United States Patent 11,098,302 (IDENTIFICATION OF POLYNUCLEOTIDES ASSOCIATED WITH A SAMPLE) - sequence listing, part 17

SEQ ID NO: 55191 - DNA, 433 bp, Homo sapiens
  misc_feature: GYAE6OF02GS22L.44.79.H02.1.454.CMB.1.raw
  modified_base (428)..(433): a, c, t, g, unknown or other
  misc_feature (428)..(433): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagccctccaccaagggccccatccggtcttccccctggccgccctgctccaggagcacctccgagagcacagcgcctgggctgcctggtcaaggacctacttccacgtctactgctgagcggctggcaaggcgcatagnnnnnn

SEQ ID NO: 55192 - DNA, 438 bp, Homo sapiens
  misc_feature: GYAE6OF02GZGGZ.44.79.H02.1.454.CMB.1.raw
  modified_base (428)..(438): a, c, t, g, unknown or other
  misc_feature (428)..(438): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcacctggtcaccgtcgcctcagcctccaccaagggcccatcggtcttccccctggccgccctgctccaggacgcacctctgggggcacagcggccctgggctgccctggtcaaggactacttcctatatactgtctgagcgggctggcaggcgcatagcnnnnnnnnnnn

SEQ ID NO: 55193 - DNA, 463 bp, Homo sapiens
  misc_feature: GYAE6OF02I2PVE.44.79.H02.1.454.CMB.1.raw
  modified_base (451)..(463): a, c, t, g, unknown or other
  misc_feature (451)..(463): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcacgccctccaccgaacgggccccagtccggtccttccccccgtggcccgcccctgcctccagggacgccaccctccgagacgccacacgccggccctgggctgcctggtcaagggctacttccacgtctactgctgacgcgggctgggcaaggcgacagtgnnnnnnnnnnnnn

SEQ ID NO: 55194 - DNA, 264 bp, Homo sapiens
  misc_feature: GYAE6OF02FR81X.44.79.H02.1.454.CMB.1.raw
  modified_base (224)..(264): a, c, t, g, unknown or other
  misc_feature (224)..(264): n is a, c, g, or t
tcagacagtatatacacgaccggtgctcgatttagtgtcacacgaagggtaaggggaaccctggtcaccgtctcctcagcctccacccaagggcccatcggtcttccccctggccgccctgcctcccaggacgcaccctcccgagagcacagcgggccctgggctgcctggtcaaggactacttcctatatactgtcctgagcgggctggcaagggcgcatagnnnnnnnnnnnnnnnnnnnnnnnnnnnnnnnnnnnnnnnnn

SEQ ID NO: 55195 - DNA, 442 bp, Homo sapiens
  misc_feature: GYAE6OF02ICKA0.44.79.H02.1.454.CMB.1.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
  modified_base (332)..(332): a, c, t, g, unknown or other
  misc_feature (332)..(332): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
  modified_base (422)..(423): a, c, t, g, unknown or other
  misc_feature (422)..(423): n is a, c, g, or t
  modified_base (425)..(442): a, c, t, g, unknown or other
  misc_feature (425)..(442): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattacngtgcgaccatatcagcgcctggactcgttcngagtacttccaagattggggccagggcacctggtcaccgtcgcctcacgctcccacaacgggccatcgtctccccnggcncctgctcnganccactccgagcgacagacgcggccctgggctgcctggtcaaggcttacttcatactactgtctgtagcgggtntggcaaggcgtnatagnngnnnnnnnnnnnnnnnnnn

SEQ ID NO: 55196 - DNA, 531 bp, Homo sapiens
  misc_feature: GYAE6OF02HGU3S.44.79.H02.1.454.CMB.1.raw
  modified_base (336)..(336): a, c, t, g, unknown or other
  misc_feature (336)..(336): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (507)..(508): a, c, t, g, unknown or other
  misc_feature (507)..(508): n is a, c, g, or t
  modified_base (510)..(510): a, c, t, g, unknown or other
  misc_feature (510)..(510): n is a, c, g, or t
  modified_base (512)..(531): a, c, t, g, unknown or other
  misc_feature (512)..(531): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggacgtccgttctgagtaccttccaaagtagttggggccagggccaccctggtccaccgtcgcctcacgcctcccaccgacggcccacgtccggtccttcccccgnggcctccctgcctccaggcgcctacctccggagacgcacgacgccggccctgggctcgccgtggtacaacgggaccttacttacctagttactaccgttcgtcgttgaacgggcggtcgacgggtacgaaacgggtccgtacaacgttaggacgtncgtangcncgcnganncncnnnnnnnnnnnnnnnnnnnn

SEQ ID NO: 55197 - DNA, 607 bp, Homo sapiens
  misc_feature: GYAE6OF02GMRFK.44.79.H02.1.454.CMB.1.raw
  modified_base (547)..(547): a, c, t, g, unknown or other
  misc_feature (547)..(547): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (580)..(580): a, c, t, g, unknown or other
  misc_feature (580)..(580): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (605)..(607): a, c, t, g, unknown or other
  misc_feature (605)..(607): n is a, c, g, or t
tcagacagtatatacacgaccggtgctcgattttagtgtcacacgaagggaaaggggctggagtgggtggccaacgtgacggcaacgatggagttagtaaattactattgcggacagtttgaaggccgattcaccatctccagagacaacgccaagaactctctgtattctgctaaattgaccagcctgagagtcgaggacacggctggtgtattactggtgacgaccgatatcaggccgtccctggagtcccgttctgagttacttccaagacttgggccagggcaccctggtcacgtcgcctcagcctccgaccgaagggcccacgtaccggtccttcccccgtagggccgcccctggccgttccgaggacgaccaacccgtaccggaacgacgaccaacgaagccggaccccttaggggaccttaggcccgttgggtaccgaaacgggtaccttaaccgtttacccgtacgtaccttaactcggaccgttaggacggccggtacggttacgggaaccgtaaacgggcctacgtaattaacggcngacagaanananagacgacgacgagacgacgcnagnagnanananagngnngngngcnnn

SEQ ID NO: 55198 - DNA, 215 bp, Homo sapiens
  misc_feature: GYAE6OF02GV2EK.44.79.H02.1.454.CMB.1.raw
  modified_base (212)..(215): a, c, t, g, unknown or other
  misc_feature (212)..(215): n is a, c, g, or t
tcagacagtatatacacgaccggtgctcgatttagtgtcacacgaagggaaagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatagnnnn

SEQ ID NO: 55199 - DNA, 686 bp, Homo sapiens
  misc_feature: GYAE6OF02H4NIR.44.79.H02.1.454.CMB.1.raw
  modified_base (207)..(207): a, c, t, g, unknown or other
  misc_feature (207)..(207): n is a, c, g, or t
  modified_base (398)..(398): a, c, t, g, unknown or other
  misc_feature (398)..(398): n is a, c, g, or t
  modified_base (621)..(621): a, c, t, g, unknown or other
  misc_feature (621)..(621): n is a, c, g, or t
  modified_base (626)..(626): a, c, t, g, unknown or other
  misc_feature (626)..(626): n is a, c, g, or t
  modified_base (630)..(630): a, c, t, g, unknown or other
  misc_feature (630)..(630): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(642): a, c, t, g, unknown or other
  misc_feature (641)..(642): n is a, c, g, or t
  modified_base (646)..(646): a, c, t, g, unknown or other
  misc_feature (646)..(646): n is a, c, g, or t
  modified_base (651)..(651): a, c, t, g, unknown or other
  misc_feature (651)..(651): n is a, c, g, or t
  modified_base (669)..(669): a, c, t, g, unknown or other
  misc_feature (669)..(669): n is a, c, g, or t
  modified_base (673)..(673): a, c, t, g, unknown or other
  misc_feature (673)..(673): n is a, c, g, or t
  modified_base (678)..(678): a, c, t, g, unknown or other
  misc_feature (678)..(678): n is a, c, g, or t
  modified_base (682)..(682): a, c, t, g, unknown or other
  misc_feature (682)..(682): n is a, c, g, or t
tcagacagtatatacacgaccggtgctcgatttagtgtcacacgaagggaaaggggctggagtgggtggccaacgtgaggcaagatggagttagtaaatactatgcggacagtttgaaggccgattcaccatctccagagacaaccgccaaagaactctcgtgtatctgacaaatgaccagcctgagagtgaggacacggctggttntattactggtgaccgactatactacgagaccgccgtagggtacgttccgtttacgtgtacgtttaacttaccgaaaggtagtttcgggggaccaaggggtcccacccgtcggtaccaccccggtccgtaccctgaccgtccctaccccgacgaaccgggtaccccagttcccggttccctttaccccccgngggtcccgaccccgtgacccgtccgacggggtacctacccgaaccgttcccggaagcgaccaaggaccggcccgggtaccccgtgggccttaccggcccggttaggtaacccggtaaacggtaccctttaccgtttaccgtaacgttaccgttacgtttacggtccgtacggacggtccggggtacttaccgggacgaaacggccggtaacgaagttaccggngtacncganctagagngncnngcgncgtanacagtcgcgatctagacncagncgtcntcgngtag

SEQ ID NO: 55200 - DNA, 248 bp, Homo sapiens
  misc_feature: GYAE6OF01DDI2V.16.67.G01.1.454.CMB.1.raw
  modified_base (242)..(248): a, c, t, g, unknown or other
  misc_feature (242)..(248): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctggtcactctgttcccaccctcctcgagtagtacactgagcgggctggcaaggcgcatagnnnnnnn

SEQ ID NO: 55201 - DNA, 247 bp, Homo sapiens
  misc_feature: GYAE6OF01BCRYZ.16.67.G01.1.454.CMB.1.raw
  modified_base (244)..(247): a, c, t, g, unknown or other
  misc_feature (244)..(247): n is a, c, g, or t
tcagtgtactactccacgaccggtgctcgatttagagtatacatattgggtttgggggtgtggtggtcgtccactcccgccttgacgaggctgactactactgtcagtcttttaatgacaccgttgtgatattcggcggagggaccaagctgaccgtcctaggtcagcccaaggctgccccctcggtcactctgttcccgccctcctcgagtagtacactgagcgggctggcaaggcgcatagnnnn

SEQ ID NO: 55202 - DNA, 254 bp, Homo sapiens
  misc_feature: GYAE6OF01AZ28R.16.67.G01.1.454.CMB.1.raw
  modified_base (243)..(254): a, c, t, g, unknown or other
  misc_feature (243)..(254): n is a, c, g, or t
tcagtgtactactccacgaccggtgctcgatttagagtatacatattgggtttggggtgtggtggtctccactcccgccttgacgaggctgactactactgtcagtcttttaatgacaccgttgtgatattcggcggagggtaccaagctgaccgtcctaggtcagcccaaggctgccccctggtcactctgttcccaccctcctcgagtagtacactgagcgggctggcaaggcgcgatagnnnnnnnnnnnn

SEQ ID NO: 55203 - DNA, 243 bp, Homo sapiens
  misc_feature: GYAE6OF01EL1ZK.16.67.G01.1.454.CMB.1.raw
  modified_base (243)..(243): a, c, t, g, unknown or other
  misc_feature (243)..(243): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccgccctcctcgagtagtacactgagcgggctggcaaggcgcatagn

SEQ ID NO: 55204 - DNA, 241 bp, Homo sapiens
  misc_feature: GYAE6OF01DHSWQ.16.67.G01.1.454.CMB.1.raw
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccacctcctcgagtagtacactgagcgggctggcaaggcgcatag

SEQ ID NO: 55205 - DNA, 246 bp, Homo sapiens
  misc_feature: GYAE6OF01E1PXE.16.67.G01.1.454.CMB.1.raw
  modified_base (242)..(246): a, c, t, g, unknown or other
  misc_feature (242)..(246): n is a, c, g, or t
tcagtgtactactccacgaccggtgctcgatttagagtatacatattgggtttgggggtgtggtggtctccactcccgccttgacgaggctgactactactgtcagtctttaatgacaccgttgtgatattcggcggagggaccaagctgaccgtcctaggtcagcccaaggctgccccctggtcactctgttcccgccctcctcgagtagtacactgagcggggctggcaaggcgcatagnnnnn

SEQ ID NO: 55206 - DNA, 546 bp, Homo sapiens
  misc_feature: GYAE6OF01E02RP.16.67.G01.1.454.CMB.1.raw
  modified_base (156)..(156): a, c, t, g, unknown or other
  misc_feature (156)..(156): n is a, c, g, or t
  modified_base (177)..(177): a, c, t, g, unknown or other
  misc_feature (177)..(177): n is a, c, g, or t
  modified_base (179)..(179): a, c, t, g, unknown or other
  misc_feature (179)..(179): n is a, c, g, or t
  modified_base (181)..(183): a, c, t, g, unknown or other
  misc_feature (181)..(183): n is a, c, g, or t
  modified_base (185)..(186): a, c, t, g, unknown or other
  misc_feature (185)..(186): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (194)..(196): a, c, t, g, unknown or other
  misc_feature (194)..(196): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (223)..(223): a, c, t, g, unknown or other
  misc_feature (223)..(223): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (246)..(247): a, c, t, g, unknown or other
  misc_feature (246)..(247): n is a, c, g, or t
  modified_base (251)..(251): a, c, t, g, unknown or other
  misc_feature (251)..(251): n is a, c, g, or t
  modified_base (253)..(254): a, c, t, g, unknown or other
  misc_feature (253)..(254): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
tcagtgtactactccacgaccggtgctcgatttagagtatacatattgggtttggggagctctgagagaggagcccagccctgggatttccaggtgttttcatttgggatcaggactgaacagagagaactcaccatggagttagggctgagcggngtgttctaggcgcattaaggncngnnngnnancngtgnnnggngntgcngctgggccngagctcncngngcgactctgnttnccttancnntatncnngngcgtcggcgcgngcgcgaggaggngngngtgtctacatagtagtgtgtgtcgtacacactactctcgtcgtcgtcgtacggacggtccggtcgtcctactctacacgacgtactacctaactaacgaacgtacgtacgtactcgtacgacgtacgacgacacgacgcccccccccccccccccccgacgagacgacgacgacgacgacgtactatacgttacgtagtacgtacgaagtacgtaccgtaccgttacccgtaccgtacgtacgtagtcgtacgtaacgtaac

SEQ ID NO: 55207 - DNA, 245 bp, Homo sapiens
  misc_feature: GYAE6OF01ENMDW.16.67.G01.1.454.CMB.1.raw
  modified_base (244)..(245): a, c, t, g, unknown or other
  misc_feature (244)..(245): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccgccctcctcgagtagtacaactgagcgggctggcaaggcgcatagnn

SEQ ID NO: 55208 - DNA, 589 bp, Homo sapiens
  misc_feature: GYAE6OF01APK1H.16.67.G01.1.454.CMB.1.raw
  modified_base (157)..(157): a, c, t, g, unknown or other
  misc_feature (157)..(157): n is a, c, g, or t
  modified_base (342)..(342): a, c, t, g, unknown or other
  misc_feature (342)..(342): n is a, c, g, or t
  modified_base (390)..(390): a, c, t, g, unknown or other
  misc_feature (390)..(390): n is a, c, g, or t
tcagtgtactactccacgaccggtgctcgatttagagtatacatattgggtttggggagctctgagagaggagcccagccctgggatttccaggtgttttcatttgggatcaggactgaacagagagaactcaccatggagttagggctgagcgtgngtttctaggtggctattttaaaggtgtcagtgtgagtgcagctgttggagtctgggggaggcttggtacagcctggggggtccctgagactctcctgtgcgacctctggattcacctttagcagctatgccatgagctgggtccgccaggctccgagggaaggggctgggagtgggtctcaactnttagtggtagtggtggtacacgatacttgctgactcgtgaggcgttcncatctcagagacacttccaagaacacgtgtatctgcaagtgcacagcctagacgacgtacccgagggaaccaccgggacctaagtaacgttacttaaccgtggttacggaccggtaaaaggacttacccgggtaaacctttccccccccgtacgggttaaccggaagtaccgttcgggaacccttaaacgttaaaaacg

SEQ ID NO: 55209 - DNA, 243 bp, Homo sapiens
  misc_feature: GYAE6OF01CFY72.16.67.G01.1.454.CMB.1.raw
  modified_base (241)..(243): a, c, t, g, unknown or other
  misc_feature (241)..(243): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctggtcactctgttcccaccctcctgagtagtacactgagcgggctggcaaggcgcatagnnn

SEQ ID NO: 55210 - DNA, 246 bp, Homo sapiens
  misc_feature: GYAE6OF01C7M2S.16.67.G01.1.454.CMB.1.raw
  modified_base (243)..(246): a, c, t, g, unknown or other
  misc_feature (243)..(246): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggtggagggaccaagctgaccgtcctaggtcagcccaaggctgccccctcggtcactctgttcccgccctcctcgagtagtacactgagcgggctggcaaggcgcatagnnnn

SEQ ID NO: 55211 - DNA, 244 bp, Homo sapiens
  misc_feature: GYAE6OF01AZDDH.16.67.G01.1.454.CMB.1.raw
  modified_base (243)..(244): a, c, t, g, unknown or other
  misc_feature (243)..(244): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccaccctcctcgagtagtacactgagcgggctggcaaggcgcatagnn

SEQ ID NO: 55212 - DNA, 544 bp, Homo sapiens
  misc_feature: GYAE6OF01BUXJH.16.67.G01.1.454.CMB.1.raw
  modified_base (302)..(302): a, c, t, g, unknown or other
  misc_feature (302)..(302): n is a, c, g, or t
  modified_base (393)..(393): a, c, t, g, unknown or other
  misc_feature (393)..(393): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtctggggaggcttggtacagcctggggggtccctgagactctcctgtgcgacctctggattcacctttagcagctatgccatgagctgggtccnccaggctccgagggagggctggagtgggtctcaactattagtggtagtggtggtaccacatacttcgctgactccgtgaacgggccgttcnccatcctccagacgacacttaccaagaacacggtatatctgcaagtcgacacagcctgacgagaccgaggaccacggccatatattactgtgacgaagactacgaccttcccccgccgtaagacgtataggactaacaaattctttacccg

SEQ ID NO: 55213 - DNA, 247 bp, Homo sapiens
  misc_feature: GYAE6OF01DNKWM.16.67.G01.1.454.CMB.1.raw
  modified_base (244)..(247): a, c, t, g, unknown or other
  misc_feature (244)..(247): n is a, c, g, or t
tcagtgtactactccacgaccggtgctcgatttagagtatacatattgggtttggggggtgtggtggtctccactcccgccttgacgaggctgactactactgtcagtcttatgataacaccagggtggtgttcggcggagggaccaagctggccgtcctaggtcagcccaaggctgccccctcggtcactctgttcccgccctcctcgagtagtacactgagcgggctggcaaggcgcatagnnnn

SEQ ID NO: 55214 - DNA, 244 bp, Homo sapiens
  misc_feature: GYAE6OF01DSOSV.16.67.G01.1.454.CMB.1.raw
  modified_base (244)..(244): a, c, t, g, unknown or other
  misc_feature (244)..(244): n is a, c, g, or t
tcagtgtactactccacgaccggtgctcgatttagagtatacatattgggtttggggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccgccctcctcgagtagtacactgagcgggctggcaaggcgcatagn

SEQ ID NO: 55215 - DNA, 243 bp, Homo sapiens
  misc_feature: GYAE6OF01CLHSW.16.67.G01.1.454.CMB.1.raw
  modified_base (243)..(243): a, c, t, g, unknown or other
  misc_feature (243)..(243): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccaccctcctcgagtagtacactgagcgggctggcaaggcgcatagn

SEQ ID NO: 55216 - DNA, 243 bp, Homo sapiens; identical to SEQ ID NO: 55203
  misc_feature: GYAE6OF01AU558.16.67.G01.1.454.CMB.1.raw
  modified_base (243)..(243): a, c, t, g, unknown or other
  misc_feature (243)..(243): n is a, c, g, or t

SEQ ID NO: 55217 - DNA, 683 bp, Homo sapiens
  misc_feature: GYAE6OF01CQMLI.16.67.G01.1.454.CMB.1.raw
  modified_base (309)..(309): a, c, t, g, unknown or other
  misc_feature (309)..(309): n is a, c, g, or t
  modified_base (416)..(416): a, c, t, g, unknown or other
  misc_feature (416)..(416): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggctttttctgtggcttaattttaaaaggtgtccagtgtgaggtgcagctgttggagtcgtgggggaggcgttggtacaggccgtggggggtccctgagactctcctgtgcgactcgtgattcacctttagcagctatgccatgagcgtgggtcccnccgaggctccgagggtaagggctgggagtgggtctcaactagttagtggtagtggtcgtaccatatacttcgcttgaccttccggtaggaacggggtcccggtttcnccgattccgtccgtagacgacctaaccttaccaaaaggtaaccgtacgggttacgtaagtccttaggactaaacggtgacctaaccgacggtcccgtagggaacgaaccgggcccggaaacgggacccgaacccgggaccctaagttaacttaacgtttacgtagggttacgaaccggtaaaagtccgttaccgtaaccctttcccccccggtaccgttaaggacgtacgttacggtaccttaaactaaagtttcccttttaacccg

SEQ ID NO: 55218 - DNA, 576 bp, Homo sapiens
  misc_feature: GYAE6OF01DHAM2.16.67.G01.1.454.CMB.1.raw
  modified_base (230)..(230): a, c, t, g, unknown or other
  misc_feature (230)..(230): n is a, c, g, or t
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
  modified_base (419)..(419): a, c, t, g, unknown or other
  misc_feature (419)..(419): n is a, c, g, or t
  modified_base (459)..(459): a, c, t, g, unknown or other
  misc_feature (459)..(459): n is a, c, g, or t
  modified_base (486)..(486): a, c, t, g, unknown or other
  misc_feature (486)..(486): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagcggtgtcgtttctaggtcggctaatttaaaaggtgtcagtgtgaggtgcagctggtggagtcgtgggggaggcttggacngccggtcgggggtccctgagctctcctgcgcgacctgtggnttcacctttagcagctancgccatgcgcgtggcccgccgaggcctaccggagggaggctgggngtcgggttcacgaattagttaggtggtacggtggtacggtaccatacttacgttcgctagacctccggtaggaacgggtccttcnctatcctacgagacacaccttacgaaacgtaaccagggtntatcagtacaaggcacacgcgtccagngacgcgacggactcgactatatactagtcgngaacgaangtcgtaccttcccctagtagacgtgacgtaataaacgtaaattcttaaccg

SEQ ID NO: 55219 - DNA, 661 bp, Homo sapiens
  misc_feature: GYAE6OF01EHPVJ.16.67.G01.1.454.CMB.1.raw
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
tcagtgtactactccacgaccggtgctcgatttagagtatacatattgggtttggggtctgagagaggagcccagccctgggatttccaggttgttttcatttggggatcaggactgaacagagagaactcaccatggagttagggctgagcgtggtctttttcttgtggctaattttaaaaggtgtccagtgtgaggtgcagctgttggagtcgtgggggaggcttggtacaggccgtggggggtccctgagctctcctgtgcgacctctggattcacctttagcagctatgccatgagcgtggtcccgccaggctccgagggaggggctggagtgggtctcaactagtnaagttggtagtcgtgtacactnactttgctcgactacggtcgtaaggcccgttatccactctccacgacgtaccaagttacccaaggtaacacggttacgtagtcctagcaagtcgacacctagaccctaggacgaaggccccgaaaggggacccaacgggtaccctaagttaaccttagtttaaccgtacgggttaacggaccggttaaaacggtaactttacccccggtaacgttttacccccccgtaacccggttaacgtacgggtaacttaacgggtaaaccttaaccgttaaaaacgttaccccg

SEQ ID NO: 55220 - DNA, 244 bp, Homo sapiens; identical to SEQ ID NO: 55211
  misc_feature: GYAE6OF01EOMHP.16.67.G01.1.454.CMB.1.raw
  modified_base (243)..(244): a, c, t, g, unknown or other
  misc_feature (243)..(244): n is a, c, g, or t

SEQ ID NO: 55221 - DNA, 243 bp, Homo sapiens
  misc_feature: GYAE6OF01DZAT8.16.67.G01.1.454.CMB.1.raw
  modified_base (239)..(243): a, c, t, g, unknown or other
  misc_feature (239)..(243): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggaggaccaagctgaccgtctaggtcagcccaaggctgcccctggtcactctgttcccgccctcctcgagtagtacactgagcgggctggcaaggcgcatagnnnnn

SEQ ID NO: 55222 - DNA, 790 bp, Homo sapiens
  misc_feature: GYAE6OF01B0XGN.16.67.G01.1.454.CMB.1.raw
  modified_base (186)..(186): a, c, t, g, unknown or other
  misc_feature (186)..(186): n is a, c, g, or t
tcagtgtactactccacgaccggtgctcgatttagagtatacatattgggtttggggagctctgagagaggagcccagccctgggatttccaggtgttttcatttggggatcaggactgaacagagagaactcaccatggagttagggctgagcggtcgtgttctaggtcggctaattttaaaggntcagtgtgaggtgcagctgttggagtcgtgggggagcttggtacagccgtgggggtccctggagctctcctgcgcgacctgtggtattctacctttagcagtcctagtcgaccaattggcgcgttcgggggccccaacgacgggcctcccggaagggggaccgggtacgttaggggacgttcggggtcctaccgtaagttaaagtttcgggtagggttaggtcggtacgggttacccacttaacgttctccgtgttcgaccgttccggtacgggtaacgggttccccggtttaacctccgtaactttccctaccggtaacgtaacggaaccttacccgttaaaccgaaacggttaaaccgaaccggtttgttaacgtttccgacgtaacccgtaagttaccggacctaacggacgttacccgtaggaaccgggacgacccgggttaaccgggacctaccgggacctaaagtttaccttaaagttccgttaacggagggtaaacccgtaaggtaacgggttcccccctttaacccggttaccccccttaggggtaaaccgtaggttaaccgtaccgggttaaaccttaaacccgtttaaaacccg

SEQ ID NO: 55223 - DNA, 275 bp, Homo sapiens
  misc_feature: GYAE6OF01C4M3M.16.67.G01.1.454.CMB.1.raw
  modified_base (251)..(275): a, c, t, g, unknown or other
  misc_feature (251)..(275): n is a, c, g, or t
tcagtgtactactccacgaccggtgctcgatttagagtatacatattgggtttgggggggtggtggtggtctccactcccgccttgacgaggctgactactactgtcagtccttttaatgacacccgttgtgatattcggcggagggaccaagctgaccgtcctaggtcagcccaaggttgccccctcggtcactcctgttccccacctcctcgagtacgtacactgaggcgggctggcaaggcgcatagnnnnnnnnnnnnnnnnnnnnnnnnn

SEQ ID NO: 55224 - DNA, 250 bp, Homo sapiens
  misc_feature: GYAE6OF01AZI1P.16.67.G01.1.454.CMB.1.raw
  modified_base (245)..(250): a, c, t, g, unknown or other
  misc_feature (245)..(250): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctcgccccctcggtcactctgttcccaccctcctcgagtagtacactggagcgggctggcaaggcgcatagnnnnnn

SEQ ID NO: 55225 - DNA, 589 bp, Homo sapiens
  misc_feature: GYAE6OF01C4X5A.16.67.G01.1.454.CMB.1.raw
  modified_base (156)..(156): a, c, t, g, unknown or other
  misc_feature (156)..(156): n is a, c, g, or t
  modified_base (185)..(185): a, c, t, g, unknown or other
  misc_feature (185)..(185): n is a, c, g, or t
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
tcagtgtactactccacgaccggtgctcgatttagagtatacatattgggtttggggagctctgagagaggagcccagccctgggatttccaggttgttttcatttgggatcaggactgaacagagagaactcacatggagttagggctgagcggngtcgttcgtaggcggtctaatttaaaggngtcagtgtgagcgcagtctgtagtgcgtggggagtcttgacngtcggtgggtccagganctcctgtgngacnctntggcttctaccggtaanctagtctagcncngngngcgtcgtcgcgacgcgtacggagggagngtgagtgtctactagtagtagtaggtgtagtacgtacactactcgtcgtcgtacgtacgtacgtacggtacgtcgtcgtactacgtactacgacacgtactactaacgtaacgtacgtagtagtagtcgtcgtacgtacgtacgacgacgacgacgacggacggacggacgaacgacgacgtactaatactagtacgtacgacgaacgtaacgtacgtaccgtacccgtaccgtacgtacgtacgtaacgtacgtaacttaactaac

SEQ ID NO: 55226 - DNA, 247 bp, Homo sapiens
  misc_feature: GYAE6OF01AYPYH.16.67.G01.1.454.CMB.1.raw
  modified_base (236)..(236): a, c, t, g, unknown or other
  misc_feature (236)..(236): n is a, c, g, or t
  modified_base (242)..(247): a, c, t, g, unknown or other
  misc_feature (242)..(247): n is a, c, g, or t
tcagtgtactactccacgaccggtgctcgatttagagtatacatattgggtttggggggtgtggtggtctccactcccgccttgacgaggctgactactactgtcagtcttttaatgacaccgttgtgatattcggcggagggaccaagctgaccgtcctaggtcagcccaaggctgccccctggtcactctgttcccaccctctcgagtagtacactgagcgggctggcaaggcncatagnnnnnn

SEQ ID NO: 55227 - DNA, 245 bp, Homo sapiens
  misc_feature: GYAE6OF01CARRG.16.67.G01.1.454.CMB.1.raw
  modified_base (243)..(245): a, c, t, g, unknown or other
  misc_feature (243)..(245): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccaccctcctcgagtagtacactgagcgggctggcaaggcgcatagnnn

SEQ ID NO: 55228 - DNA, 697 bp, Homo sapiens
  misc_feature: GYAE6OF01A8Q5Z.16.67.G01.1.454.CMB.1.raw
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggtctttttcttgtggcttaattttaaaaggtgtccagtgtgaggtgcagctgttggagtcgtgggggagtcttggtacaggccgtgggggtccctggagactctcctgtcgcgtacctcgtggtattcacctttagcagctatcgcatgagcgtcggtccgcgaggcctacggaggggacgggtctgggagtcggtactactaacgttagttaggtggtagtggtacgtacctagtacttacgtctcgtacgacgtccggtaggaacggggttcccggttactcccgtagttaccgacctaagggaccgtaaccttacccgttaaccgaaaacggtaaccgtcgggttattacgttcgacggtaacgtaaggtcgaacacgtaccggcgtaggacgtaaccggccgaaagggtaccgacggtacctaattacgtaacttaccggtgaaccggaacggtaaacggtccgtaaagggtactcggaaccgttgggtacccgtacgttacgggaacccaacgggttccggggaacccgttaaccgggg

SEQ ID NO: 55229 - DNA, 909 bp, Homo sapiens
  misc_feature: GYAE6OF01DGR5K.16.67.G01.1.454.CMB.1.raw
tcagtgtactactccacgaccggtgctcgatttagagtatacatattgggtttggggtctgagagaggagcccagccctgggatttccaggtgttttcatttgggatcaggactgaacagagagaactcaccatggagttaggctgagctggtctttttcttgtggtcttaagttttaaaaggtgtccagtgtgaggtgcagcttgttggagtcggtgggggaggtcgttggtacgacggccggttcggggggttccccttggacgtaccgttccttccgtggtcggacccgtaccgtcgttaggtacctttccgtaacccttttagccgtaacgtccttaagtcgacccgtagttaggacgtccggttaccggggttacccggacggtaaccggtccggtaccggggaaacggggggtaacggggtaccggttaggggtaacgggtttccggggttacccttaaccggtaaaccgttttaaggtttaagggttacgggttagggttacggggttaaccgggttaaccctaacgtaacgtttaccgtttaccggacgttacggtacccgtttaccgggtacggtaacccgggggttcccggtttaccctacccgtaaccttccggtaccgaacgtaaccggtacctaaaccctttacccgaaaagtaaacccgggtaacgttacggtaaacttcccggtaagtaacgtaaacggttaccgaaccgtaacggtaccggtaccggtacggaaccgggaaccgaccgggaacccggtaaaccggaacccggtaaccttaaagttacttaaccgtttagtacggttacgaacgtaaaagtccttacccgttaccctccccggtacgtaaagcgtaaacgtccgaatttaaaccttaacgttccgtttaacccg

SEQ ID NO: 55230 - DNA, 833 bp, Homo sapiens
  misc_feature: GYAE6OF01AO8W1.16.67.G01.1.454.CMB.1.raw
tcagtgtactactccacgaccggtgctcgatttagagtatacatattgggtttggggtctgagagaggagcccagccctgggatttccaggttgttttcatttggggatcaggactgaacagagagaactcaccatggagttagggctgagctggtctttttcttgtggcttaattttaaaaggtgtccagtgtgaggtgcagctgttggagtcggtgggggagtcgttagtacgagtccgtggggggtccctgacgtccgtctccgtggtcgccgtacctcgtggtacttcctacctttagctacgtactagtcggacctagtagacgtccggtcggggtcccgaccggacggccgtaccgggaaggggacggggcgttagggtacggtgggttacctacgtaaacttaggtttaaggtagggttacggttcgggtaacggtaaccctaacgtaacgtttacccgttcgtaccggttacggtaaccggttacccggggtacgggtaaaccggggtttccccggtttaccgtaccctaacggtttcccttaaccgaacggtaacgttaaccctaaccgtttaaaccaaacgggtaaacccgtacgggttaacttaccgttacgtaccgtaacgttaacggacgtaacccgaacgtaccggtacccgtaggggaacgacccgggacccggaagggaacccgtacggaccttaagttaaccgtttagtaccgttggaaaccggtaagtaacgtaccgttacgtaacccccgttccccgtaacggtagaacggtacgttacggtaaacctttaaagtacttttcccgtttaacccg

SEQ ID NO: 55231 - DNA, 244 bp, Homo sapiens; identical to SEQ ID NO: 55211
  misc_feature: GYAE6OF01ATNOA.16.67.G01.1.454.CMB.1.raw
  modified_base (243)..(244): a, c, t, g, unknown or other
  misc_feature (243)..(244): n is a, c, g, or t

SEQ ID NO: 55232 - DNA, 799 bp, Homo sapiens
  misc_feature: GYAE6OF01BU14Z.16.67.G01.1.454.CMB.1.raw
tcagtgtactactccacgaccggtgctcgatttagagtatacatattgggtttggggagctctgagagaggagcccagccctgggatttccaggtgttttcatttgggatcaggactgaacagagagaactcaccatggagttagggctgagctggtctttttcttgtggcttattttaaaaggtgtcagtgtgaggtgcagctgttggagtcgtgggggaggtcttggtacaggccggttgggggggtacccctggacgtaccttccgtccgttggtcgccgtacctcttgggtactttacctaccttttagctaaggtcttaatcgacctaagtggacggtccgtcgggtcccgaccgacgggccgtaccggaagggggaacggggcggtgggtaaggttcggggtaccttacgtaaaccgttagtttaaggtggggttaaggttcggggttacggttaaaccctaacgtaactttaccgttccgacggttcgaccgtttccgggtaggtaacggggtcccgtttacctccgtactccctaccgaagacgtaactacctaccgaaacgtaacgtacggttacgtaacttcgtacgtacgtaagttcgacaaccgacgtaccgtagaacggtacgggaccgggaacggaaccggtaaccgggaccctaagttaacgtttaactttacggtacgttaacggtaacggtaaaaccgtacggttacccgttaacccctttccccccgttaaacggttacggaacggttaaccgtacggttaaccgtaaacctttaaaaccg

SEQ ID NO: 55233 - DNA, 855 bp, Homo sapiens
  misc_feature: GYAE6OF01C0JSM.16.67.G01.1.454.CMB.1.raw
  modified_base (249)..(249): a, c, t, g, unknown or other
  misc_feature (249)..(249): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggtctttttcttgtggtcttaagttttaaaaggtgttccagtgtggaggtgcagtcgtggttgggaggttcggtggggggaggtcgttgggttaacncggtccggttcgggggggttcccctaggtaacggtaccttccgttccgtggtcgccgtaccttcgtggtaactttcctaccgtttagctacgtctacgtcgaccagtcgacggtccgtcgggggtcccgccggtacggtcccggtacgggaacgggggtaacggggtcggttaggggaggttccgggtactttaaccgtaaagtttaggtttaagggtaggggttacgggttcgggttaccggtttaacctaacgttacgttaccgttcggtacgtacggtaacccgttcgggtaccgggtaacggggttccccgttttactacccgtacgttaccgtaccgaacggaaccgtaaccttaaccgttaccgaaaacggttaaccgttacggttaacgttaacgttcgtagggaacgtaacggtcgaaccacgaccgtaccggtaaggacggacccgaacccgggaccggtaaccgaccggtactaaacgtttacttaacgttacgttaacggcgttaaacggaacgttccgtacccgttaccccgttaccccgtacgggtaacacggtacgttacgaaccttaaaacgttaacgtttcgttaacccg

SEQ ID NO: 55234 - DNA, 328 bp, Homo sapiens
  misc_feature: GYAE6OF01BOB9R.16.67.G01.1.454.CMB.1.raw
  modified_base (260)..(261): a, c, t, g, unknown or other
  misc_feature (260)..(261): n is a, c, g, or t
  modified_base (263)..(328): a, c, t, g, unknown or other
  misc_feature (263)..(328): n is a, c, g, or t
tcagtgtactactccacgaccggtgctcgatttagagtatacatattgggtttggggggtggtggtggtctccactcccgccttgacgaggctgacttactactgttcagttcttttaatgacaccgttgtgatatcggcggaggaccaagctgaccgttcctaggtcagcccaaggtccttcgcccccgtggtcacttctcgttccccgcctcctcgagtagtacactgaggcgggctgggacgaaggcgacaagtggnngnnnnnnnnnnnnnnnnnnnnnnnnnnnnnnnnnnnnnnnnnnnnnnnnnnnnnnnnnnnnnnnnnn

SEQ ID NO: 55235 - DNA, 636 bp, Homo sapiens
  misc_feature: GYAE6OF01D4ITY.16.67.G01.1.454.CMB.1.raw
  modified_base (448)..(448): a, c, t, g, unknown or other
  misc_feature (448)..(448): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggtcttttttcttgtggcttaattttaaaaggtgtccagtgtgaggtgcagctgttggagtcgtgggggagcttggtacagccgtgggggtccctgagacctctcctgtcgccgtacctcgtggtactttcctaccttttagcagtctatcgccatgagcgtcgggtcccgccgacggccgtaccggagggggaacggggcgtgggaggttgggtctacgtaacgttagttaggtggtaggtgggtacggtaccatataccgttcgctcgaccgtccgtgggaacgggtccgttcnctatcctacagacactactacaacgaacgacggtgtactcgtgacgaagtcgacacgacgaccgtgacggacgccgaagggaccgacggacaattataacgttactgtacgaacgtaagtacgtaccgtacccttcccccgtacgtagaacgtcgtacggtacctaaactaaacgttccgtttaaccg

SEQ ID NO: 55236 - DNA, 736 bp, Homo sapiens
  misc_feature: GYAE6OF01DNQ6T.16.67.G01.1.454.CMB.1.raw
  modified_base (338)..(338): a, c, t, g, unknown or other
  misc_feature (338)..(338): n is a, c, g, or t
  modified_base (616)..(616): a, c, t, g, unknown or other
  misc_feature (616)..(616): n is a, c, g, or t
  modified_base (642)..(642): a, c, t, g, unknown or other
  misc_feature (642)..(642): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
  modified_base (672)..(672): a, c, t, g, unknown or other
  misc_feature (672)..(672): n is a, c, g, or t
tcagtgtactactccacgaccggtgctcgatttagagtatacatattgggtttgggtctgagagaggagcccagccctgggatttccaggtgttttcatttggggatcaggactgaacagagagaactcaccatggagttagggctgagctggtctttttcttgtggtcttaattttaaaggtgtccagtgtgaggtgcagtcgttgttggagtcggtggggaggtcttggtacacggtccggtgggggtccctgagtacctctcctgtcgcgtacctcgtgtacttctacctttacgcaacgtcctatcgacctagtcggacgtcggtcgggtcccncggacggtccgtaccggagggggaacggtcgtggggtaggtcgggttctactaagttagtttaggtcggttaggttcggggtacggtaccctacgtttaacttaccgtttccgattaccggtaccttccgggagggttaccggggtccctttaccttccaacttccaccggtaagacccgtaaacccttacgttaaacccgaaacgtaacggttaaccggttaagttcgtcccttacgtaccggaacgttcgacctacggacctacgtggaacccggnggaacccggaactacgaccgtaactnttaacgtnttaccgngtacgacgaaacgtnttaccccgaccgtttccccgagtagagttaccgttagaacttaaactaacctttcgtttaaccg

SEQ ID NO: 55237 - DNA, 265 bp, Homo sapiens
  misc_feature: GYAE6OF01EFHH4.16.67.G01.1.454.CMB.1.raw
  modified_base (248)..(265): a, c, t, g, unknown or other
  misc_feature (248)..(265): n is a, c, g, or t
tcagtgtactactccacgaccggtgctcgatttagagtatacatattgggtttggggggtgtggtggtctccactcccgccttgacgaggctgactactactgtcagtcttttaatgacaccgttgtgatattcggcggaggaccaagctgaccgtcctaggtcagcccaaggcctcgccccctcggtcactctcgttcccaccctcctcgagtacgtacactgagcgggctcggcaaggcgcatagnnnnnnnnnnnnnnnnnn

SEQ ID NO: 55238 - DNA, 249 bp, Homo sapiens
  misc_feature: GYAE6OF02I14VA.16.67.G01.1.454.CMB.1.raw
  modified_base (241)..(249): a, c, t, g, unknown or other
  misc_feature (241)..(249): n is a, c, g, or t
tcagtgtactactccacgaccggtgctcgatttagagtatacatattgggtttgggggtgtggtggtctccactcccgccttgacgaggctgactactactgtcagtctttaatgacaccgttgtgatattcggcggagggaccaagctgaccgtcctaggtcagcccaaggctgccccctcggtcactctgttcccacctcctcgagtagtacactgagcgggctggcaaggcgcatagnnnnnnnnn

SEQ ID NO: 55239 - DNA, 241 bp, Homo sapiens
  misc_feature: GYAE6OF02GKD73.16.67.G01.1.454.CMB.1.raw
  modified_base (241)..(241): a, c, t, g, unknown or other
  misc_feature (241)..(241): n is a, c, g, or t
tcagtgtactactccacgaccggtgctcgatttagagtatacatattgggtttggggtgtggtggtctccactcccgccttgacgaggctgactactactgtcagtctttaatgacaccgttgtgatattcggcggagggaccaagctgaccgtcctaggtcagcccaaggctgccccctcggtcactctgttcccaccctcctcgagtagtacactgagcgggctggcaaggcgcatagn

SEQ ID NO: 55240 - DNA, 244 bp, Homo sapiens
  misc_feature: GYAE6OF02HVVVX.16.67.G01.1.454.CMB.1.raw
  modified_base (243)..(244): a, c, t, g, unknown or other
  misc_feature (243)..(244): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccgccctcctcgagtagtacactgagcgggctggcaaggcgcatagnn

SEQ ID NO: 55241 - DNA, 244 bp, Homo sapiens; identical to SEQ ID NO: 55240
  misc_feature: GYAE6OF02GIL7C.16.67.G01.1.454.CMB.1.raw
  modified_base (243)..(244): a, c, t, g, unknown or other
  misc_feature (243)..(244): n is a, c, g, or t

SEQ ID NO: 55242 - DNA, 244 bp, Homo sapiens
  misc_feature: GYAE6OF02FO03G.16.67.G01.1.454.CMB.1.raw
  modified_base (242)..(244): a, c, t, g, unknown or other
  misc_feature (242)..(244): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccgcctcctcgagtagtacactgagcgggctggcaaggcgcatagnnn

SEQ ID NO: 55243 - DNA, 243 bp, Homo sapiens; identical to SEQ ID NO: 55215
  misc_feature: GYAE6OF02F4X2Z.16.67.G01.1.454.CMB.1.raw
  modified_base (243)..(243): a, c, t, g, unknown or other
  misc_feature (243)..(243): n is a, c, g, or t

SEQ ID NO: 55244 - DNA, 245 bp, Homo sapiens; identical to SEQ ID NO: 55227
  misc_feature: GYAE6OF02I09FS.16.67.G01.1.454.CMB.1.raw
  modified_base (243)..(245): a, c, t, g, unknown or other
  misc_feature (243)..(245): n is a, c, g, or t

SEQ ID NO: 55245 - DNA, 243 bp, Homo sapiens
  misc_feature: GYAE6OF02IQZ6K.16.67.G01.1.454.CMB.1.raw
  modified_base (242)..(243): a, c, t, g, unknown or other
  misc_feature (242)..(243): n is a, c, g, or t
tcagtgtactactccacgaccggtgctcgatttagagtatacatattgggtttgggggtgtggtggtctccactcccgccttgacgaggctgactactactgtcagtctttaatgacaccgttgtgatattcggcggagggaccaagctgaccgtcctaggtcagcccaaggctgccccctcggtcactctgttcccaccctcctcgagtagtacactgagcgggctggcaaggcgcatagnn

SEQ ID NO: 55246 - DNA, 316 bp, Homo sapiens
  misc_feature: GYAE6OF02FUGDJ.16.67.G01.1.454.CMB.1.raw
  modified_base (254)..(254): a, c, t, g, unknown or other
  misc_feature (254)..(254): n is a, c, g, or t
  modified_base (257)..(316): a, c, t, g, unknown or other
  misc_feature (257)..(316): n is a, c, g, or t
tcagtgtactactccacgaccggtgctcgatttagagtatacatattgggtttggggggtgtggtggtctccaccggtccccgccttgacgaggcctgactactactgtcagtcttttaatgtacaccgttgtgatattcggcggagggaccaaggcctgaccgtcctaggtcaaggcccaaggctggcccccctcggtacactctgttcccaccctcctcgagtagtacactgagcggctggcaaggcgctanagnnnnnnnnnnnnnnnnnnnnnnnnnnnnnnnnnnnnnnnnnnnnnnnnnnnnnnnnnnnn

SEQ ID NO: 55247 - DNA, 244 bp, Homo sapiens; identical to SEQ ID NO: 55211
  misc_feature: GYAE6OF02HM1CZ.16.67.G01.1.454.CMB.1.raw
  modified_base (243)..(244): a, c, t, g, unknown or other
  misc_feature (243)..(244): n is a, c, g, or t

SEQ ID NO: 55248 - DNA, 532 bp, Homo sapiens
  misc_feature: GYAE6OF02GW1D6.16.67.G01.1.454.CMB.1.raw
  modified_base (428)..(428): a, c, t, g, unknown or other
  misc_feature (428)..(428): n is a, c, g, or t
  modified_base (488)..(488): a, c, t, g, unknown or other
  misc_feature (488)..(488): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggcttttcttgtggctattttaaaaggtgtccagtgtgaggtgcagctgttggagtctgggggaggcttggtacagcctggggggtccctgagactctcctgtgcgacctctggattcacctttagcagctatgccatgagctgggtccgccaggctccagggaaggggctgggagtgggtctcaactattagtggtagtggtggtaccacgatacttcgctgactccgtgaagggccggttctccatctccagagacacttccaagaacacggtntatctgcaagtgcacagcctgagagccgaggacacggccatatattactgtgacgaaagntacgacttccccctcgtagacgatggactaacaaatctttaccg

SEQ ID NO: 55249 - DNA, 245 bp, Homo sapiens
  misc_feature: GYAE6OF02HMJZR.16.67.G01.1.454.CMB.1.raw
  modified_base (243)..(245): a, c, t, g, unknown or other
  misc_feature (243)..(245): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctcggtcactctgttcccgccctcctcgagtagtacactgagcgggctggcaaggcgcatagnnn

SEQ ID NO: 55250 - DNA, 242 bp, Homo sapiens
  misc_feature: GYAE6OF02GXFY8.16.67.G01.1.454.CMB.1.raw
  modified_base (242)..(242): a, c, t, g, unknown or other
  misc_feature (242)..(242): n is a, c, g, or t
tcagtgtactactccacgaccggtgctcgatttagagtatacatattgggtttgggggtgtggtggtctccactcccgccttgacgaggctgactactactgtcagtcttttaatgacaccgttgtgatattcggcggagggaccaagctgaccgtcctaggtcagcccaaggctgccccctggtcactctgttcccaccctcctcgagtagtacactgagcgggctggcaaggcgcatagn

SEQ ID NO: 55251 - DNA, 650 bp, Homo sapiens
  misc_feature: GYAE6OF02H9EKP.16.67.G01.1.454.CMB.1.raw
  modified_base (157)..(157): a, c, t, g, unknown or other
  misc_feature (157)..(157): n is a, c, g, or t
  modified_base (179)..(179): a, c, t, g, unknown or other
  misc_feature (179)..(179): n is a, c, g, or t
  modified_base (182)..(183): a, c, t, g, unknown or other
  misc_feature (182)..(183): n is a, c, g, or t
  modified_base (186)..(186): a, c, t, g, unknown or other
  misc_feature (186)..(186): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
tcagtgtactactccacgaccggtgctcgatttagagtatacatattgggtttggggagctctgagagaggagcccagccctgggatttccaggtgttttcatttggggatcaggactgaacagagagaactcaccatggagttagggctgagcggngtgttctaggcgctattaaagntcnngtnagtgcagntgtgngntgggngngtgtngcgtcgggtcgtgagactctctgtgcgctcgtgtactactaccttagacacgtctatcgcatgacgcgtcggtccgccgacgcgcgacggacggcggtggtggtggtcgtacgtaacgtagtagtggtaggtggtacggtacacgtacgttacgttcgtcgtcgtacgtacgtacggtacggtccggttccgttcctactacctaccgtacgacgaccgtacctaaccgtaacgtaacgtacggttagtacttacgtacgtacgtacgtacgacgacgacgtaccgtacggtacgacggaccggacggaccgaccggacgtaacgttaacgttaacgttacgtacggtacggtaacggtaaacgtaacgtaaccgttaccccgttaccccgttaccggttaccggtaacggttacggtacgtaccgtaacttaaacc

SEQ ID NO: 55252 - DNA, 536 bp, Homo sapiens
  misc_feature: GYAE6OF02I52SH.16.67.G01.1.454.CMB.1.raw
  modified_base (447)..(448): a, c, t, g, unknown or other
  misc_feature (447)..(448): n is a, c, g, or t
  modified_base (472)..(472): a, c, t, g, unknown or other
  misc_feature (472)..(472): n is a, c, g, or t
  modified_base (490)..(490): a, c, t, g, unknown or other
  misc_feature (490)..(490): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtctgggggaggcttggtacagcctgggggggtcccctgagactctcctgtgcgacctctggattcacctttagcagctatgccatgagctgggtccgccaggctccgaggggaaggggctgggagtgggtctcaactattaggtggtagtggtggtaccacatacttcgctgactccgtgaagggccggttctccatctccagacgacactccaagacacggtgtatctgcagtgcacnncctgagagccgaggacacggccanatatactgtgacgaaagntacgacttccccctccgtagacgagtggactaacgtaaatctttac

SEQ ID NO: 55253 - DNA, 554 bp, Homo sapiens
  misc_feature: GYAE6OF02IP0ZZ.16.67.G01.1.454.CMB.1.raw
  modified_base (432)..(432): a, c, t, g, unknown or other
  misc_feature (432)..(432): n is a, c, g, or t
  modified_base (456)..(456): a, c, t, g, unknown or other
  misc_feature (456)..(456): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtctgggggaggcttggtacagccgtggggggtccctgagactctcctgtcgcgacctctggattcacctttagcagctatgccatgagctgggtccgccgaggcctccgagggaagggggctgggagtgggtctacaacttagttagtggtagtggtgtaccacatacttgctgactcgtgaacgggccgttctccatctcagagacactccaagacgacggtntactctggcagtgacacagctganaggccgaggacacggccaatatacttactgtagacgaaagcttaccgacttccccctcgtaaggacgtagtacggacctaactaaacttcctttaccg

SEQ ID NO: 55254 - DNA, 533 bp, Homo sapiens
  misc_feature: GYAE6OF02FHGSK.16.67.G01.1.454.CMB.1.raw
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtctgggggaggcttggtacagcctggggggtccctgagactctcctgtgcgacctctggattcacctttagcagctatgccatgagctgggtcccgccaggctccgagggaagggctggagtggggtctcaactattaggtggtagtggtggtaccacatacttcgctgactccgtgaagggccggttctccatctccagagcacttccaagaacacgtgatctgcaagtgcacagcctgagagccgagacacgccatatattacngtagcgaagntacgacttcccccgtacgtacgagtagtcggactacgaattctttaccg

SEQ ID NO: 55255 - DNA, 621 bp, Homo sapiens
  misc_feature: GYAE6OF02I7XA6.16.67.G01.1.454.CMB.1.raw
tcagtgtactactccacgaccggtgctcgatttagagtatacatattgggtttgggggagctctgagagaggagcccagccctgggatttccaggtgttttcatttggggatcaggactgaacagagagaactcaccatggagttagggctgagctggctttttctgtggctattttaaaaggtgtccagtgtgaggtgcagctgttggagtctgggggaggcttggtacagccgtggggggtccctgagactctcctgtgcgacctctggattccacctttagcagctatgccatgagctgggtccgccaggctccgagggagggctgggagtgggtctcaactatagtggtagtggtgtaccacatacgttcgctgaccttccgtggacgggtccggtttctcactctccagacgacaccttaccaacgtaacacggtgtactctagaccgtaagtcgacacgacgcctaggacgacggacccggaagggaccgaaccggaccgtaacgtaattaccgtttaacttggtacggaacgggtaaaacgtcgttacccggtaacccttttccccccgtaccggttacggtaaccgtaggtaccgtaccgtaacttaaaaccg

SEQ ID NO: 55256 - DNA, 543 bp, Homo sapiens
  misc_feature: GYAE6OF02JBOID.16.67.G01.1.454.CMB.1.raw
  modified_base (445)..(445): a, c, t, g, unknown or other
  misc_feature (445)..(445): n is a, c, g, or t
  modified_base (497)..(497): a, c, t, g, unknown or other
  misc_feature (497)..(497): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtcgtgggggaggcttggtacagccgtggggggtccctgagactctcctgtgcgacctctggattcacctttagcagctatgccatgagctgggtccgccaggctccgagggaaggggctgggagtgggtctcaactattagtggtagtggtggtaccactatacttcgctgactccgtgaacgggccgttctccatctccagagacacttccaagaacacggtgtatctgacaagtnacacagcctgagacgccgaggacacggccatatattacgtgtgacgaaagtntccgacttacccccgtcgtagacgagtgactaacaattctttaccg

SEQ ID NO: 55257 - DNA, 537 bp, Homo sapiens
  misc_feature: GYAE6OF02H9LU7.16.67.G01.1.454.CMB.1.raw
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (466)..(466): a, c, t, g, unknown or other
  misc_feature (466)..(466): n is a, c, g, or t
  modified_base (510)..(510): a, c, t, g, unknown or other
  misc_feature (510)..(510): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagcgtggcttttctgtggctattttaaaaggtgtccagtgtgaggtgcagctgttggagtctgggggaggcttggtacagccgtggggggtccctgagactctcctgtgcgacctctggattcacctttagcagctatcgccatgagcgtggtccgccaggctccgagggaagggctggagtgggtctcgaactagttaggtggtagtggtaggtaccatatactcgctgactcgtgaacgggtccgtctcntcncagnacnctcaagacacgtntatctgcaagtgacacagcctgagacgcgagacgcgtacatanaattctgtagacgaaagtctacgaccttccccgacgtagacgtntacggtactaactaacttcctttaccg

SEQ ID NO: 55258 - DNA, 541 bp, Homo sapiens
  misc_feature: GYAE6OF02GVA6E.16.67.G01.1.454.CMB.1.raw
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
tcagtgtactactccacgaccggtgctcgatttagagtatacatattgggtttggggagctctgagagaggagcccagccctgggatttccaggtgttttcatttggggatcaggactgaacagagagaactcaccatggagttagggctgagcggtgcgtttctaggtcggctaattttaaaaggtgtccagtgtgaggtgcagctgttggagtctgggggaggcttggtacagcctggggggtccctgagactctcctgtgcgacctctggattcacctttagcagctatgccatgagctgggtccgccaggcctccgaggggaagggctgggagtggggtctnaactattagtggtagtggtggtaccanatacttcgctgactccgtgaacgggtccgttctccatctccagagacacttccaaagacacggtgtatctgacaagtgcacacgcctgagacgcgaggactacggccagtatatactgtgaacgaagctcgtaccttccccgtacgtagagagtcggtactaactaac

SEQ ID NO: 55259 - DNA, 566 bp, Homo sapiens
  misc_feature: GYAE6OF02FU7N5.16.67.G01.1.454.CMB.1.raw
  modified_base (213)..(213): a, c, t, g, unknown or other
  misc_feature (213)..(213): n is a, c, g, or t
  modified_base (258)..(258): a, c, t, g, unknown or other
  misc_feature (258)..(258): n is a, c, g, or t
  modified_base (445)..(445): a, c, t, g, unknown or other
  misc_feature (445)..(445): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagcggtgcgtttctaggtcggctaattttaaaaggtgtccagtgtgaggtgcagctgttggagtntgggggaggcttggacagcctggggggtccctgagactctcctgngcgacctctggattcacctttagcagctatgccatgagctggtccgccaggcttaccgagggaaagggctggagtgggtactcgaactagttagtaggtagtcggtggtacacgtataccttgctgactcgtgaaggccggtttctccaatctccgaagacgacacttcaaagaacacggtgtaacnctgcaagttncaacngcctgacgacgacgacgacgacgactatagtacttagtgtacgaacgaacgtagtaccgtacccttacccgtacgtagacgtacgtacgactaactaacttcttcg

SEQ ID NO: 55260 - DNA, 245 bp, Homo sapiens; identical to SEQ ID NO: 55249
  misc_feature: GYAE6OF02HEH3P.16.67.G01.1.454.CMB.1.raw
  modified_base (243)..(245): a, c, t, g, unknown or other
  misc_feature (243)..(245): n is a, c, g, or t

SEQ ID NO: 55261 - DNA, 714 bp, Homo sapiens
  misc_feature: GYAE6OF02GP1PU.16.67.G01.1.454.CMB.1.raw
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtcgtgggggagcttggtacagccgtggggggtccctgagactctcctgtgcgacctctggattcacctttagcagctatgccatgagcgtcgggtcccgccgagggcctaccgagggggaaggggctagggagtggggtctacgaacttagttaggtggtaggttggtcggtaccagattacttcgctgacctcgtaggaacgggtccggttctcctaatcctaccgaggacgtacctaaccttaccgaaacgaaaccgtaccgggttagtacgttccgtaggaccgtaaacggtcgaccaccgacggtcccgttaggaacggtacggacccggtaaacgggacccgaaccgggacccttaaagttaaacttaactttaaccgttggttacggaaccggtaaaacggtacgttacccggttaacccgttttaccccccccgtaccggttaaggtacggtaagttaccgggtaaccttaaaccgtaaaacctttccgttttaacccg

SEQ ID NO: 55262 - DNA, 285 bp, Homo sapiens
  misc_feature: GYAE6OF02ISFJ7.16.67.G01.1.454.CMB.1.raw
  modified_base (243)..(243): a, c, t, g, unknown or other
  misc_feature (243)..(243): n is a, c, g, or t
  modified_base (249)..(285): a, c, t, g, unknown or other
  misc_feature (249)..(285): n is a, c, g, or t
tcagtgtactactccacgaccggtgctcgattttagagtatacatattgggtttgggggggtgtggtggtcctccactcccgccttgacgaggctgactactactgtcagtcttttaatgacaccgttgtgatattcggcggagggaccaagctgaccgtcctaggtcagcccaaggctgaccccctggtcactctgttcccgccctcctcgagtagtacactggagcgggctggcaagggcncatagnnnnnnnnnnnnnnnnnnnnnnnnnnnnnnnnnnnnn

SEQ ID NO: 55263 - DNA, 694 bp, Homo sapiens
  misc_feature: GYAE6OF02GD19G.16.67.G01.1.454.CMB.1.raw
  modified_base (167)..(167): a, c, t, g, unknown or other
  misc_feature (167)..(167): n is a, c, g, or t
  modified_base (362)..(362): a, c, t, g, unknown or other
  misc_feature (362)..(362): n is a, c, g, or t
tcagtgtactactccacgaccggtgctcgatttagagtatacatattgggtttggggagctctgagagaggagcccagccctgggatttccaggtgttttcatttggggatcaggactgaacagagagaactcaccatggagttagggctgagcgtgtgtttctagngctatttaaaggtgtcagtgtgaggtgcagctgtgagtcgtgggggaggcgttggtacagccgtcggggggtccctaggagacttctcctggtgccgtacctcgtggtacttctaccgtttacggcaagtcttagtcgcctagtgagtccgtcgggtccgcgaggcctccggaggggaaggcgtggaggtggtcncgtaacttattaggtggtagtgggtcgtaacacactttacgtcgcgtacgtactccggttagacggggtaccgtttctacctcttccgacgacgaacgtactacgttaccgaaagaaccggtacgttacgtaacgttctcgtacgtaggtcaccgtccacgttcgaggaacgtacgggaaccggacggaacccgtaacgtaccggtaacttaacgttaacgttacgtaggtacggtaacggaaacgtaccgttaacccggtaaccctttaccccccggtaacggttacgggtaacgttaacgtcgggttaaacttaaaccgtttaaacccgg

SEQ ID NO: 55264 - DNA, 247 bp, Homo sapiens
  misc_feature: GYAE6OF02GB82E.16.67.G01.1.454.CMB.1.raw
  modified_base (243)..(247): a, c, t, g, unknown or other
  misc_feature (243)..(247): n is a, c, g, or t
tcagtgtactactccacgaccggtgctcgatttagagtatacatattgggtttggggggtgtggtggtctccactcccgccttgacgaggctgactactactgtcagtcttttaatgacaccgttgtgatattcggcggagggaccaagctgaccgtcctaggtcagcccaaggctgccccctggtcactctgttcccaccctcctcgagtagtacactgagcgggctggcaaggcgcatagnnnnn

SEQ ID NO: 55265 - DNA, 335 bp, Homo sapiens
  misc_feature: GYAE6OF02I3QTB.16.67.G01.1.454.CMB.1.raw
  modified_base (90)..(90): a, c, t, g, unknown or other
  misc_feature (90)..(90): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
  modified_base (291)..(293): a, c, t, g, unknown or other
  misc_feature (291)..(293): n is a, c, g, or t
  modified_base (295)..(335): a, c, t, g, unknown or other
  misc_feature (295)..(335): n is a, c, g, or t
tcagtgtactactccacgaccggtgctcgatttagagtatacatattgggtttggggggtgtgggtggtctccactcccgccttcgacgnggctgactactactgtcagtctttaatgcaccgttgtgatattcggcggagggaccgaagtctgaccgtcctacggttgacgccgaacggctcgtccccccgtcggttaccacctcgttcggttccccggccctaccccgttggaacgttaggtacaccttgggacggnggggccgtaggaccaaggccggtcgatgngcnnntnnnnnnnnnnnnnnnnnnnnnnnnnnnnnnnnnnnnnnnnn

SEQ ID NO: 55266 - DNA, 880 bp, Homo sapiens
  misc_feature: GYAE6OF02FKC2T.16.67.G01.1.454.CMB.1.raw
  modified_base (291)..(291): a, c, t, g, unknown or other
  misc_feature (291)..(291): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggctttttcttgtggctattttaaaaggtgtcctagtgtgaggtgcagctgttggagtcgtggggggagcgtttggtaccaggtcccgttgggggggtccccttaggacgaccttccttccgtggtcgccgtacccgtntcgggactttccaccccttttaggcaaggtcttaattcggccattgacggtctcgggggtcccgacccggtagggcccttaccggaagggggtaaccgggggcgtgggggtaacggttcgggggttactaccgttaaacgttagtttttacggggtgggtttaacggtggggttacgggttaaccccaacgtaacgtttaaccgtttcggacgttcggtaaccgtcccgggttaggtaaacgggggtcccgggtttcgttacccgtaagttcccgtacccgtaaggaaccgggtaacctaacccgttttaacccgaaaacggtaaccgtaacgggttacggttaacgtcgttacggtaacgtaaggttaccgtaccgaaccgtacggtccgtacggtaacggtaacgggaccgggacgggaaaccggtacccgggtaaaccgtaacgttaaacgttaaccgtttaacgttacggttacggtaacggtaaacggtaacgtaccgtaacccgtttaccccccgttaccgggttacgtaacgtacgtaccggggttaacctaacgttaaaaccgtttccgttttaaccccgg

SEQ ID NO: 55267 - DNA, 791 bp, Homo sapiens
  misc_feature: GYAE6OF02IMVA9.16.67.G01.1.454.CMB.1.raw
  modified_base (183)..(183): a, c, t, g, unknown or other
  misc_feature (183)..(183): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggctttttcttgtggcttaattttaaaggtntccagtgtgaggtgcagctgttggagttcgtgggggaggtctttcggtacgacgtcccggttcgggggggttcccctggacgtaccgttctcccgttggtcgccgacctcctgggtactttccgtaccttttaggccacggtctaagtcgcctatgacgcgtcgggtccgaccgacggtccgtaccggaggggaacggggtcgtagggtacggttcgggttacctacgtaaacgtttagttaaggttagggttacggttcgggttaacggttaaccgaacgttaacgtttaccgttccgtacttacggtaccgttaccgggtacgggtaaccgggtcccggtttaccttaccctacgttcccgtaccgacggtaaaccgaccgtaacccttaccgaaacgtaaaccgtaccggttgttaacgtcgtacggaactacgtccggaccaaccgtcgtaacccgttgggaaccgggaccgaacccgggtaggaaccgaccggtaaacctgttaacttaacgttacgtacggtagaacgtaaacgtcgttaccgttacccttaccccgtacgttacggatacggtaccgacttaacgttaacttccttaccgg

SEQ ID NO: 55268 - DNA, 698 bp, Homo sapiens
  misc_feature: GYAE6OF02G77YU.16.67.G01.1.454.CMB.1.raw
  modified_base (473)..(473): a, c, t, g, unknown or other
  misc_feature (473)..(473): n is a, c, g, or t
tcagtgtactactccacgaccggtgctcgatttagagtatacatattgggtttggggtctgagagaggagcccagccctgggatttccaggtgttttcatttggggatcaggactgaacagagagaactcaccatggagttagggctgagctggtctttttcttgtggctattttaaaaggtgtccagtgtgaggtgcagctgttggagtcgtgggggaggctttggtacaggccgtgggggggtccctggagactctcctgtgccgtacctctggattcctacctttagcagtctatcgccagtgagcgtcgggtcccgaccgaggtcctccggaagggggtaacggggtccgtaggggacggttcggggtcctactaaacgttagtttaggttcgggtaggttgggttacgtaccgactattaccgttcgctacgtaccgtccggtaggaacgggttcccggttactaccnttccgtaccgaggtacgacctacttaccgaaaggtaccgtacggttctactcgtagactaacggttcaccgtacgacgtcctggaacggacggtcccggaaggaccgaccggtcctaattacttaacgttaccgttggtagaaccggtaagtcgttaccgtacccttaccccgtacggttaagaccgtagtacgtaaccttaaccttaaactttccgtttaaccg

SEQ ID NO: 55269 - DNA, 255 bp, Homo sapiens
  misc_feature: GYAE6OF02I5I14.16.67.G01.1.454.CMB.1.raw
  modified_base (246)..(255): a, c, t, g, unknown or other
  misc_feature (246)..(255): n is a, c, g, or t
tcagtgtactactccacgaccggtgctcgatttagagtatacatattgggtttggggggtgtggtggtctccactcccgccttgacgaggctgactactactgtcagtcttttaatgacaccgttgtgatattcggcggagggaccaagctgaccgtcctaggtcagcccaaggctcgccccctcggtcactctcgttccccgccctcctcggtagtacactgagcgggctggcaaggcgcatagnnnnnnnnnn

SEQ ID NO: 55270 - DNA, 287 bp, Homo sapiens
  misc_feature: GYAE6OF01C26Z9.21.11.A11.1.454.CMB.1.raw
  modified_base (283)..(287): a, c, t, g, unknown or other
  misc_feature (283)..(287): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccgcctcctcctcgtctctactgagcgggctggcaaggcgcatagnnnnn

SEQ ID NO: 55271 - DNA, 286 bp, Homo sapiens
  misc_feature: GYAE6OF01BOBDA.21.11.A11.1.454.CMB.1.raw
  modified_base (283)..(286): a, c, t, g, unknown or other
  misc_feature (283)..(286): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaacccactgtcactctgttcccgccctcctccgagcgacgactgagcgggctggcaaggcgcatagnnnn

SEQ ID NO: 55272 - DNA, 353 bp, Homo sapiens
  misc_feature: GYAE6OF01D9N6C.21.11.A11.1.454.CMB.1.raw
  modified_base (153)..(153): a, c, t, g, unknown or other
  misc_feature (153)..(153): n is a, c, g, or t
  modified_base (169)..(169): a, c, t, g, unknown or other
  misc_feature (169)..(169): n is a, c, g, or t
  modified_base (297)..(353): a, c, t, g, unknown or other
  misc_feature (297)..(353): n is a, c, g, or t
tcagtcgtcgctcgcacgaccggtgctcgatttagctacgactgcagggtagaacgggctggatggacgttgggatggggacgagagaccccgtcccctgggactccgtgcaagctccaggctggaacgacgaggtgattagtactgtgcctnttactacgagagggcnccacgtatgtcttcggaagtggaccacggtcacgtcctaggtcaggcccaaggcccaacccatgtccacgtcgtgttcccacctcctcctcgtctctactgagcggctgggctaaaggcgtcatacgnnnnnnnnnnnnnnnnnnnnnnnnnnnnnnnnnnnnnnnnnnnnnnnnnnnnnnnnn

SEQ ID NO: 55273 - DNA, 331 bp, Homo sapiens
  misc_feature: GYAE6OF01CSZKH.21.11.A11.1.454.CMB.1.raw
  modified_base (288)..(331): a, c, t, g, unknown or other
  misc_feature (288)..(331): n is a, c, g, or t
tcagtcgtcgctcgcacgaccggtgctcgatttagctacgactgcagggtaggaagggctggatggacttgggatggggagagagaccctccctgggactcctgcagctccgaggctgaagacgaggtgattatactgttcgctcttatacgagaaggggcgccacgtatcgtcttcggaatgggaccacggtcaccgtctaggtcaggcccaaggccaacccactgtcactctgttcccgcctctccgctctcaactgaagtcgggctggccaaaggcgcataggcnnnnnnnnnnnnnnnnnnnnnnnnnnnnnnnnnnnnnnnnnnnn

SEQ ID NO: 55274 - DNA, 308 bp, Homo sapiens
  misc_feature: GYAE6OF01EDHGN.21.11.A11.1.454.CMB.1.raw
  modified_base (288)..(308): a, c, t, g, unknown or other
  misc_feature (288)..(308): n is a, c, g, or t
tcagtcgtcgctcgcacgaccggtgctcgatttagctacgactgcgagggagaagggctggatgacttgggatgggggagagagacccctcccctgggatcctgccagctccacggcctgaagacgagggtgattattactgttgctcttatacgagaaggggcgccacgtatgtcttcggaagtgggaccacggtcaccgtcctaggtcagcccaaggcccaaccccactgtcactctgttcccgccctctcctcgtctctactgagcggctggcaaggcgcatagnnnnnnnnnnnnnnnnnnnnn

SEQ ID NO: 55275 - DNA, 286 bp, Homo sapiens
  misc_feature: GYAE6OF01CRMFB.21.11.A11.1.454.CMB.1.raw
  modified_base (283)..(286): a, c, t, g, unknown or other
  misc_feature (283)..(286): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccaccctcctcctcgtctctactgagcggctggcaaggcgcatagnnnn

SEQ ID NO: 55276 - DNA, 286 bp, Homo sapiens
  misc_feature: GYAE6OF01A1V5V.21.11.A11.1.454.CMB.1.raw
  modified_base (284)..(286): a, c, t, g, unknown or other
  misc_feature (284)..(286): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccgccctcctcctcgtctctactgagcgggctggcaaggcgcatagnnn

SEQ ID NO: 55277 - DNA, 286 bp, Homo sapiens
  misc_feature: GYAE6OF01EC1OA.21.11.A11.1.454.CMB.1.raw
  modified_base (281)..(286): a, c, t, g, unknown or other
  misc_feature (281)..(286): n is a, c, g, or t
tcagtcgtcgctcgcacgaccggtgctcgatttagctacgactgcagggagaagggctggatgacttgggatggggagagagacccctcccctgggatcctgcagctccaggctgaagacgaggtgattattactgttgctcttatacgagaagggcgccacgtatgtcttcggaagtggaccacggtcaccgtcctaggtcagcccaaggccaacccactgtcactctgttccccaccctcctccgagcgacgactgagcgggctggcaaggcgcatagnnnnnn

SEQ ID NO: 55278 - DNA, 287 bp, Homo sapiens
  misc_feature: GYAE6OF01BXAHX.21.11.A11.1.454.CMB.1.raw
  modified_base (159)..(159): a, c, t, g, unknown or other
  misc_feature (159)..(159): n is a, c, g, or t
  modified_base (283)..(287): a, c, t, g, unknown or other
  misc_feature (283)..(287): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcnccacgtatgtcttcggaagtgggaccacggtcaccgtcctaggtcagcccaaggccaaccccactgtcactctcgttcccacctcctcctcgtctctactgacgcggctggcaaggcgcatagnnnnn

SEQ ID NO: 55279 - DNA, 288 bp, Homo sapiens
  misc_feature: GYAE6OF01EOEPA.21.11.A11.1.454.CMB.1.raw
  modified_base (285)..(288): a, c, t, g, unknown or other
  misc_feature (285)..(288): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccgccctgcctcctcgtctctactgagcgggctggcaaggcgcatagnnnn

SEQ ID NO: 55280 - DNA, 284 bp, Homo sapiens
  misc_feature: GYAE6OF01AKC2C.21.11.A11.1.454.CMB.1.raw
  modified_base (284)..(284): a, c, t, g, unknown or other
  misc_feature (284)..(284): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccaccctcctcctcgtctctactgagcgggctggcaaggcgcatagn

SEQ ID NO: 55281 - DNA, 286 bp, Homo sapiens
  misc_feature: GYAE6OF01CX7I7.21.11.A11.1.454.CMB.1.raw
  modified_base (285)..(286): a, c, t, g, unknown or other
  misc_feature (285)..(286): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttccccaccctcctcctcgtctctactgagcggctggccaaggcgcatagnn

SEQ ID NO: 55282 - DNA, 289 bp, Homo sapiens
  misc_feature: GYAE6OF01DE5OS.21.11.A11.1.454.CMB.1.raw
  modified_base (285)..(289): a, c, t, g, unknown or other
  misc_feature (285)..(289): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggccaaccccactgtcactctgttccccgccctcctccgagcgacgactgagcgggctggcaaaggcgcatagnnnnn

SEQ ID NO: 55283 - DNA, 286 bp, Homo sapiens
  misc_feature: GYAE6OF01DQ3OS.21.11.A11.1.454.CMB.1.raw
  modified_base (284)..(286): a, c, t, g, unknown or other
  misc_feature (284)..(286): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtggaccacggtcaccgtcctaggtcagcccaaggcccaacccactgtcactctcgttccccaccctcctcctcgtctctactgacgcggctggcaaggcgcatagnnn

SEQ ID NO: 55284 - DNA, 284 bp, Homo sapiens
  misc_feature: GYAE6OF01D2YFM.21.11.A11.1.454.CMB.1.raw
  modified_base (159)..(159): a, c, t, g, unknown or other
  misc_feature (159)..(159): n is a, c, g, or t
  modified_base (282)..(284): a, c, t, g, unknown or other
  misc_feature (282)..(284): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcnccacgtatgtcttcggaagtgggaccacggtcaccgtcctaggtcagcccaaggccaacccactgtcactctcgttcccgccctcctcctcgtctctactgagcggctggcaaggcgcatagnnn

SEQ ID NO: 55285 - DNA, 290 bp, Homo sapiens
  misc_feature: GYAE6OF01BTE7C.21.11.A11.1.454.CMB.1.raw
  modified_base (162)..(162): a, c, t, g, unknown or other
  misc_feature (162)..(162): n is a, c, g, or t
  modified_base (224)..(224): a, c, t, g, unknown or other
  misc_feature (224)..(224): n is a, c, g, or t
  modified_base (283)..(290): a, c, t, g, unknown or other
  misc_feature (283)..(290): n is a, c, g, or t
tcagtcgtcgctcgcacgaccggtgctcgatttagctacgactgcagggagaagggctggatgacttgggatggggagagagacccctccccgtgggatcctgcagctccaggctgaagacgagggtgattattactgttgcttcttatacggagaagggcnccacgtatgtcttcggaagtgggaccacggtcaccgtcctaggtcagcccaaggccaacccntgtcactctcgtcccgcctcctcctcgtctctactgagcggctggcaaggcgacatagnnnnnnnn

SEQ ID NO: 55286 - DNA, 285 bp, Homo sapiens
  misc_feature: GYAE6OF01C6LP3.21.11.A11.1.454.CMB.1.raw
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
  modified_base (162)..(162): a, c, t, g, unknown or other
  misc_feature (162)..(162): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (278)..(285): a, c, t, g, unknown or other
  misc_feature (278)..(285): n is a, c, g, or t
tcagtcgtcgctcgcacgaccggtgctcgatttagctacgactgcagggagaagggctggatgacttgggatggggagagacgaccccctccccgtgggatcctgcagctccaggctagaagacgaggtgattattactgttnctcttanacgagaagggcncagtatgtcttacggaagtggaccacggtcaccgtcctaggcacgcccaaggccaacccntgcactctcgttccccncctctcctcgtctcgacgngcggctgacaaggcnaatgnnnnnnnn

SEQ ID NO: 55287 - DNA, 297 bp, Homo sapiens
  misc_feature: GYAE6OF01EIS4J.21.11.A11.1.454.CMB.1.raw
  modified_base (159)..(159): a, c, t, g, unknown or other
  misc_feature (159)..(159): n is a, c, g, or t
  modified_base (291)..(297): a, c, t, g, unknown or other
  misc_feature (291)..(297): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcnccacgtatgtcttcggaagtgggaccacggtcaccgtcctaggtcagcccaaggccaacccgactgtcactctcgttccccaccctcctcctcgtcctctactgacgcgggctggccaaaggccgacatagnnnnnnn

SEQ ID NO: 55288 - DNA, 291 bp, Homo sapiens
  misc_feature: GYAE6OF01DWY1W.21.11.A11.1.454.CMB.1.raw
  modified_base (286)..(291): a, c, t, g, unknown or other
  misc_feature (286)..(291): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctcgttccccgccctcctcctcgtctctactgagcgggctggcaaggcgcatagnnnnnn

SEQ ID NO: 55289 - DNA, 299 bp, Homo sapiens
  misc_feature: GYAE6OF01EJG2F.21.11.A11.1.454.CMB.1.raw
  modified_base (161)..(161): a, c, t, g, unknown or other
  misc_feature (161)..(161): n is a, c, g, or t
  modified_base (284)..(299): a, c, t, g, unknown or other
  misc_feature (284)..(299): n is a, c, g, or t
tcagtcgtcgctcgcacgaccggtgctcgatttagctacgactgcagggaggaagggctggatgacttgggatggggagagagacccctcccctgggatcctgcagctccaggctgaagacgagggtgattattactgttgctcttatacgagaaggggcnccacgtatgtcttcggaagtgggaccacggtcacgtcctaggtcagcccaaggccaacccatgtcactctcgttcccgccctcctcctcgtctcactgagcgggtctggccaaggcgcatagnnnnnnnnnnnnnnnn

SEQ ID NO: 55290 - DNA, 292 bp, Homo sapiens
  misc_feature: GYAE6OF01DN3JW.21.11.A11.1.454.CMB.1.raw
  modified_base (287)..(292): a, c, t, g, unknown or other
  misc_feature (287)..(292): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctcgttccccaccctcctcctcgtcctctactgagtcggctggcaaggcgcatagnnnnnn

SEQ ID NO: 55291 - DNA, 287 bp, Homo sapiens
  misc_feature: GYAE6OF01BDYX3.21.11.A11.1.454.CMB.1.raw
  modified_base (159)..(159): a, c, t, g, unknown or other
  misc_feature (159)..(159): n is a, c, g, or t
  modified_base (279)..(287): a, c, t, g, unknown or other
  misc_feature (279)..(287): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcncagtatgtcttcggaagtggaccacggtcaccgtcctaggtcagcccaaggccaacccatgtcactctcgtcccacctcctcctcgtctcctactgagcgggctggcaaggcgcatagcnnnnnnnnn

SEQ ID NO: 55292 - DNA, 299 bp, Homo sapiens
  misc_feature: GYAE6OF01BLRSR.21.11.A11.1.454.CMB.1.raw
  modified_base (126)..(126): a, c, t, g, unknown or other
  misc_feature (126)..(126): n is a, c, g, or t
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (281)..(282): a, c, t, g, unknown or other
  misc_feature (281)..(282): n is a, c, g, or t
  modified_base (284)..(299): a, c, t, g, unknown or other
  misc_feature (284)..(299): n is a, c, g, or t
tcagtcgtcgctcgcacgaccggtgctcgatttagctacgactgcagggagaagggctggatgacttgggatggggagagagacccctcccctgggatcctgcagctccaggctgaagacgaggtnattattactgttgctcttatacggagaacggggcgccacgtatgtcttcggaagtggaccacggtcaccgtctaggtcagcccaaggccaacccntgtcactctcgttcccnccctctcctcgtctctactgngcggctggcaacggcncatagnncnnnnnnnnnnnnnnnn

SEQ ID NO: 55293 - DNA, 317 bp, Homo sapiens
  misc_feature: GYAE6OF01E3V8W.21.11.A11.1.454.CMB.1.raw
  modified_base (164)..(164): a, c, t, g, unknown or other
  misc_feature (164)..(164): n is a, c, g, or t
  modified_base (296)..(317): a, c, t, g, unknown or other
  misc_feature (296)..(317): n is a, c, g, or t
tcagtcgtcgctcgcacgaccggtgctcgatttagctacgactgcaggggagaagggctggatgacttgggatggggagagagacccctccccctgggatcctgcagctccaggctgaagacgagggtgattattactgttgacctcttatacgagaaggggcnccacgtatgtcttcggaagtcgggaccacggtcaccgtctagggtcacgccccaaggcccaaccccactgtcaccttctcgttccccgccctcctcctcgtctctactgagcgggctggcaaggcgcatagnnnnnnnnnnnnnnnnnnnnnn

SEQ ID NO: 55294 - DNA, 295 bp, Homo sapiens
  misc_feature: GYAE6OF01ARFQX.21.11.A11.1.454.CMB.1.raw
  modified_base (285)..(295): a, c, t, g, unknown or other
  misc_feature (285)..(295): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtggaccacggtcaccgtcctaggtcacgcccaagcccaaccccactgtcactctcgttcccgccctcctcctcgtctctactgagcggctggcaaggcgcagtagnnnnnnnnnnn

SEQ ID NO: 55295 - DNA, 309 bp, Homo sapiens
  misc_feature: GYAE6OF01EECQR.21.11.A11.1.454.CMB.1.raw
  modified_base (130)..(130): a, c, t, g, unknown or other
  misc_feature (130)..(130): n is a, c, g, or t
  modified_base (289)..(309): a, c, t, g, unknown or other
  misc_feature (289)..(309): n is a, c, g, or t
tcagtcgtcgctcgcacgaccggtgctcgattttagctacgactgcagggagaagggctggatgacttgggatgggggagagagacccctccccctgggatccctgcagctccaggctgaagacgaggtnattattactgttgctcttatacgagaagggcgccacgtatgtcttcggaagtggaccacggtcaccgtcctaggtcagacccaaggcccaaccccatgtcactctcgttcccaccctccctcctcgtctctactggacgcggctggcaaggcgcatagnnnnnnnnnnnnnnnnnnnnn

SEQ ID NO: 55296 - DNA, 294 bp, Homo sapiens
  misc_feature: GYAE6OF01DGPA3.21.11.A11.1.454.CMB.1.raw
  modified_base (160)..(160): a, c, t, g, unknown or other
  misc_feature (160)..(160): n is a, c, g, or t
  modified_base (280)..(280): a, c, t, g, unknown or other
  misc_feature (280)..(280): n is a, c, g, or t
  modified_base (287)..(294): a, c, t, g, unknown or other
  misc_feature (287)..(294): n is a, c, g, or t
tcagtcgtcgctcgcacgaccggtgctcgatttagctacgactgcagggagaagggctggatgacttgggatggggagagagacccctccccctgggatccctgcagctccaggctgaagacgaggtgattattactgttgctcttatacgagaagggcnccacgtatgtcttcggaagtgggaccacggtccaccgtcctaggtcacgccaaggccaacccatgtcactctcgttcccacctcctcctcgtctctactgacgcggctggcaaagggccncatacgnnnnnnnn

SEQ ID NO: 55297 - DNA, 326 bp, Homo sapiens
  misc_feature: GYAE6OF01BPWAD.21.11.A11.1.454.CMB.1.raw
  modified_base (161)..(161): a, c, t, g, unknown or other
  misc_feature (161)..(161): n is a, c, g, or t
  modified_base (294)..(296): a, c, t, g, unknown or other
  misc_feature (294)..(296): n is a, c, g, or t
  modified_base (299)..(326): a, c, t, g, unknown or other
  misc_feature (299)..(326): n is a, c, g, or t
tcagtcgtcgctcgcacgaccggtgctcgatttagctacgactgcagggagaagggctggatgacttgggatgggggagagagacccctcccctgggatcctgcagctccaggctgaagacgagggtgattattactgttgctcttatacgagaaggggcnccacgtatgtcttcggagtgggaccaggtcaccgtctaggtcacgcccaaggcccaacccctatcgtcactctcgttccccgccctcctcctcgtctctactgacgcgggactggccgaaggccgcacgtagnnngtnnnnnnnnnnnnnnnnnnnnnnnnnnnn

SEQ ID NO: 55298 - DNA, 299 bp, Homo sapiens
  misc_feature: GYAE6OF01E3DOK.21.11.A11.1.454.CMB.1.raw
  modified_base (293)..(299): a, c, t, g, unknown or other
  misc_feature (293)..(299): n is a, c, g, or t
tcagtcgtcgctcgcacgaccggtgctcgatttagctacgactgcagggagaagggctggatgacttgggatggggagagagaccccctcccctgggatcctgcagctccaggctgaagacgagggtgattattactgttgcttcttatacgaggaagggcgccacgtatgtcttcggaagtggaccacggtcaccgtcctaggtcacgcccaaaggcccaacccactgtcacttctcgttccccacccttcctcctcgtcctctactgacgcggctaggcaaggcgcatagnnnnnnn

SEQ ID NO: 55299 - DNA, 328 bp, Homo sapiens
  misc_feature: GYAE6OF01DLFQQ.21.11.A11.1.454.CMB.1.raw
  modified_base (180)..(180): a, c, t, g, unknown or other
  misc_feature (180)..(180): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (300)..(300): a, c, t, g, unknown or other
  misc_feature (300)..(300): n is a, c, g, or t
  modified_base (316)..(328): a, c, t, g, unknown or other
  misc_feature (316)..(328): n is a, c, g, or t
tcagtcgtcgctcgcacgaccggtgctcgatttagctacgactgcagggagaagggctggatgacttgggatggggagagagaccccctcccctgggatcctgcagcctccaggctagaagacggagggtgatttattacgtgttcgcttacttagacggaggaacgggcctactaagtntcgtacgttacggaaggtcggaccgacgtccaccgtcgtagcacgaccgaaccgacccaacctntcgtcctactcgtcccggtcccnccctcctccgtactcctctaggtgacggcggtncggacgacgcactagnnnnnnnnnnnnn

SEQ ID NO: 55300 - DNA, 298 bp, Homo sapiens
  misc_feature: GYAE6OF01BQQDP.21.11.A11.1.454.CMB.1.raw
  modified_base (160)..(160): a, c, t, g, unknown or other
  misc_feature (160)..(160): n is a, c, g, or t
  modified_base (287)..(298): a, c, t, g, unknown or other
  misc_feature (287)..(298): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcnccacgtatgtcttcggaagtgggaccacggtcaccgtcctaggtcagccccaaaggccaacctcactgtcactctgttccccgccctcctcctcgtctctactgagcgggctggcaaggcgcatagnnnnnnnnnnnn

SEQ ID NO: 55301 - DNA, 365 bp, Homo sapiens
  misc_feature: GYAE6OF01CEBTO.21.11.A11.1.454.CMB.1.raw
  modified_base (253)..(253): a, c, t, g, unknown or other
  misc_feature (253)..(253): n is a, c, g, or t
  modified_base (341)..(365): a, c, t, g, unknown or other
  misc_feature (341)..(365): n is a, c, g, or t
tcagtcgtcgctcgcacgaccggtgctcgatttagctacgactgcagggagaagggctggatgacttgggagtgggggagagacgaccccctcccctgggatcctgcagctccgaggctggaagacggagggtgtattatttactgttgcttacttagtacggaggaaggggccgcctaacgttagtgttcgttacgggaaggtcgggacccacggtccaccgttcgtaggcacgacccaacggcccaacccntcgtccactccttccgtccccacccttccttccgtccgtctactacgtggacggcgggtactcgggacgaagggcacgagtaagcagnnnnnnnnnnnnnnnnnnnnnnnnn

SEQ ID NO: 55302 - DNA, 339 bp, Homo sapiens
  misc_feature: GYAE6OF01E5JZU.21.11.A11.1.454.CMB.1.raw
  modified_base (149)..(149): a, c, t, g, unknown or other
  misc_feature (149)..(149): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (307)..(339): a, c, t, g, unknown or other
  misc_feature (307)..(339): n is a, c, g, or t
tcagtcgtcgctcgcacgaccggtgctcgatttagctacgactgcagggagaagggctggatgacttgggatgggggagagagacccctcccctgggatcctgcagctccgaggctgaagacgagggtgattattactgttgctcttanacgaggaacgggcgcacgtatgtcgttggaaggtcgggaccacggtcaccgtcgtaggtcacgcccgaacggcccaaccccactcgctactcgtccgttccccgcccttcctcgtccgtctcgtacgtggacggcggtcgnggacaaggctacgangnnnnnnnnnnnnnnnnnnnnnnnnnnnnnnnnn

SEQ ID NO: 55303 - DNA, 416 bp, Homo sapiens
  misc_feature: GYAE6OF01BNX27.21.11.A11.1.454.CMB.1.raw
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (335)..(336): a, c, t, g, unknown or other
  misc_feature (335)..(336): n is a, c, g, or t
  modified_base (340)..(340): a, c, t, g, unknown or other
  misc_feature (340)..(340): n is a, c, g, or t
  modified_base (342)..(345): a, c, t, g, unknown or other
  misc_feature (342)..(345): n is a, c, g, or t
  modified_base (347)..(416): a, c, t, g, unknown or other
  misc_feature (347)..(416): n is a, c, g, or t
tcagtcgtcgctcgcacgaccggtgctcgattttagctacgactgcagggagaagggctggatgacttgggatgggggagagagaccccctcccctgggatcctgcagctccaggctagaagacgagggtgattatttactgttgcttcttatacgaggaaggggcaccacgtatgtcttcggaagtcgggaccacggtcaccgtcctaggtccagccccaaggcccaacccccatgtccacttctcgttccccaccctccctcctccgtctcctacngacggccgggcttagggcaacggggcctanaacgtagcaatcanctagcangntagnngtcngnnnncnnnnnnnnnnnnnnnnnnnnnnnnnnnnnnnnnnnnnnnnnnnnnnnnnnnnnnnnnnnnnnnnnnnnnn

SEQ ID NO: 55304 - DNA, 360 bp, Homo sapiens
  misc_feature: GYAE6OF01CAJL7.21.11.A11.1.454.CMB.1.raw
  modified_base (133)..(133): a, c, t, g, unknown or other
  misc_feature (133)..(133): n is a, c, g, or t
  modified_base (146)..(146): a, c, t, g, unknown or other
  misc_feature (146)..(146): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (327)..(360): a, c, t, g, unknown or other
  misc_feature (327)..(360): n is a, c, g, or t
tcagtcgtcgctcgcacgaccggtgctcgatttagctacgactgcagggagaagggctggatgacttgggatggggagagacgacccctccccgtgggactcctgcagctccaggctagaaagacggagggtnattattactggtnctacttagacgaggaacggggcacctagttagtgtcgttacggaaggtacgggaccacggtccaaccgtccgtagcacgaccgaacgacccaacccatcgtcctacctcgttccgtccccgtccctccttccgtaccgtctacctaagtggacggccgggatacggacgacgcanaagngnnnnnnnnnnnnnnnnnnnnnnnnnnnnnnnnnn

SEQ ID NO: 55305 - DNA, 277 bp, Homo sapiens
  misc_feature: GYAE6OF02F71L7.21.11.A11.1.454.CMB.1.raw
  modified_base (277)..(277): a, c, t, g, unknown or other
  misc_feature (277)..(277): n is a, c, g, or t
tcagtcgtcgctcgcacgaccggtgctcgatttagctacgactgcagggagaaggctggatgacttgggatgggagagagaccctccctgggatcctgcagctccaggctgaagacgaggtgattattactgttgctcttatacgagaagggcgccacgtatgtcttcggaagtgggaccacggtcaccgtcctaggtcagcccaaggccaaccccactgtcactctgttcccacctcctcctcgtctctactgagcgggctggcaaggcgcatagn

SEQ ID NO: 55306 - DNA, 290 bp, Homo sapiens
  misc_feature: GYAE6OF02GY1JF.21.11.A11.1.454.CMB.1.raw
  modified_base (283)..(290): a, c, t, g, unknown or other
  misc_feature (283)..(290): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaacccactgtcactctgttcccgccctcctccgagcgacgactgagcgggctggcaaggcgcatagnnnnnnnn

SEQ ID NO: 55307 - DNA, 286 bp, Homo sapiens
  misc_feature: GYAE6OF02HV20N.21.11.A11.1.454.CMB.1.raw
  modified_base (283)..(286): a, c, t, g, unknown or other
  misc_feature (283)..(286): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggccaaccccactgtcactctgttcccgccctcctcctcgtctctactgagcgggctggcaaggcgcatagnnnn

SEQ ID NO: 55308 - DNA, 285 bp, Homo sapiens
  misc_feature: GYAE6OF02FQQ01.21.11.A11.1.454.CMB.1.raw
  modified_base (283)..(285): a, c, t, g, unknown or other
  misc_feature (283)..(285): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggccaaccccactgtcactctgttcccaccctcctcctcgtctctactgagcgggctggcaaggcgcatagnnn

SEQ ID NO: 55309 - DNA, 296 bp, Homo sapiens
  misc_feature: GYAE6OF02F8UZT.21.11.A11.1.454.CMB.1.raw
  modified_base (280)..(296): a, c, t, g, unknown or other
  misc_feature (280)..(296): n is a, c, g, or t
tcagtcgtcgctcgcacgaccggtgctcgatttagctacgactgcagggagaagggctggatgacttgggatgggagagagacccctccctgggatcctgcagctccaggctgaagacgaggtgattattactgttgctcttagtacgagaagggcgccacgtatgtcttcggaagtgggaccacggtcaccgtcctaggtcagcccaaggccaacccactgtcactctgttcccaccctcctcctcgtctctactgacgcggctggcaaggcgcatagnnnnnnnnnnnnnnnnn

SEQ ID NO: 55310 - DNA, 286 bp, Homo sapiens; identical to SEQ ID NO: 55307
  misc_feature: GYAE6OF02F0466.21.11.A11.1.454.CMB.1.raw
  modified_base (283)..(286): a, c, t, g, unknown or other
  misc_feature (283)..(286): n is a, c, g, or t

SEQ ID NO: 55311 - DNA, 285 bp, Homo sapiens
  misc_feature: GYAE6OF02F0CCH.21.11.A11.1.454.CMB.1.raw
  modified_base (283)..(285): a, c, t, g, unknown or other
  misc_feature (283)..(285): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggccaaccccactgtcactctcgttcccgccctcctcctcgtctctactgagcggctggcaaggcgcatagnnn

SEQ ID NO: 55312 - DNA, 309 bp, Homo sapiens
  misc_feature: GYAE6OF02H5U2X.21.11.A11.1.454.CMB.1.raw
  modified_base (288)..(309): a, c, t, g, unknown or other
  misc_feature (288)..(309): n is a, c, g, or t
tcagtcgtcgctcgcacgaccggtgctcgatttagctacgactgcagggagaaggctggatgacttgggagtggggagagagacccctcccctgggatcctgcagctccaggctgaagacgagggtgattattactgttgctcttatacgagaaggggcgccacgtatgtctttcggaagtgggaccacggtcaccgtcctaggtcagcccaaggccaacccccactgtcactctgttcccaccctcctcctcgtctctactgacgcgggctggccaaggcgcatagnnnnnnnnnnnnnnnnnnnnnn

SEQ ID NO: 55313 - DNA, 284 bp, Homo sapiens
  misc_feature: GYAE6OF02F7PTG.21.11.A11.1.454.CMB.1.raw
  modified_base (282)..(284): a, c, t, g, unknown or other
  misc_feature (282)..(284): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggccaaccccactgtcactctgttcccaccctcctcctcgtctctactgagcggctggcaaggcgcatagnnn

SEQ ID NO: 55314 - DNA, 287 bp, Homo sapiens
  misc_feature: GYAE6OF02JXLDE.21.11.A11.1.454.CMB.1.raw
  modified_base (282)..(287): a, c, t, g, unknown or other
  misc_feature (282)..(287): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggccaaccccactgtcactctgttcccaccctcctccgagcgacgactgagcggctggcaaggcgcatagnnnnnn

SEQ ID NO: 55315 - DNA, 284 bp, Homo sapiens; identical to SEQ ID NO: 55280
  misc_feature: GYAE6OF02HW45E.21.11.A11.1.454.CMB.1.raw
  modified_base (284)..(284): a, c, t, g, unknown or other
  misc_feature (284)..(284): n is a, c, g, or t

SEQ ID NO: 55316 - DNA, 300 bp, Homo sapiens
  misc_feature: GYAE6OF02G0HM5.21.11.A11.1.454.CMB.1.raw
  modified_base (284)..(300): a, c, t, g, unknown or other
  misc_feature (284)..(300): n is a, c, g, or t
tcagtcgtcgctcgcacgaccggtgctcgatttagctacgactgcagggagaagggctggatgacttgggatggggagagagacccctcccctgggatcctgcagctccaggctgaagacgaggtgattattactgttgctcttatacgagaaggggcgccacgtatgtcttcggaagtgggaccacggtcaccgtcctaggtcagcccaaggccaaccccactgtcactctgttcccaccctcctcctcgtctctactgacgcgggctggcaaggcgcatagnnnnnnnnnnnnnnnnn

SEQ ID NO: 55317 - DNA, 326 bp, Homo sapiens
  misc_feature: GYAE6OF02I2RZX.21.11.A11.1.454.CMB.1.raw
  modified_base (140)..(140): a, c, t, g, unknown or other
  misc_feature (140)..(140): n is a, c, g, or t
  modified_base (171)..(171): a, c, t, g, unknown or other
  misc_feature (171)..(171): n is a, c, g, or t
  modified_base (312)..(326): a, c, t, g, unknown or other
  misc_feature (312)..(326): n is a, c, g, or t
tcagtcgtcgctcgcacgaccggtgctcgatttagctacgactgcagggagaaggggctggatgacttgggatggggagaggagaccccctccccgtgggactccgtgcgagcctccgaggtctagaacgacggagggtnattatactgtgctcttagtacgaggagggcnccagtatgtcttcggaagtcggaccacggtcaccgtctagggtcacgcccgaaggccctaacccattgtccacttctcgttaccccgcccttcgaccgagccggacgacttggacggcgggtctggcaaaggcgcatagcnnnnnnnnnnnnnnn

SEQ ID NO: 55318 - DNA, 287 bp, Homo sapiens
  misc_feature: GYAE6OF02JFL9Z.21.11.A11.1.454.CMB.1.raw
  modified_base (282)..(287): a, c, t, g, unknown or other
  misc_feature (282)..(287): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccatgtcactctgttcccacctcctccgagcgacgactgagcgggctggcaaggcgcatagnnnnnn

SEQ ID NO: 55319 - DNA, 286 bp, Homo sapiens
  misc_feature: GYAE6OF02IRL1A.21.11.A11.1.454.CMB.1.raw
  modified_base (281)..(286): a, c, t, g, unknown or other
  misc_feature (281)..(286): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaacccactgtcactctgttcccacctcctcctcgtctctactgagcggctggcaaggcgcatagnnnnnn

SEQ ID NO: 55320 - DNA, 285 bp, Homo sapiens
  misc_feature: GYAE6OF02IB2GQ.21.11.A11.1.454.CMB.1.raw
  modified_base (283)..(285): a, c, t, g, unknown or other
  misc_feature (283)..(285): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccaccctcctcctcgtctctactgagcggctggcaaggcgcatagnnn

SEQ ID NO: 55321 - DNA, 287 bp, Homo sapiens
  misc_feature: GYAE6OF02FVF74.21.11.A11.1.454.CMB.1.raw
  modified_base (284)..(287): a, c, t, g, unknown or other
  misc_feature (284)..(287): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccaccctcctcctcgtctctactgagcgggctggcaaggcgcatagnnnn

SEQ ID NO: 55322 - DNA, 287 bp, Homo sapiens; identical to SEQ ID NO: 55321
  misc_feature: GYAE6OF02FQG5Q.21.11.A11.1.454.CMB.1.raw
  modified_base (284)..(287): a, c, t, g, unknown or other
  misc_feature (284)..(287): n is a, c, g, or t

SEQ ID NO: 55323 - DNA, 286 bp, Homo sapiens
  misc_feature: GYAE6OF02G3J27.21.11.A11.1.454.CMB.1.raw
  modified_base (282)..(286): a, c, t, g, unknown or other
  misc_feature (282)..(286): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccacctcctcctcgtctctactgagcggctggcaaggcgcatagnnnnn

SEQ ID NO: 55324 - DNA, 285 bp, Homo sapiens
  misc_feature: GYAE6OF02HV24H.21.11.A11.1.454.CMB.1.raw
  modified_base (281)..(285): a, c, t, g, unknown or other
  misc_feature (281)..(285): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaacccactgtcactctgttcccacctcctcctcgtctctactgagcggctggcaaggcgcatagnnnnn

SEQ ID NO: 55325 - DNA, 306 bp, Homo sapiens
  misc_feature: GYAE6OF02GU0WI.21.11.A11.1.454.CMB.1.raw
  modified_base (302)..(306): a, c, t, g, unknown or other
  misc_feature (302)..(306): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcgacgcccaacggaccgaaccccaacctgtcacctactcgttccctacccctccctcccgacgcgaccgactgagcgggcgtgcgaaggacgcatagnnnnn

SEQ ID NO: 55326 - DNA, 284 bp, Homo sapiens
  misc_feature: GYAE6OF02JG77D.21.11.A11.1.454.CMB.1.raw
  modified_base (282)..(284): a, c, t, g, unknown or other
  misc_feature (282)..(284): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtctaggtcagcccaaggccaaccccactgtcactctgttcccaccctcctcctcgtctctactgagcggctggcaaggcgcatagnnn

SEQ ID NO: 55327 - DNA, 288 bp, Homo sapiens
  misc_feature: GYAE6OF02JAR6A.21.11.A11.1.454.CMB.1.raw
  modified_base (283)..(288): a, c, t, g, unknown or other
  misc_feature (283)..(288): n is a, c, g, or t
tcagtcgtcgctcgcacgaccggtgctcgatttagctacgactgcagggagaagggctggatgacttgggatggggagagagaccctcccctcgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccgccctcctcctcgtctctactgagcggctggcaaggcgcatagnnnnnn

SEQ ID NO: 55328 - DNA, 297 bp, Homo sapiens
  misc_feature: GYAE6OF02I656G.21.11.A11.1.454.CMB.1.raw
  modified_base (283)..(297): a, c, t, g, unknown or other
  misc_feature (283)..(297): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggcccaacccactgtcactctgttcccgccctcctcctcgtctctactgagcggctggcaaggccgcatagnnnnnnnnnnnnnnn

SEQ ID NO: 55329 - DNA, 286 bp, Homo sapiens; identical to SEQ ID NO: 55307
  misc_feature: GYAE6OF02FUXJ7.21.11.A11.1.454.CMB.1.raw
  modified_base (283)..(286): a, c, t, g, unknown or other
  misc_feature (283)..(286): n is a, c, g, or t

SEQ ID NO: 55330 - DNA, 288 bp, Homo sapiens
  misc_feature: GYAE6OF02FZFLO.21.11.A11.1.454.CMB.1.raw
  modified_base (282)..(288): a, c, t, g, unknown or other
  misc_feature (282)..(288): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggccaaccccactgtccactctgttcccgccctcctccgagcgacgaggagcggctggcaaggcgcatagnnnnnnn

SEQ ID NO: 55331 - DNA, 297 bp, Homo sapiens
  misc_feature: GYAE6OF02ITH9D.21.11.A11.1.454.CMB.1.raw
  modified_base (117)..(117): a, c, t, g, unknown or other
  misc_feature (117)..(117): n is a, c, g, or t
  modified_base (289)..(297): a, c, t, g, unknown or other
  misc_feature (289)..(297): n is a, c, g, or t
tcagtcgtcgctcgcacgaccggtgctcgatttagctacgactgcagggagaagggctggatgacttgggatggggagagagaccccctcccctgggatcctgcagctccacccggntgaagacgagggtgattattactgtgctcttatacgagaagggcgccacgtatgtcttcggaagtgggaccacggtcaccgtcctaggtcagcccaaggccaaccccactgtcactctcgttccccgcccctcctcctcgtctctactgacgcggctggcaaggcgcatagnnnnnnnnn

SEQ ID NO: 55332 - DNA, 300 bp, Homo sapiens
  misc_feature: GYAE6OF02HYZ6Q.21.11.A11.1.454.CMB.1.raw
  modified_base (280)..(280): a, c, t, g, unknown or other
  misc_feature (280)..(280): n is a, c, g, or t
  modified_base (286)..(300): a, c, t, g, unknown or other
  misc_feature (286)..(300): n is a, c, g, or t
tcagtcgtcgctcgcacgaccggtgctcgatttagctacgactgcagggagaagggctggatgacttgggatggggagagagaccctccctgggatcctgcagctccaggctgaagacgaggtgattattactgttgctcttatacgagaagggcgccacgtatgtcttcggaagtgggaccacggtcaccgtcctaggtcagcccaaggctgcccccctggtcactctgttccccacctcctcctcgtctactactgacgcgggctggccaaaggccgntatagnnnnnnnnnnnnnnn

SEQ ID NO: 55333 - DNA, 362 bp, Homo sapiens
  misc_feature: GYAE6OF02FK8SX.21.11.A11.1.454.CMB.1.raw
  modified_base (166)..(166): a, c, t, g, unknown or other
  misc_feature (166)..(166): n is a, c, g, or t
  modified_base (225)..(225): a, c, t, g, unknown or other
  misc_feature (225)..(225): n is a, c, g, or t
  modified_base (288)..(288): a, c, t, g, unknown or other
  misc_feature (288)..(288): n is a, c, g, or t
  modified_base (290)..(291): a, c, t, g, unknown or other
  misc_feature (290)..(291): n is a, c, g, or t
  modified_base (293)..(362): a, c, t, g, unknown or other
  misc_feature (293)..(362): n is a, c, g, or t
tcagtcgtcgctcgcacgaccggtgctcgattttagctacgactgcgagggagaagggctggatgacttgggatggggagaagagaccccctcccctgggatcctgcagctccaggctgaagacgagggtgatttattactgttgctcttatacgaagaaggggcnccacgtatgtcttggaagtggaccaggtcaccgtctaggtcagcccaaggccaaccccntgtcactctcgttccccaccctcctcctgtcctctactggagcggctgggcaaggcacatagnanncnnnnnnnnnnnnnnnnnnnnnnnnnnnnnnnnnnnnnnnnnnnnnnnnnnnnnnnnnnnnnnnnnnnnnn

SEQ ID NO: 55334 - DNA, 303 bp, Homo sapiens
  misc_feature: GYAE6OF02FQGI4.21.11.A11.1.454.CMB.1.raw
  modified_base (285)..(285): a, c, t, g, unknown or other
  misc_feature (285)..(285): n is a, c, g, or t
  modified_base (291)..(303): a, c, t, g, unknown or other
  misc_feature (291)..(303): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgccacgtatgtcttcggaagtgggaccacggtcaccgtcctaggtcagccccaaggcccaaacccccactgtccactctgttccccacccctccctccgagcgacgacgagcgggctggcaaggcncatagnnnnnnnnnnnnn

SEQ ID NO: 55335 - DNA, 311 bp, Homo sapiens
  misc_feature: GYAE6OF02IW6I7.21.11.A11.1.454.CMB.1.raw
  modified_base (286)..(286): a, c, t, g, unknown or other
  misc_feature (286)..(286): n is a, c, g, or t
  modified_base (288)..(311): a, c, t, g, unknown or other
  misc_feature (288)..(311): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaaggggcgtccacggtatgtcttcggaagtgggaccacggtcaccgtcctaggtcaggcccaaggccaaccccatgtcactctgttcccacctcctcctcgtctctactgagcggctggcctaaggcgcatagnannnnnnnnnnnnnnnnnnnnnnnn

SEQ ID NO: 55336 - DNA, 294 bp, Homo sapiens
  misc_feature: GYAE6OF02GCC77.21.11.A11.1.454.CMB.1.raw
  modified_base (282)..(294): a, c, t, g, unknown or other
  misc_feature (282)..(294): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggcccaacccatgtcactctcgttcccgcctcctcctcgtctctactgagccggctggcaaggcgcatagnnnnnnnnnnnnn

SEQ ID NO: 55337 - DNA, 293 bp, Homo sapiens
  misc_feature: GYAE6OF02JC5N3.21.11.A11.1.454.CMB.1.raw
  modified_base (127)..(127): a, c, t, g, unknown or other
  misc_feature (127)..(127): n is a, c, g, or t
  modified_base (160)..(160): a, c, t, g, unknown or other
  misc_feature (160)..(160): n is a, c, g, or t
  modified_base (285)..(293): a, c, t, g, unknown or other
  misc_feature (285)..(293): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtnattattactgttgctcttatacgagaaggggcnccacgtatgtcttcggaagtgggaccacggtcaccgtcctaggtcagcccaaggcccaaccccatgtcactctcgttcccaccctcctcctcgtctctactgagcggctggctaaggcgcatagnnnnnnnnn

SEQ ID NO: 55338 - DNA, 285 bp, Homo sapiens
  misc_feature: GYAE6OF02FPGVQ.21.11.A11.1.454.CMB.1.raw
  modified_base (282)..(285): a, c, t, g, unknown or other
  misc_feature (282)..(285): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgagaagggcgccacgtatgtcttcggaagtgggaccacggtcaccgtcctaggtcagcccaaggccaacccactgtcactctcgttcccaccctcctcctcgtctctactgagcggctggcaaggcgcatagnnnn

SEQ ID NO: 55339 - DNA, 345 bp, Homo sapiens
  misc_feature: GYAE6OF02HPD10.21.11.A11.1.454.CMB.1.raw
  modified_base (327)..(345): a, c, t, g, unknown or other
  misc_feature (327)..(345): n is a, c, g, or t
tcagtcgtcgctcgcacgaccggtgctcgatttagctacgactgcagggagaagggctggatgacttgggatggggagagagacccctcccctgggatcctgcagctccaggctgaagacgagggtgattattactgttgctcttatacgaggaagggcgccacgtatcgtcgttacggaaggtcgggaccacggtccaccgtcgtaggtcacgacccaacggacccaaaccccacgtcgtacctactccgttccgttcccccgcccttccctcctccgtcctctacgtgacggccgggtctcgggacgaaggtccgactaagtcgnnnnnnnnnnnnnnnnnnn

SEQ ID NO: 55340 - DNA, 342 bp, Homo sapiens
  misc_feature: GYAE6OF02JIICF.21.11.A11.1.454.CMB.1.raw
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (292)..(293): a, c, t, g, unknown or other
  misc_feature (292)..(293): n is a, c, g, or t
  modified_base (296)..(296): a, c, t, g, unknown or other
  misc_feature (296)..(296): n is a, c, g, or t
  modified_base (300)..(302): a, c, t, g, unknown or other
  misc_feature (300)..(302): n is a, c, g, or t
  modified_base (305)..(342): a, c, t, g, unknown or other
  misc_feature (305)..(342): n is a, c, g, or t
tcagtcgtcgctcgcacgaccggtgctcgatttagctacgactgcagggagaagggctggatgacttgggatggggagagagaccctccctgggatcctgcagctccaggctgaagacgagggtgattagttactgttgctcttatacgagtaaggggcgccacggtatgtcttcggaagtgggaccacggtcaccgtcaggtcagccaagccaacccactgtcactcctgttccccgccctcctccctcgtccttctactgacncggcttggcaacggcncgtaataggcnncgntagnnncgnnnnnnnnnnnnnnnnnnnnnnnnnnnnnnnnnnnnnn

SEQ ID NO: 55341 - DNA, 307 bp, Homo sapiens
  misc_feature: GYAE6OF02F5RST.21.11.A11.1.454.CMB.1.raw
  modified_base (160)..(160): a, c, t, g, unknown or other
  misc_feature (160)..(160): n is a, c, g, or t
  modified_base (287)..(307): a, c, t, g, unknown or other
  misc_feature (287)..(307): n is a, c, g, or t
tcagtcgtcgctcgcacgaccggtgctcgatttagctacgactgcagggagaagggctggatgacttgggatggggagagagaccccctcccctgggatcctgcagctccaggctgaagacgagggtgattattactgttgctcttatacgagaagggcnccacgtatgtcttcggaagtggaccacggtcaccgtcctaggtcagcccaaggccaaccccactgtcacctctgttccccgccctcctcctcgtcctctactggagcggctggcaaggcgcatacgnnnnnnnnnnnnnnnnnnnnn

SEQ ID NO: 55342 - DNA, 244 bp, Homo sapiens
  misc_feature: GYAE6OF01CZBLA.35.78.H01.1.454.CMB.1.raw
  modified_base (243)..(244): a, c, t, g, unknown or other
  misc_feature (243)..(244): n is a, c, g, or t
tcagtacagatcgtcacgaccggtgctcgatttagtgtgagtagtttgggtttgggtgtggtggtctccactcccgccttgacgaggctgactattactgtcagtcttatgatggtagcaagtatgtggtcttcggcggagggaccaagctgaccgtcctaggtcagcccaagactgcccctcggtcactctgttcccgccctcctcacgatctgtactgagcgggctggcaaggcgcatagnn

SEQ ID NO: 55343 - DNA, 276 bp, Homo sapiens
  misc_feature: GYAE6OF01CNDQ9.35.78.H01.1.454.CMB.1.raw
  modified_base (249)..(276): a, c, t, g, unknown or other
  misc_feature (249)..(276): n is a, c, g, or t
tcagtacagatcgtcacgaccggtgctcgatttagtgtgagtagttgggtttggggtgtgggtggtcgtccactcccgccttgacgaggctgactattactgtcagtcttatgatggtagccaagtatgtggtcttcggcggagggaccaagctgaccgtcctaggtcagcccaaggctgccccctggtcactctcgttccccaccctcctcacgatcctgtactgagcgggctggcaaggcgcatagnnnnnnnnnnnnnnnnnnnnnnnnnnnn

SEQ ID NO: 55344 - DNA, 244 bp, Homo sapiens
  misc_feature: GYAE6OF01DF0SX.35.78.H01.1.454.CMB.1.raw
  modified_base (242)..(244): a, c, t, g, unknown or other
  misc_feature (242)..(244): n is a, c, g, or t
tcagtacagatcgtcacgaccggtgctcgatttagtgtgagtagtttgggtttgggtgtggtggtctccactcccgccttgacgaggctgactattactgtcagtcttatgatggtagcaagtatgtggtcttcggcggagggaccaagctgaccgtcctaggtcagcccaagactgcccctcggtcactctgttcccgcctcctcacgatctgtactgagcgggctggcaaggcgcatagnnn

SEQ ID NO: 55345 - DNA, 245 bp, Homo sapiens
  misc_feature: GYAE6OF01C5XB2.35.78.H01.1.454.CMB.1.raw
  modified_base (244)..(245): a, c, t, g, unknown or other
  misc_feature (244)..(245): n is a, c, g, or t
tcagtacagatcgtcacgaccggtgctcgatttagtgtgagtagtttgggtttggggtgtggtggtctccactcccgccttgacgaggctgactattactgtcagtcttatgatggtagcaagtatgtggtcttcggcggagggaccaagctgaccgtcctaggtcagcccaagactgcccctcggtcactctgttcccgccctcctcacgatctgtactgagcgggctggcaaggcgcatagnn

SEQ ID NO: 55346 - DNA, 246 bp, Homo sapiens
  misc_feature: GYAE6OF01AFVD6.35.78.H01.1.454.CMB.1.raw
  modified_base (246)..(246): a, c, t, g, unknown or other
  misc_feature (246)..(246): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctcctcacgatctgtactgagcgggctggcaaggcgcatagn

SEQ ID NO: 55347 - DNA, 246 bp, Homo sapiens
  misc_feature: GYAE6OF01CRYOP.35.78.H01.1.454.CMB.1.raw
  modified_base (244)..(246): a, c, t, g, unknown or other
  misc_feature (244)..(246): n is a, c, g, or t
tcagtacagatcgtcacgaccggtgctcgatttagtgtgagtagtttgggtttggggtgtggtggtctccactcccgccttgacgaggctgattattattgttgctcatatgcaggtagtagcactaatgtcttcggaactgggaccaaggtcaccgtcctaggtcagcccaaggccaacccactgtcactctgttcccgccctcctcacgatctgtactgagcgggctggcaaggcgcatagnnn

SEQ ID NO: 55348 - DNA, 269 bp, Homo sapiens
  misc_feature: GYAE6OF01B45YZ.35.78.H01.1.454.CMB.1.raw
  modified_base (243)..(269): a, c, t, g, unknown or other
  misc_feature (243)..(269): n is a, c, g, or t
tcagtacagatcgtcacgaccggtgctcgatttagtgtgagtagtttgggtttggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgcctcctcacgatctgtactgagcgggctggcaaggcgcatagnnnnnnnnnnnnnnnnnnnnnnnnnnn

SEQ ID NO: 55349 - DNA, 292 bp, Homo sapiens
  misc_feature: GYAE6OF01BONEB.35.78.H01.1.454.CMB.1.raw
  modified_base (248)..(292): a, c, t, g, unknown or other
  misc_feature (248)..(292): n is a, c, g, or t
tcagtacagatcgtcacgaccggtgctcgatttagtgtgagtagtttgggtttgggggttgggtggtaggtctccactcccgccttgacgaggctgactattactgtcagtcttatgatggtagcaagtatgtggtcttcggcggagggaccaagctgaccgtcctaggtcagcccaagactgcccctggtcactctgttcccaccgtcctcacgatctgtactgagcggtctggcaaggcgcatagnnnnnnnnnnnnnnnnnnnnnnnnnnnnnnnnnnnnnnnnnnnnn

SEQ ID NO: 55350 - DNA, 244 bp, Homo sapiens
  misc_feature: GYAE6OF01EV2XY.35.78.H01.1.454.CMB.1.raw
  modified_base (243)..(244): a, c, t, g, unknown or other
  misc_feature (243)..(244): n is a, c, g, or t
tcagtacagatcgtcacgaccggtgctcgatttagtgtgagtagtttgggtttggggtgtggtggtctccactcccgccttgacgaggctgactattactgtcagtcttatgatggtagcaagtatgtggtcttcggcggagggaccaagctgaccgtcctaggtcagcccaagactgcccctcggtcactctgttcccacctcctcacgatctgtactgagcgggctggcaaggcgcatagnn

SEQ ID NO: 55351 - DNA, 260 bp, Homo sapiens
  misc_feature: GYAE6OF01E03MM.35.78.H01.1.454.CMB.1.raw
  modified_base (245)..(260): a, c, t, g, unknown or other
  misc_feature (245)..(260): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgcctcctcacgatctgtactgagcgggctggcaaggcgcatagnnnnnnnnnnnnnnnn

SEQ ID NO: 55352 - DNA, 279 bp, Homo sapiens
  misc_feature: GYAE6OF01BOKL3.35.78.H01.1.454.CMB.1.raw
  modified_base (242)..(242): a, c, t, g, unknown or other
  misc_feature (242)..(242): n is a, c, g, or t
  modified_base (244)..(279): a, c, t, g, unknown or other
  misc_feature (244)..(279): n is a, c, g, or t
tcagtacagatcgtcacgaccggtgctcgatttagtgtgagtagtttgggtttgggggtggtggtggtctccactcccgccttgacgaggctgactattactgtcagtcttatgatggtagcaagtatgtggtcttcggcggagggaccaagctgaccgtcctaggtcagcccaagactgcccctggtcactctgttcccacctctcacgatctgtactgagcggctggcaaggcgcatagntnnnnnnnnnnnnnnnnnnnnnnnnnnnnnnnnnnnn

SEQ ID NO: 55353 - DNA, 268 bp, Homo sapiens
  misc_feature: GYAE6OF01A5M0D.35.78.H01.1.454.CMB.1.raw
  modified_base (245)..(268): a, c, t, g, unknown or other
  misc_feature (245)..(268): n is a, c, g, or t
tcagtacagatcgtcacgaccggtgctcgatttagtgtgagtagttgggttgggggtgtggtggtctccactcccgccttgacgaggctgactattactgtcagtcttatgatggtagccaagtatgtggtcttcggcggagggaccaaggcctgaccgtcctaggtcagcccaagactgccccctggtcactctgttcccacctcctcacgatctgtactgagcgggctggcaaggcgcatagnnnnnnnnnnnnnnnnnnnnnnnn

SEQ ID NO: 55354 - DNA, 266 bp, Homo sapiens
  misc_feature: GYAE6OF01C19GM.35.78.H01.1.454.CMB.1.raw
  modified_base (246)..(266): a, c, t, g, unknown or other
  misc_feature (246)..(266): n is a, c, g, or t
tcagtacagatcgtcacgaccggtgctcgatttagtgtgagtagtttgggtttgggggtggtggtggtctccactcccgccttgacgaggctgactaattactgtcagtcttatgatggtagcaagtatgtggtcttcggcggagggaccaagctgaccgtcctaggtcagcccaagactgccccctggtcactctgttcccgcctcctcacgatctgtactgagcgggctggcaaggcgcatagnnnnnnnnnnnnnnnnnnnnn

SEQ ID NO: 55355 - DNA, 247 bp, Homo sapiens
  misc_feature: GYAE6OF01DRYOH.35.78.H01.1.454.CMB.1.raw
  modified_base (245)..(247): a, c, t, g, unknown or other
  misc_feature (245)..(247): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctctcacgatctgtactgagcgggctggcaaggcgcatagnnn

SEQ ID NO: 55356 - DNA, 296 bp, Homo sapiens
  misc_feature: GYAE6OF01CX0YE.35.78.H01.1.454.CMB.1.raw
  modified_base (294)..(296): a, c, t, g, unknown or other
  misc_feature (294)..(296): n is a, c, g, or t
tcagtacagatcgtcacgaccggtgctcgatttagtgtgagtagtttgggtttggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactgccccctggtcactctgttccccaccctcctcacgatctgtactgagcgggctggcaaggcgcatagnnn

SEQ ID NO: 55357 - DNA, 248 bp, Homo sapiens
  misc_feature: GYAE6OF01EHYOY.35.78.H01.1.454.CMB.1.raw
  modified_base (244)..(248): a, c, t, g, unknown or other
  misc_feature (244)..(248): n is a, c, g, or t
tcagtacagatcgtcacgaccggtgctcgatttagtgtgagtagtttgggtttggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcgcatagnnnnn

SEQ ID NO: 55358 - DNA, 556 bp, Homo sapiens
  misc_feature: GYAE6OF01BXLK1.35.78.H01.1.454.CMB.1.raw
tcagtacagatcgtcacgaccggtgctcgatttagtgtgagtagtttgggtttggggggatcagtcctggtggtagctcaggaagcagagcctggagcatctccactatggcctgggctccactacttctcaccctcctcgctcactgcacaggttcttgggccagtttcacgctgactcacgccccactctgtgtcggagtccgtaccgggaaagacggttaccatctcctgccacccgcagcagtggcagcattacctccggctatgtgcagtggtaccagcagccgcccgggctccttcccccaccaccgtcactccgtgaagacaacgtaaaacggccctcgtcggggttcctgatcggttctcgtggctccatcgacacgtcctcaattctcgcctccctaacactctctgactagaagactgagacgaggctagactactactcgtcagttctttaggagggtacaacgattcgtagtgggtggttcgggcggggaccagccgtggaccgtccgtaagtcgacgcccgaaggcctcgcccccgtgtcccg

SEQ ID NO: 55359 - DNA, 249 bp, Homo sapiens
  misc_feature: GYAE6OF01BDDAC.35.78.H01.1.454.CMB.1.raw
  modified_base (246)..(249): a, c, t, g, unknown or other
  misc_feature (246)..(249): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccaccctcctcacgatctgtactgagcgggctggcaaggcgcatagnnnn

SEQ ID NO: 55360 - DNA, 253 bp, Homo sapiens
  misc_feature: GYAE6OF01EDERY.35.78.H01.1.454.CMB.1.raw
  modified_base (245)..(253): a, c, t, g, unknown or other
  misc_feature (245)..(253): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactcctgttcccgcctcctcacgatctgtactgagcgggctggcaaggcgcatagnnnnnnnnn

SEQ ID NO: 55361 - DNA, 246 bp, Homo sapiens
  misc_feature: GYAE6OF01BNFH2.35.78.H01.1.454.CMB.1.raw
  modified_base (245)..(246): a, c, t, g, unknown or other
  misc_feature (245)..(246): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgcccctcggtcactctgttcccaccctcctcacgatctgtactgagcgggctggcaaggcgcatagnn

SEQ ID NO: 55362 - DNA, 247 bp, Homo sapiens
  misc_feature: GYAE6OF01C8BHW.35.78.H01.1.454.CMB.1.raw
  modified_base (246)..(247): a, c, t, g, unknown or other
  misc_feature (246)..(247): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctcctcacgatctgtactgagcgggctggcaaggcgcatagnn

SEQ ID NO: 55363 - DNA, 250 bp, Homo sapiens
  misc_feature: GYAE6OF01BO1TQ.35.78.H01.1.454.CMB.1.raw
  modified_base (246)..(250): a, c, t, g, unknown or other
  misc_feature (246)..(250): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctcctcacgatctgtactgagcgggctggcaaggcgcatagnnnnn

SEQ ID NO: 55364 - DNA, 246 bp, Homo sapiens
  misc_feature: GYAE6OF01EWUXE.35.78.H01.1.454.CMB.1.raw
  modified_base (244)..(246): a, c, t, g, unknown or other
  misc_feature (244)..(246): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccacctcctcacgatctgtactgagcgggctggcaaggcgcatagnnn

SEQ ID NO: 55365 - DNA, 246 bp, Homo sapiens
  misc_feature: GYAE6OF01DQJ57.35.78.H01.1.454.CMB.1.raw
  modified_base (245)..(246): a, c, t, g, unknown or other
  misc_feature (245)..(246): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnn

SEQ ID NO: 55366 - DNA, 247 bp, Homo sapiens
  misc_feature: GYAE6OF01BV1FY.35.78.H01.1.454.CMB.1.raw
  modified_base (246)..(247): a, c, t, g, unknown or other
  misc_feature (246)..(247): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccaccctcctcacgatctgtactgagcgggctggcaaggcgcatagnn

SEQ ID NO: 55367 - DNA, 305 bp, Homo sapiens
  misc_feature: GYAE6OF01D892P.35.78.H01.1.454.CMB.1.raw
  modified_base (292)..(292): a, c, t, g, unknown or other
  misc_feature (292)..(292): n is a, c, g, or t
  modified_base (298)..(305): a, c, t, g, unknown or other
  misc_feature (298)..(305): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactcgccccctcggtcactctgttccccaccctcctcacgattctgtactgagcgggctggcaaggcncatagnnnnnnnn

SEQ ID NO: 55368 - DNA, 249 bp, Homo sapiens
  misc_feature: GYAE6OF01BJ9Z0.35.78.H01.1.454.CMB.1.raw
  modified_base (242)..(249): a, c, t, g, unknown or other
  misc_feature (242)..(249): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccacctctcacgatctgtactgagcggctggcaaggcgcatagnnnnnnnn

SEQ ID NO: 55369 - DNA, 248 bp, Homo sapiens
  misc_feature: GYAE6OF01AJG1H.35.78.H01.1.454.CMB.1.raw
  modified_base (246)..(248): a, c, t, g, unknown or other
  misc_feature (246)..(248): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctcctcacgatctgtactgagcgggctggcaaggcgcatagnnn

SEQ ID NO: 55370 - DNA, 274 bp, Homo sapiens
  misc_feature: GYAE6OF01C8VH8.35.78.H01.1.454.CMB.1.raw
  modified_base (247)..(274): a, c, t, g, unknown or other
  misc_feature (247)..(274): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactcgccccctggtcactctcgttcccaccctctcacgatctgtactgagcgggctgggcaaggcgcatagnnnnnnnnnnnnnnnnnnnnnnnnnnnn

SEQ ID NO: 55371 - DNA, 247 bp, Homo sapiens
  misc_feature: GYAE6OF01BR11A.35.78.H01.1.454.CMB.1.raw
  modified_base (245)..(247): a, c, t, g, unknown or other
  misc_feature (245)..(247): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcgcatagnnn

SEQ ID NO: 55372 - DNA, 250 bp, Homo sapiens
  misc_feature: GYAE6OF01D14ZI.35.78.H01.1.454.CMB.1.raw
  modified_base (247)..(250): a, c, t, g, unknown or other
  misc_feature (247)..(250): n is a, c, g, or t
tcagtacagatcgtcacgaccggtgctcgatttagtgtgagtagtttgggtttgggggtgtggtggtctccactcccgccttgacgaggctgactattactgtcagtattatgatggtagcaagtatgtggtcttcgggcggagggaccaagctgaccgtcctaggtcagcccaagactgccccctcggtcactctgttcccaccctcctcacgatctgtactgagcgggctggcaaggcgcatagnnnn

SEQ ID NO: 55373 - DNA, 295 bp, Homo sapiens
  misc_feature: GYAE6OF01EVKXR.35.78.H01.1.454.CMB.1.raw
  modified_base (293)..(295): a, c, t, g, unknown or other
  misc_feature (293)..(295): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactgccccctggtcactctgttcccaccctctcacgatctgtactgagcgggctggcaaggcgcatagnnn

SEQ ID NO: 55374 - DNA, 250 bp, Homo sapiens
  misc_feature: GYAE6OF01A3NVL.35.78.H01.1.454.CMB.1.raw
  modified_base (246)..(250): a, c, t, g, unknown or other
  misc_feature (246)..(250): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccaccctcctcacgatctgtactgagcgggctggcaaggcgcatagnnnnn

SEQ ID NO: 55375 - DNA, 294 bp, Homo sapiens
  misc_feature: GYAE6OF01C2LE0.35.78.H01.1.454.CMB.1.raw
  modified_base (127)..(127): a, c, t, g, unknown or other
  misc_feature (127)..(127): n is a, c, g, or t
  modified_base (261)..(294): a, c, t, g, unknown or other
  misc_feature (261)..(294): n is a, c, g, or t
tcagtacagatcgtcacgaccggtgctcgatttagtgtgagtagtttgggtttgggggttggtggtggtctccactcccgtccttcgacgaggctgactaattacctgtcagtcttatgattggtancaagtatgtggtcttcggcggagggaccaagctgaaccgtcctaggtcagcccaagactcgccccctggtcactctgttcccgccctcctcacggatctcgtacctgacgcgggctgggccaaggccgcatagnnnnnnnnnnnnnnnnnnnnnnnnnnnnnnnnnn

SEQ ID NO: 55376 - DNA, 298 bp, Homo sapiens
  misc_feature: GYAE6OF01B1GNM.35.78.H01.1.454.CMB.1.raw
  modified_base (294)..(298): a, c, t, g, unknown or other
  misc_feature (294)..(298): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnnnnn

SEQ ID NO: 55377 - DNA, 245 bp, Homo sapiens
  misc_feature: GYAE6OF01A5BV4.35.78.H01.1.454.CMB.1.raw
  modified_base (245)..(245): a, c, t, g, unknown or other
  misc_feature (245)..(245): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagn

SEQ ID NO: 55378 - DNA, 247 bp, Homo sapiens
  misc_feature: GYAE6OF01DU14N.35.78.H01.1.454.CMB.1.raw
  modified_base (245)..(247): a, c, t, g, unknown or other
  misc_feature (245)..(247): n is a, c, g, or t
tcagtacagatcgtcacgaccggtgctcgatttagtgtgagtagtttgggtttgggggtgtggtggtctccactcccgcattgacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcgcatagnnn

SEQ ID NO: 55379 - DNA, 248 bp, Homo sapiens
  misc_feature: GYAE6OF01APOTS.35.78.H01.1.454.CMB.1.raw
  modified_base (245)..(248): a, c, t, g, unknown or other
  misc_feature (245)..(248): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtctaggtcagcccaagactcgccccctggtcactctgttcccaccctcctcacgatctgtactgagcgggctggcaaggcgcatagnnnn

SEQ ID NO: 55380 - DNA, 320 bp, Homo sapiens
  misc_feature: GYAE6OF01BJAKG.35.78.H01.1.454.CMB.1.raw
  modified_base (188)..(188): a, c, t, g, unknown or other
  misc_feature (188)..(188): n is a, c, g, or t
  modified_base (297)..(320): a, c, t, g, unknown or other
  misc_feature (297)..(320): n is a, c, g, or t
tcagtacagatcgtcacgaccggtgctcgatttagtgtgagtagtttgggtttgggggtgtggtggtctccactcccgccttgacgggctgctatctgcctccctcactatctctggactcaagacgtgaggacgaggctgactattactgtcagtcttatgatggtagcaagtatgtggtcttcggnggagggaccaagctgaccgtcctaggtcagcccaagactcgccccctggtcactctcgttccccacctctcacgatctgtactgagcgggctggacaaggcgcagtagnnnnnnnnnnnnnnnnnnnnnnnn

SEQ ID NO: 55381 - DNA, 294 bp, Homo sapiens
  misc_feature: GYAE6OF01EIMFN.35.78.H01.1.454.CMB.1.raw
  modified_base (249)..(294): a, c, t, g, unknown or other
  misc_feature (249)..(294): n is a, c, g, or t
tcagtacagatcgtcacgaccggtgctcgatttagtgtgagtagtttgggtttggggggtgtggtggtctccactcccgtccttgacgaggctgacgtattactgtcagtcttatgatggtagcaagtatgtggtcttcggccggagggaccaagctgaccgtcctaggtcagcccaagactgcccctgtcactctgttcccacctcctcacgatctgtactgagccgggctggcaaggcgtcgatagnnnnnnnnnnnnnnnnnnnnnnnnnnnnnnnnnnnnnnnnnnnnnn

SEQ ID NO: 55382 - DNA, 251 bp, Homo sapiens
  misc_feature: GYAE6OF01CV9H5.35.78.H01.1.454.CMB.1.raw
  modified_base (246)..(251): a, c, t, g, unknown or other
  misc_feature (246)..(251): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctcctcacgatctgtactgagcgggctggcaaggcgcatagnnnnnn

SEQ ID NO: 55383 - DNA, 248 bp, Homo sapiens
  misc_feature: GYAE6OF01CGIQ3.35.78.H01.1.454.CMB.1.raw
  modified_base (245)..(248): a, c, t, g, unknown or other
  misc_feature (245)..(248): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnnnn

SEQ ID NO: 55384 - DNA, 248 bp, Homo sapiens
  misc_feature: GYAE6OF01B7LJ8.35.78.H01.1.454.CMB.1.raw
  modified_base (246)..(248): a, c, t, g, unknown or other
  misc_feature (246)..(248): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactcgccccctggtcactctgttcccaccctcctcacgatctgtactgagcgggctggcaaggcgcatagnnn

SEQ ID NO: 55385 - DNA, 301 bp, Homo sapiens
  misc_feature: GYAE6OF01C7GII.35.78.H01.1.454.CMB.1.raw
  modified_base (297)..(301): a, c, t, g, unknown or other
  misc_feature (297)..(301): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagacctcgcccctcggtcactcctcgttcccacctcctcacgatctgtactgagcgggctggcaaggcgcatagnnnnn

SEQ ID NO: 55386 - DNA, 306 bp, Homo sapiens
  misc_feature: GYAE6OF01C4JC8.35.78.H01.1.454.CMB.1.raw
  modified_base (295)..(306): a, c, t, g, unknown or other
  misc_feature (295)..(306): n is a, c, g, or t
tcagtacagatcgtcacgaccggtgctcgatttagtgtgagtagtttgggtttgggggtggtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactgccccctggtcactctgttcccgcctcctcacgatctgtactgagcggctggcaaggcgacactagnnnnnnnnnnnn

SEQ ID NO: 55387 - DNA, 245 bp, Homo sapiens
  misc_feature: GYAE6OF01BNVAD.35.78.H01.1.454.CMB.1.raw
  modified_base (245)..(245): a, c, t, g, unknown or other
  misc_feature (245)..(245): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgcccctcggtcactctgttcccaccctcctcacgatctgtactgagcgggctggcaaggcgcatagn

SEQ ID NO: 55388 - DNA, 285 bp, Homo sapiens
  misc_feature: GYAE6OF01EUFCN.35.78.H01.1.454.CMB.1.raw
  modified_base (253)..(285): a, c, t, g, unknown or other
  misc_feature (253)..(285): n is a, c, g, or t
tcagtacagatcgtcacgaccggtgctcgatttagtgtgagtagtttgggtttgggggtggtggtggtctcccactcccgccttgacgaggctgtactattactgtcagtcttatgatggtagcaagtatgtggtcttcggcggtagggaccaagctgaccggttcctaggtcagccctaagactgccccctggtcactctgttcccgccctctcacgatcgtgtactgagcgggctggccaaggcgcatagnnnnnnnnnnnnnnnnnnnnnnnnnnnnnnnnn

SEQ ID NO: 55389 - DNA, 248 bp, Homo sapiens
  misc_feature: GYAE6OF01CC01R.35.78.H01.1.454.CMB.1.raw
  modified_base (244)..(248): a, c, t, g, unknown or other
  misc_feature (244)..(248): n is a, c, g, or t
tcagtacagatcgtcacgaccggtgctcgatttagtgtgagtagtttgggtttgggggtgtggtggtctccactcccgccttgacgaggctgattattattgttgctcatatgcaggtagtagcactaatgtcttcggaactgggaccaaggtcaccgtcctaggtcagcccaaggccaacccactgtcactctgttcccgccctcctcacatctgtactgagcgggctggcaaggcgcatagnnnnn

SEQ ID NO: 55390 - DNA, 249 bp, Homo sapiens
  misc_feature: GYAE6OF01C7CFT.35.78.H01.1.454.CMB.1.raw
  modified_base (245)..(249): a, c, t, g, unknown or other
  misc_feature (245)..(249): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnnnnn

SEQ ID NO: 55391 - DNA, 252 bp, Homo sapiens
  misc_feature: GYAE6OF01BO5VF.35.78.H01.1.454.CMB.1.raw
  modified_base (246)..(252): a, c, t, g, unknown or other
  misc_feature (246)..(252): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgacccctggtcactctcgttcccgccctcctcacgatctgtactgagcgggctggcaaggcgcatagnnnnnnn

SEQ ID NO: 55392 - DNA, 566 bp, Homo sapiens
  misc_feature: GYAE6OF01E5A0G.35.78.H01.1.454.CMB.1.raw
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (284)..(285): a, c, t, g, unknown or other
  misc_feature (284)..(285): n is a, c, g, or t
  modified_base (303)..(303): a, c, t, g, unknown or other
  misc_feature (303)..(303): n is a, c, g, or t
  modified_base (308)..(312): a, c, t, g, unknown or other
  misc_feature (308)..(312): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
tcagtacagatcgtcacgaccggtgctcgatttagtgtgagtagtttggtttgggggttggtggtggtcgtccacgtcccgccttgacgaggcgtgactattacgtccgtcagtcttatcgaggtggtacgcaagtatgtggtcttcggcggagggaccaagctgaccgtcctaggtcagcccaagacctgcccctcgtcacctcctgttcccacctcctacgacggatctgtactgacgcggtctggcgaacgggcgacagtagntgcnctatatgancacanncaggcgcctaagctccanctgcnnnnnctntgcgagtcgtcnctgtgtngngngngtgngtgngacgntntctctcncacatactatatctacgtacgagtagtagtacgttatactacttattactacgtaactaacgtataacgtaactacgttacgttacgtacgtaacggtacgtacgtaacttaaactaaacgtaaacgtaacgtacgtacgtacgtacgtaccgtacctacgtacgttcttacgttactcctcctaccctacctctcgtcgtacg

SEQ ID NO: 55393 - DNA, 285 bp, Homo sapiens
  misc_feature: GYAE6OF01EINIV.35.78.H01.1.454.CMB.1.raw
  modified_base (251)..(285): a, c, t, g, unknown or other
  misc_feature (251)..(285): n is a, c, g, or t
tcagtacagatcgtcacgaccggtgctcgatttagtgtgagtagtttgggtttggggggtgtggtggtctccgactcccgtcttgacgaggctgactattactgtcagtcttactgatggtagctaagtatgtggtcttcggcggagggaccaagctgtaccgtcctaggtcagcccaagactcgcccctggtcactctcgttcccgcctctcacgatctgtactgagcgggctggactaaggcgcatagnnnnnnnnnnnnnnnnnnnnnnnnnnnnnnnnnnn

SEQ ID NO: 55394 - DNA, 249 bp, Homo sapiens
  misc_feature: GYAE6OF01BWJK8.35.78.H01.1.454.CMB.1.raw
  modified_base (245)..(249): a, c, t, g, unknown or other
  misc_feature (245)..(249): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcgcatagnnnnn

SEQ ID NO: 55395 - DNA, 245 bp, Homo sapiens
  misc_feature: GYAE6OF01BNAP6.35.78.H01.1.454.CMB.1.raw
  modified_base (239)..(239): a, c, t, g, unknown or other
  misc_feature (239)..(239): n is a, c, g, or t
  modified_base (244)..(245): a, c, t, g, unknown or other
  misc_feature (244)..(245): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttccccgcctcctcacgatctgtactgagcgggctggcaaggcnatagnn

SEQ ID NO: 55396 - DNA, 252 bp, Homo sapiens
  misc_feature: GYAE6OF01BB1S9.35.78.H01.1.454.CMB.1.raw
  modified_base (241)..(241): a, c, t, g, unknown or other
  misc_feature (241)..(241): n is a, c, g, or t
  modified_base (247)..(252): a, c, t, g, unknown or other
  misc_feature (247)..(252): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcgggcggagggaccaagctgaccgtcctaggtcagcccaagactgccccctggtcactctcgttcccaccctcctcacgatctgtactgagcgggctggcaaggcncatagnnnnnn

SEQ ID NO: 55397 - DNA, 560 bp, Homo sapiens
  misc_feature: GYAE6OF01A97BV.35.78.H01.1.454.CMB.1.raw
  modified_base (158)..(158): a, c, t, g, unknown or other
  misc_feature (158)..(158): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (384)..(385): a, c, t, g, unknown or other
  misc_feature (384)..(385): n is a, c, g, or t
  modified_base (391)..(391): a, c, t, g, unknown or other
  misc_feature (391)..(391): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
tcagtacagatcgtcacgaccggtgctcgatttagtgtgagtagtttgggtttgggggtggtggtggtctccactcccgccttgacggggctgctatctcgcctccctcactactctctggacttcaaggtacgtgaggacgaggctgacctattacngtcagtcttatgatcggtagcaagtatggtgtcttcggcggtaggaccaagcgtgaccgtctaggtcacgccaagcgtcgcccctggtcacgtctcggtccccgaccttccgtacaaccggtattacctaggttaacctaggacggccggggcttcgggaccaaacggggccaccgaagttaacggcgtgactcaagncggngcgntagcacacgtanacgtananngatagngagagagagacgacgacgacacacactacacacgacacgacacacgngatactatanatatagtgtanaganagtanacgtacgacgcgacgtacgtcgacgacgtacgagtagtacgagagagacgtagagtgtagacgtacgtacgtacgtacgtcgtacgtcgtcg

SEQ ID NO: 55398 - DNA, 249 bp, Homo sapiens; identical to SEQ ID NO: 55390
  misc_feature: GYAE6OF01A9GEZ.35.78.H01.1.454.CMB.1.raw
  modified_base (245)..(249): a, c, t, g, unknown or other
  misc_feature (245)..(249): n is a, c, g, or t

SEQ ID NO: 55399 - DNA, 248 bp, Homo sapiens
  misc_feature: GYAE6OF01EQGW6.35.78.H01.1.454.CMB.1.raw
  modified_base (246)..(248): a, c, t, g, unknown or other
  misc_feature (246)..(248): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccaccctcctcacgatctgtactgagcgggctggcaaggcgcatagnnn

SEQ ID NO: 55400 - DNA, 714 bp, Homo sapiens
  misc_feature: GYAE6OF01CQKVX.35.78.H01.1.454.CMB.1.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
tcagtacagatcgtcacgaccggtgctcgatttagtgtgagtagtttgggtttggggggtggtagctcaggaagcagagcctggagcatctccactatggcctgggctccactacttctcaccctcctcgctcactgcacaggttcttgggccagtttttatgctgactcacgccccactctgtgtcggagtcgtccggggaagacggtgaccatcctcctgcacccgnagcagtgcagcattaccngcaatatgtgcagtcgtaaccaacgacgccggcccgggctaccgttcccccaaatacctcgtagactacgtaaagtaaaggtgtaactacgaaaacgtccccgttcggtacgggtccctaggtacgttccggtttccgtcgtacgggtcccaagttcgaactacgtcctaccctaccgtaaccttccgtacgtcccctcctacgtaccttactccttacgtacggaaccttaaccgaaggtaccgtaaggtacgggaacgtacggtctaacgtaacctacgtttacgtacgttaccgtagtttaccttaagagttaagtagggttaacgtacgttaaaggttgtaggtttacgggttacgttaccggggagggaaccgggtaccgaaaggtccgttaaccgggtaacccggttccgtaacggtccgaacggtaccccgtaacgtacccggttccccgtacccccggg

SEQ ID NO: 55401 - DNA, 386 bp, Homo sapiens
  misc_feature: GYAE6OF01ASXXF.35.78.H01.1.454.CMB.1.raw
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (320)..(386): a, c, t, g, unknown or other
  misc_feature (320)..(386): n is a, c, g, or t
tcagtacagatcgtcacgaccggtgctcgattttagtgtgagtagtttgggtttggggggtgtggttgggtctccactcccgccttgacggggctgctatctgcctccctcactagtcctctggactcaagacgtgaggacgaggctgactattactgtcagtcttatgatggtagcaagtatgtggtcttcggcggaggaccaagctgaccgtcctaggtcagcccaagactcgccccctggtcactctcgttccccgccctcctcacgatctgttactagagtcgggtactgggacaggtcgtcaagtaagncgntcnnnnnnnnnnnnnnnnnnnnnnnnnnnnnnnnnnnnnnnnnnnnnnnnnnnnnnnnnnnnnnnnnnn

SEQ ID NO: 55402 - DNA, 250 bp, Homo sapiens
  misc_feature: GYAE6OF01AVDSC.35.78.H01.1.454.CMB.1.raw
  modified_base (245)..(250): a, c, t, g, unknown or other
  misc_feature (245)..(250): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnnnnnn

SEQ ID NO: 55403 - DNA, 251 bp, Homo sapiens
  misc_feature: GYAE6OF01BBH44.35.78.H01.1.454.CMB.1.raw
  modified_base (248)..(251): a, c, t, g, unknown or other
  misc_feature (248)..(251): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttccccaccctcctcacgatctgtactgagcgggctgggcaaggcgcatagnnnn

SEQ ID NO: 55404 - DNA, 247 bp, Homo sapiens
  misc_feature: GYAE6OF01BJEIV.35.78.H01.1.454.CMB.1.raw
  modified_base (246)..(247): a, c, t, g, unknown or other
  misc_feature (246)..(247): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttccccaccctcctcacgatctgtactgagcgggctggcaaggcgcatagnn

SEQ ID NO: 55405 - DNA, 288 bp, Homo sapiens
  misc_feature: GYAE6OF01EL25T.35.78.H01.1.454.CMB.1.raw
  modified_base (246)..(246): a, c, t, g, unknown or other
  misc_feature (246)..(246): n is a, c, g, or t
  modified_base (252)..(288): a, c, t, g, unknown or other
  misc_feature (252)..(288): n is a, c, g, or t
tcagtacagatcgtcacgaccggtgctcgatttagtgtgagtagtttgggtttggggggtagtggtggtctaccaacctcccgccttgacgaggctgactattactgtcagtcttatgactggtagcaagtatgtggtcttcggcggagggaccaagctgaccgtcctaggtcagcccaagctgccccctggtcactctgttcccgccctcctcacgatctgtactgagccgggcgtggcaaggcncatagnnnnnnnnnnnnnnnnnnnnnnnnnnnnnnnnnnnnn

SEQ ID NO: 55406 - DNA, 247 bp, Homo sapiens
  misc_feature: GYAE6OF01EJML0.35.78.H01.1.454.CMB.1.raw
  modified_base (238)..(238): a, c, t, g, unknown or other
  misc_feature (238)..(238): n is a, c, g, or t
  modified_base (244)..(247): a, c, t, g, unknown or other
  misc_feature (244)..(247): n is a, c, g, or t
tcagtacagatcgtcacgaccggtgctcgatttagtgtgagtagtttgggtttgggggtggtggtggtctccactcccgcccttgacgaggctgactattactgtcagtcttatgatggtagcaagtatgtggtcttcggcggaggaccaagctgaccgtcctaggtcagcccaagactgccccctggtcactctgttcccacctctcacgatctgtactgagcgggctggcaaggcncatagnnnn

SEQ ID NO: 55407 - DNA, 556 bp, Homo sapiens
  misc_feature: GYAE6OF01BV4A7.35.78.H01.1.454.CMB.1.raw
  modified_base (212)..(212): a, c, t, g, unknown or other
  misc_feature (212)..(212): n is a, c, g, or t
tcagtacagatcgtcacgaccggtgctcgatttagtgtgagtagtttgggtttgggggggatcagtcctggtggtagctcaggaagcagagcctggagcatctccactatggcctgggctccactacttctcaccctcctcgctcactgcacaggttcttgggccagttttatgctgactcagccccatctgtgtcggagtctccggggaanacggtgaccatcctcctgccacccgcagcagtggcagcattaccagcaactatgtgcagtggtaccaacagcgcccgggcacgttcccccaatacctctgatctaataaaggtgatacaaacgtccctcgtcgggtccctgacgttccgttctcgtcgggtccagtcgacagcctcctaccaactctcgccctcctcactactctctgacctcaagactgacggacgaggctacgtactcttactcgtctagttacttagtgagtaggtagtacgtaagtgttggtcggttcgttcgggcgggacggacccgagtcgtacggacccgttcgtacggtcaaccgg

SEQ ID NO: 55408 - DNA, 247 bp, Homo sapiens
  misc_feature: GYAE6OF01C93FD.35.78.H01.1.454.CMB.1.raw
  modified_base (246)..(247): a, c, t, g, unknown or other
  misc_feature (246)..(247): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcgggcggagggaccaagctgaccgtcctaggtcagcccaagactgccccctggtcactctgttcccaccctcctcacgatctgtactgagcgggctggcaaggcgcatagnn

SEQ ID NO: 55409 - DNA, 581 bp, Homo sapiens
  misc_feature: GYAE6OF01AHNUQ.35.78.H01.1.454.CMB.1.raw
tcagtacagatcgtcacgaccggtgctcgatttagtgtgagtagtttgggtttgggggtggtagctcaggaagcagagcctggagcatctccactatggcctgggctccactacttctcaccctcctcgctcactgcacaggttcttgggccagttttatgctgactcagcccccactctgtgtcggagtctccggggaagacggtgaccatctcctgcacccgcagcagtggcagcattaccagcaactatgtgcagtggtaccaacagcgcccgggcacgtcccccaatacgtctgatctataaaggtgatcaaagaccctctggggtccctgactcggttctcgtgggtccatcgacagctcctccaactctcgcctccgtcactactctcctggacctcaaacgtacgtcggacggaccgagggcctagtaccgttaacttacgttcgtctacgttcctttaagtgtaagttcggtagtacaaggttatggttcggtacttcgggacggtaacgggaccgaagcgtcgacccgttccgtacggtccaggtaccccaacgtccgtaccggtccccccg

SEQ ID NO: 55410 - DNA, 251 bp, Homo sapiens
  misc_feature: GYAE6OF01C2YDT.35.78.H01.1.454.CMB.1.raw
  modified_base (247)..(251): a, c, t, g, unknown or other
  misc_feature (247)..(251): n is a, c, g, or t
tcagtacagatcgtcacgaccggtgctcgatttagtgtgagtagtttgggtttgggggtgtggtggtctccactcccgccttgacgaggctgattattattgttgctcatatgcaggtagtagcactaatgtcttcggaactgggaccaaggtcaccgtcctaggtcagcccaaggcccaaccccactgtcactctcgttcccaccctcctcacgatctgtactgagcggctggcaaggcgcatagnnnnn

SEQ ID NO: 55411 - DNA, 248 bp, Homo sapiens
  misc_feature: GYAE6OF01CDOKO.35.78.H01.1.454.CMB.1.raw
  modified_base (246)..(248): a, c, t, g, unknown or other
  misc_feature (246)..(248): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctcgttcccgccctcctcacgatctgtactgagcgggctggcaaggcgcatagnnn

SEQ ID NO: 55412 - DNA, 311 bp, Homo sapiens
  misc_feature: GYAE6OF01B9JWT.35.78.H01.1.454.CMB.1.raw
  modified_base (299)..(311): a, c, t, g, unknown or other
  misc_feature (299)..(311): n is a, c, g, or t
tcagtacagatcgtcacgaccggtgctcgatttagtgtgagtagtttgggtttggggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactcgccccctcggtcacctctcgttcccaccctcctcacgatctgtactgagcgggctggcaaggcgcatagnnnnnnnnnnnnn

SEQ ID NO: 55413 - DNA, 251 bp, Homo sapiens
  misc_feature: GYAE6OF01CNGUS.35.78.H01.1.454.CMB.1.raw
  modified_base (247)..(251): a, c, t, g, unknown or other
  misc_feature (247)..(251): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctggtaactctcgttccccgccctcctcacgatctgtactgagcggctggcaaggcgcatagnnnnn

SEQ ID NO: 55414 - DNA, 246 bp, Homo sapiens
  misc_feature: GYAE6OF01A7JD4.35.78.H01.1.454.CMB.1.raw
  modified_base (245)..(246): a, c, t, g, unknown or other
  misc_feature (245)..(246): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctcgttcccccctctcacgatctgtactgagcgggctggcaaggcgcatagnn

SEQ ID NO: 55415 - DNA, 295 bp, Homo sapiens
  misc_feature: GYAE6OF01DY86D.35.78.H01.1.454.CMB.1.raw
  modified_base (254)..(295): a, c, t, g, unknown or other
  misc_feature (254)..(295): n is a, c, g, or t
tcagtacagatcgtcacgaccggtgctcgatttagtgtgagtagtttgggtttggggggtggtggtggtctccactcccgccttgacgaggctgactattacctgtcagtcttatgatggtagcaagtatgtggtcttcggcggagggaccaagctgaccgtctaggtcagcccaagactgccccctcggtcacttctgttccccacccgtcctcacgactctgtactgagcgggctggcaagggcgtcatagnnnnnnnnnnnnnnnnnnnnnnnnnnnnnnnnnnnnnnnnnn

SEQ ID NO: 55416 - DNA, 634 bp, Homo sapiens
  misc_feature: GYAE6OF01B1NPO.35.78.H01.1.454.CMB.1.raw
  modified_base (174)..(174): a, c, t, g, unknown or other
  misc_feature (174)..(174): n is a, c, g, or t
  modified_base (326)..(326): a, c, t, g, unknown or other
  misc_feature (326)..(326): n is a, c, g, or t
tcagtacagatcgtcacgaccggtgctcgatttagtgtgagtagtttgggtttgggggggatcagtcctggtggtagctcaggaagcagagcctggagcatctccactatggcctgggctccactacttctcaccctcctcgctcactgcacaggttcttgggccagtttttangctgactcagccccatctgtgtcggagtctccgggggaagacggtgaccatctcctgccacccgcagcagtggcagcattaccagcaactatgtgcagtggtaccaacagcgcccgggcacgttccccaatactctgatactaataaaggtnaatcaaaacgtccctcgtcgggtccctgactcggttctcgtgggtccatcgacagcctcctaccaactctcgtccctcctctactactctcgtcggactacgaacgacgtaggacgggacggaggtctacgtaacttacgtttaacgttcgtacgtaagttctttaagttggtagttagggtaacgtacgtaaaggttagttcgggttcgggtttaccgggttaccggggccggggtaaacggggaacccgtaaacgggtccgttaaccggtaacccggttaccggttaacgggtacccgaaacccgg

SEQ ID NO: 55417 - DNA, 284 bp, Homo sapiens
  misc_feature: GYAE6OF01BVIK4.35.78.H01.1.454.CMB.1.raw
  modified_base (247)..(247): a, c, t, g, unknown or other
  misc_feature (247)..(247): n is a, c, g, or t
  modified_base (252)..(284): a, c, t, g, unknown or other
  misc_feature (252)..(284): n is a, c, g, or t
tcagtacagatcgtcacgaccggtgctcgatttagtgtgagtagtttgggtttgggggggtgtggtggtctccactcccgccttgacgaggctggaactattactgtcagtcttatcgatggtagcaacgtatgtggtcttcggcggagggaccaagctgaccgtcctaggtcagcccaagactcgccccctggtccactctgttccccgcctcctcacgatttgactgagcgggctggcaaggcgnatagnnnnnnnnnnnnnnnnnnnnnnnnnnnnnnnnn

SEQ ID NO: 55418 - DNA, 739 bp, Homo sapiens
  misc_feature: GYAE6OF01BNDA9.35.78.H01.1.454.CMB.1.raw
  modified_base (174)..(174): a, c, t, g, unknown or other
  misc_feature (174)..(174): n is a, c, g, or t
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
tcagtacagatcgtcacgaccggtgctcgatttagtgtgagtagtttgggtttgggggggatcagtcctggtggtagctcaggaagcagagcctggagcatctccactatggcctgggctccactacttctcaccctctcgctcactgcactaggttcttgggcctagttttangctagactcacgccctatcgtgtgtcggagtcgtacgggaagtccgtacntctcncgacaccgnagcaggtggcagctacttccgtcggcttagtgtgacgtaggtacgaccgaggaccgcggcccggccccggtcttacccccttaccccgaccgtaccgtctacggttaccgaggaaccaacgtaaccggtaaaccgtcccgttaggttcgggtactggtacgttcggtcctcggtacgtccctacgtacgtaccgaaccttccgtacctacgttacttccgaccctaccctaccaactcgttccgtaggtacgtaacgtacggtaacgtaccgaggacgggtacgtacggtactaccggtaactttaactcgttacgtacgttcggtttacggttacggaacgtaacgtacgtacgttcgggtacgggttcgggtacggggtcccgggtaaacggggaacctacggtaccggttaccggtaacccggttaaccgtaaggtaccccggtacggtaacccggtacggttccccccgtaccggttaccccgttacgggttacccc

SEQ ID NO: 55419 - DNA, 253 bp, Homo sapiens
  misc_feature: GYAE6OF01DE07W.35.78.H01.1.454.CMB.1.raw
  modified_base (250)..(253): a, c, t, g, unknown or other
  misc_feature (250)..(253): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcgggcggagggaccaagctgaccgtcctaggtcagcccaagacctcgccccctggtcactctcgttcccaccctcctcacgatctgtactgacgcgggctggacaaggcgcatgnnnn

SEQ ID NO: 55420 - DNA, 249 bp, Homo sapiens
  misc_feature: GYAE6OF01BA1M8.35.78.H01.1.454.CMB.1.raw
  modified_base (247)..(249): a, c, t, g, unknown or other
  misc_feature (247)..(249): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctcgttcccaccctcctcacgatctgtactgagcgggctggcaaggcgcatagnnn

SEQ ID NO: 55421 - DNA, 708 bp, Homo sapiens
  misc_feature: GYAE6OF01DN5KU.35.78.H01.1.454.CMB.1.raw
  modified_base (165)..(165): a, c, t, g, unknown or other
  misc_feature (165)..(165): n is a, c, g, or t
  modified_base (232)..(232): a, c, t, g, unknown or other
  misc_feature (232)..(232): n is a, c, g, or t
  modified_base (454)..(454): a, c, t, g, unknown or other
  misc_feature (454)..(454): n is a, c, g, or t
tcagtacagatcgtcacgaccggtgctcgatttagtgtgagtagtttgggtttgggggggtggtagctcaggaagcagagcctggagcatctccactatggcctgggctccactacttctccaccctcctcgctcactgcactaggttcttgggcctagttttangctgactcacgccccatctgtggtcggagtcgtaccggggaagacggtgaccatctcctgccaccgnacgcaggtggcacgtactaactaccgagactaaactagtggtcggactaacggtacggtaaaccaacgaccggcccgggaccccgggtactaccccggttaccccctaattaccgtctacgtaactaacgttaaagtaacgggtataactaaccgaaaccgtccgttcgggttaccgggtcctggtacgttccggttcgtcggtcggtacctacgtcgaacncgtccttacctaccacgttctccgtccctcctactatcctctccgtacgtactacgaaagtacgtaggaacggacgtacggtctaaacgtacttactcgtgttactacgttgtatggtacgtgtaacgacttaaggtcggttggttcggtaccgcgggggtaacggtaacgggaaccgtaggtccgttaccgtaccggttaccgaacggtaccaacccggtacccgtaacgggtccccttccccggggtacccc

SEQ ID NO: 55422 - DNA, 256 bp, Homo sapiens
  misc_feature: GYAE6OF01AXX6Z.35.78.H01.1.454.CMB.1.raw
  modified_base (249)..(256): a, c, t, g, unknown or other
  misc_feature (249)..(256): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactcgccccctcggtcactctcgttcccaccctcctcacgatctgtactgacgcgggctggcaaggcgcatagnnnnnnnn

SEQ ID NO: 55423 - DNA, 249 bp, Homo sapiens; identical to SEQ ID NO: 55390
  misc_feature: GYAE6OF01AZTIF.35.78.H01.1.454.CMB.1.raw
  modified_base (245)..(249): a, c, t, g, unknown or other
  misc_feature (245)..(249): n is a, c, g, or t

SEQ ID NO: 55424 - DNA, 254 bp, Homo sapiens
  misc_feature: GYAE6OF01D260I.35.78.H01.1.454.CMB.1.raw
  modified_base (248)..(254): a, c, t, g, unknown or other
  misc_feature (248)..(254): n is a, c, g, or t
tcagtacagatcgtcacgaccggtgctcgatttagtgtgagtagtttgggtttgggggtgtggtggtctccactcccgccttgaccaggctgactattactgtcagtcttatgatggtagcaagtatgtggtcttcgggcggagggaccaagctgaccgtcctaggtcagcccaagactcgccccctggtcactctcgttcccgccctcctcacgatctgtactgagcgggctggcaaggcgcatagnnnnnnn

SEQ ID NO: 55425 - DNA, 250 bp, Homo sapiens
  misc_feature: GYAE6OF01D49MP.35.78.H01.1.454.CMB.1.raw
  modified_base (241)..(241): a, c, t, g, unknown or other
  misc_feature (241)..(241): n is a, c, g, or t
  modified_base (245)..(250): a, c, t, g, unknown or other
  misc_feature (245)..(250): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcgggcggagggaccaagctgaccgtcctaggtcagcccaagactcgccccctggtcactctcgttcccgcctcctcacgatctgtactgagcggctggcaggcganatgnnnnnn

SEQ ID NO: 55426 - DNA, 249 bp, Homo sapiens
  misc_feature: GYAE6OF01CECMS.35.78.H01.1.454.CMB.1.raw
  modified_base (238)..(238): a, c, t, g, unknown or other
  misc_feature (238)..(238): n is a, c, g, or t
  modified_base (243)..(249): a, c, t, g, unknown or other
  misc_feature (243)..(249): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtctaggtcagcccaagactgccccctggtcactctgttcccgccctctcacgatctgtactgagcgggctggcaaggcnatagnnnnnnn

SEQ ID NO: 55427 - DNA, 268 bp, Homo sapiens
  misc_feature: GYAE6OF01DAIJZ.35.78.H01.1.454.CMB.1.raw
  modified_base (121)..(121): a, c, t, g, unknown or other
  misc_feature (121)..(121): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (258)..(268): a, c, t, g, unknown or other
  misc_feature (258)..(268): n is a, c, g, or t
tcagtacagatcgtcacgaccggtgctcgatttagtgtgagtagtttgggtttggggggtgtggtggtctccactcccgcttgacgaggctgactattactgtcagtcttatgagtggtancgaagttatggtggtcttcgggcggagggaccagctgaccgtctaggtcagccaagactcgcccctggtcactctcgttcccaccctcncacgatcgtgtacgnggacggcgggtctggaccgaagggccacaatgnnnnnnnnnnn

SEQ ID NO: 55428 - DNA, 323 bp, Homo sapiens
  misc_feature: GYAE6OF01ET4HO.35.78.H01.1.454.CMB.1.raw
  modified_base (142)..(142): a, c, t, g, unknown or other
  misc_feature (142)..(142): n is a, c, g, or t
  modified_base (215)..(215): a, c, t, g, unknown or other
  misc_feature (215)..(215): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (283)..(323): a, c, t, g, unknown or other
  misc_feature (283)..(323): n is a, c, g, or t
tcagtacagatcgtcacgaccggtgctcgatttagtgtgagtagtttgggtttgggggggtgtggtggtctccactcccgccttgacgaggctgactattactgtcagtcttatgatggtagcaagtatgtggtcttcgggnggagggaccagctgaccgtctaggtcacgacccaagacctcgtcccccgtggtctactccttccggttccccncccttcctcacgtattccgtagtacgtgacggcggtcgtggacgaacggtcactaagaggnagntgannnnnnnnnnnnnnnnnnnnnnnnnnnnnnnnnnnnnnnnn

SEQ ID NO: 55429 - DNA, 248 bp, Homo sapiens
  misc_feature: GYAE6OF01AOY8E.35.78.H01.1.454.CMB.1.raw
  modified_base (243)..(248): a, c, t, g, unknown or other
  misc_feature (243)..(248): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactcgccccctggtcactctcgttcccacctcctcacgatctgtactgagcggctggcaggcgcatgnnnnnn

SEQ ID NO: 55430 - DNA, 639 bp, Homo sapiens
  misc_feature: GYAE6OF01CBASD.35.78.H01.1.454.CMB.1.raw
tcagtacagatcgtcacgaccggtgctcgatttagtgtgagtagtttgggtttggggggtggtagctcaggaagcagagcctggagcatctccactatggcctgggctccactacttctcaccctcctcgctcactgcacaggttcttgggccagttttatgctgactcagccccactctgtgtcggagtcgtccggggaagacggtgaccatcctcctgccacccgcagcagtggcagcattaccagcaactatgtgcagtcggtaaccaacgacgccggcccgggctaccgttacccccaatactctgatactaagtaaaggtgaatacaaacgtcccgtcgtcgggtcctagtacgttccggttctcgtcggtccagtcgacacgtcctccctaccaactctcgccctccctactactactcctacgtacggtacctacgaaacgcgtaggacggacgtacggtctacgtacttatttaccgtcgtacgtacgtttcttagtacgtagttaggtaacgtacgtaaggttgttaggttcggttacgtacggggacgggtacgggaccgtaagtaccggtacggtacccgttcgtacggtaccaccgacccgtaacgtacccgtcccggtacccccgg

SEQ ID NO: 55431 - DNA, 258 bp, Homo sapiens
  misc_feature: GYAE6OF01B1PVB.35.78.H01.1.454.CMB.1.raw
  modified_base (247)..(258): a, c, t, g, unknown or other
  misc_feature (247)..(258): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttggcggagggaccaagctgaccgtcctaggccagcccaagactcgccccctggtcactctcgttcccgccctcctcacgatctgtactgagcgggctggcaaggcgcatagnnnnnnnnnnnn

SEQ ID NO: 55432 - DNA, 822 bp, Homo sapiens
  misc_feature: GYAE6OF01D43AQ.35.78.H01.1.454.CMB.1.raw
  modified_base (229)..(229): a, c, t, g, unknown or other
  misc_feature (229)..(229): n is a, c, g, or t
tcagtacagatcgtcacgaccggtgctcgatttagtgtgagtagtttgggtttggggggtggtagctcaggaagcagagcctggagcatctccactatggctgggctccactacttctcaccctcctcgctcactgcactaggttcttgggcctagttttatgctgactcacgcccatctgtgtcggagtcgtaccggggaagacggtcgaccatcctcctgccaccgnagcgagtggacagtctacttaccagactaacgtgtggtacgacgtaggtacggaaaccaacgcggtcccggaccgggtactaccgttacccctaattcctctagacttaacgtaataaggtctaactaacgaaacgtccccgttaggtccggggtacctacggttacgttccggttttactccgggttcgggtaacctaacgtccggtaaacctacgttcccgttacccttaaacccggttactttcccggtcccgtaccccctttaccctaaccttaaccgttaacttcctacggtacgtaaccgtaacgaacggtaacgtagggaaacgacgtaggttacctaacgtttaaccttattaccggttagtaccgttaagtttaccgttagtacggtagttacgggtaaacttagttaaaggtttcggttcgggttaccgggttaccgggttaccgggggaaaaccgggtacgggtaaacccgtaagggtttcccgaccccggtttaaccccggggttaccccttaccgggtaaaccccgtaccccgggaaaccccggtacgggttcccccctaccccggggtttaccccccgg

SEQ ID NO: 55433 - DNA, 252 bp, Homo sapiens
  misc_feature: GYAE6OF01BUD44.35.78.H01.1.454.CMB.1.raw
  modified_base (246)..(252): a, c, t, g, unknown or other
  misc_feature (246)..(252): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcgggcggagggaccaagctgaccgtcctaggtcagcccaagactcgccccctggtcactctgttcccgccctctcacgatctgtactgagcgggctggcaaggcgcatagnnnnnnn

SEQ ID NO: 55434 - DNA, 190 bp, Homo sapiens
  misc_feature: GYAE6OF01BDWJN.35.78.H01.1.454.CMB.1.raw
  modified_base (161)..(161): a, c, t, g, unknown or other
  misc_feature (161)..(161): n is a, c, g, or t
  modified_base (166)..(190): a, c, t, g, unknown or other
  misc_feature (166)..(190): n is a, c, g, or t
tcagtacagatcgtcacgaccggtgctcgatttagtgtgagtagtttgggtttggggggtgtggtggtctccactcccgccttgacggggctgctatctgccccctggtcactctgttccccgccctcctcacgatctgtactgagcgggctggcaaggcnatagnnnnnnnnnnnnnnnnnnnnnnnnn

SEQ ID NO: 55435 - DNA, 247 bp, Homo sapiens
  misc_feature: GYAE6OF01A92EL.35.78.H01.1.454.CMB.1.raw
  modified_base (242)..(247): a, c, t, g, unknown or other
  misc_feature (242)..(247): n is a, c, g, or t
tcagtacagatcgtcacgaccggtgctcgatttagtgtgagtagtttgggtttgggggtgtggtggtctccactcccgcttgacgaggctgactattactgtcagtcttatgatggtagcaagtatgtggtcttcggcggagggaccaagctgaccgtcctaggtcagcccaagactgcccctggtcactctgttcccgccctctcacgatctgtactgagcgggctggcaaggcgcatagnnnnnn

SEQ ID NO: 55436 - DNA, 324 bp, Homo sapiens
  misc_feature: GYAE6OF01CKKR7.35.78.H01.1.454.CMB.1.raw
  modified_base (311)..(324): a, c, t, g, unknown or other
  misc_feature (311)..(324): n is a, c, g, or t
tcagtacagatcgtcacgaccggtgctcgatttagtgtgagtagtttgggtttggggggtgtgatggtctccactcccgccttgacgggctgctatctgcctccctcactatctctggactcaagactgaggacgaggctgactattactgtcagttcttatgatggtagcaagtatgtggtcttcggcggaggaccaagcctgaccgtcctaggtcacgacccaagacctcgccccctcggtccactctcgtccccacctcctcacgatcctgtactgaggccgggtctcgggacaacggcgcaagtagnnnnnnnnnnnnnn

SEQ ID NO: 55437 - DNA, 700 bp, Homo sapiens
  misc_feature: GYAE6OF01CFRNN.35.78.H01.1.454.CMB.1.raw
  modified_base (174)..(174): a, c, t, g, unknown or other
  misc_feature (174)..(174): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
tcagtacagatcgtcacgaccggtgctcgatttagtgtgagtagtttgggtttgggggggatcagtcctggtggtagctcaggaagcagagcctggagcatctccactatggcctgggctccactacttctcacccctctcgctcactgcacaggttcttgggcctagttttangctgactcacgcccccatctgtgtcggagtcgccgggggaancggtnaccatcctcctgccacccgnagcaggtcggcagcattaccagacaactagtgtgacaggtacggaccaacgacggccggcccgggacctaccgttaccccaatacctctacgtattacttaaagtaaaggtgaactacgtaaaaccgtacccgttacggtcggggtcctaggtacttccggttctcgtcgggtcctacgtaccgacaccgtctaccctacctaactcctccgtaccctcccctactaccttacgttcctacgtacggaacctacgaaggtacgtaggacgggtaacgacggtccgttagtactttaacgtttagtcgtacttagttaccgtttagtaggtacgtacgggtagaaccggtttaagtacgttagggttccggttacggttacggggaccgggtaacggggtaaccgttaacggtccgttaaccgggacccctttacgggtaccggttacccggaaccccgg

SEQ ID NO: 55438 - DNA, 260 bp, Homo sapiens
  misc_feature: GYAE6OF01CF8U4.35.78.H01.1.454.CMB.1.raw
  modified_base (243)..(243): a, c, t, g, unknown or other
  misc_feature (243)..(243): n is a, c, g, or t
  modified_base (249)..(260): a, c, t, g, unknown or other
  misc_feature (249)..(260): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctcgtccccaccctctcacgtatctgtactgaggcggctgggcaaggccgnagtagnnnnnnnnnnnn

SEQ ID NO: 55439 - DNA, 256 bp, Homo sapiens
  misc_feature: GYAE6OF01EXAQ6.35.78.H01.1.454.CMB.1.raw
  modified_base (246)..(256): a, c, t, g, unknown or other
  misc_feature (246)..(256): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcgcatagnnnnnnnnnnn

SEQ ID NO: 55440 - DNA, 694 bp, Homo sapiens
  misc_feature: GYAE6OF01DLM7E.35.78.H01.1.454.CMB.1.raw
tcagtacagatcgtcacgaccggtgctcgatttagtgtgagtagtttgggtttgggggtggtagctcaggaagcagagcctggagcatctccactatggcctgggctccactacttctcaccctcctcgctcactgcacaggtttcttgggccagtttcacgctgactcagccccatctgtgtcggagtctaccgggaaagacggttaccatctcctgcacccgcagcagtcggcagcacttaccgccggctagtgtgcaggtcggtaccagcagccggcccggcctcctcccccaccaccgtcacgtccgtagaacgaccaacgtaaacggcccttcgttcgggttcctgtatccggttctcgtgctcactcgactacctcctcctaactctcgtccctacctaacctctctcgtacgtactagaacgtacgtggaacggacgacggtactcgtactacttacgtgtcgttagtttcgtttggaacggtacgtaacgtacgttcggttaggttcgggggttcgggttaccgggggtacgggggtacccgtaaggtcccgttaaccgggtaacccgtttaccggtaaaccggttccggaacccggtacccggtaaacgggtcccgttaccccggtaccccccgtttcgggtacctacccggtttccgttccccggtttacccccttacccccgg

SEQ ID NO: 55441 - DNA, 254 bp, Homo sapiens
  misc_feature: GYAE6OF01D8BBW.35.78.H01.1.454.CMB.1.raw
  modified_base (250)..(254): a, c, t, g, unknown or other
  misc_feature (250)..(254): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcgggcggagggaccaagctgaccgtcctaggtcagcccaagactcgccccctggtcactctcgttccccaccctcctcacgactctgtactggaggcggctggcaaggcgcatgnnnnn

SEQ ID NO: 55442 - DNA, 723 bp, Homo sapiens
  misc_feature: GYAE6OF01AEWF6.35.78.H01.1.454.CMB.1.raw
  modified_base (131)..(131): a, c, t, g, unknown or other
  misc_feature (131)..(131): n is a, c, g, or t
  modified_base (180)..(180): a, c, t, g, unknown or other
  misc_feature (180)..(180): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (284)..(284): a, c, t, g, unknown or other
  misc_feature (284)..(284): n is a, c, g, or t
  modified_base (614)..(614): a, c, t, g, unknown or other
  misc_feature (614)..(614): n is a, c, g, or t
tcagtacagatcgtcacgaccggtgctcgatttagtgtgagtagtttggggtttgggggggatcagtcctggtggtagctcaggaagcagagcctggagcatctccactatggcctggctccactacttcnccaccctctcgctcactgcacgaggttcttcgggacctaaggttttacngctgactcacgcccatctgtggtcggagtcggtacggggaagacggtnaacctatctcncgccaccgcagcaggcgcagactataaccgagtacaactagtcgngtacaggttacggaaccaagacggacccgggccgggtactaacccgttaccccaaattaccgtcgttacgaacttaacgttaaacggtaaaaggtcggtaaaactaaccggtaaaacgccccgtttagggacccgggttacctggtacgtccgttacgtcgtcggtacacgtacgtacctacgtcctaccctaaccgtaacctcgttacccgacccttaccacgtagtaccgttaccgtaggtaacggtaaccgtacgaacgggttaacgagggacggaaccggtaaggttcgttaactaacgtttattagtacggttactaacgttttnaggttaactaggttaaccgctaaaccgttcgttacggtacggttcgggtaccggggttcggggaccggtacgtagtcccggtactacggtaagtcaacgtaccggaccg

SEQ ID NO: 55443 - DNA, 275 bp, Homo sapiens
  misc_feature: GYAE6OF01EQQPL.35.78.H01.1.454.CMB.1.raw
  modified_base (255)..(275): a, c, t, g, unknown or other
  misc_feature (255)..(275): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagacctcgccccctcggtcactctcgttccccaccctcctcacgattctgtactgaggcgggcgtggacaaggcgacatagnnnnnnnnnnnnnnnnnnnnn

SEQ ID NO: 55444 - DNA, 886 bp, Homo sapiens
  misc_feature: GYAE6OF01D1FQH.35.78.H01.1.454.CMB.1.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
tcagtacagatcgtcacgaccggtgctcgatttagtgtgagtagtttgggtttggggggtggtagctcaggaagcagagcctggagcatctccactatggcctgggctccactacttctccaccctcctcgctcactgcactaggttcttgggcctagttttatgctgactcacgcccatctgtgtcggagtcgtccggggaagacggtnaaccntcctccgtgaccacccgnacgcaggtggcagctaacttaaccgagactaaacgttacgtggtcgtagtaggttaccgtaaccgaaaccgacggacccgggtcccccgggtacctaccccggttacccccccgaaccctaacccggtacctaaccggttacccggtaacggaaaaccggtaaccgtaaaccggtaaaacccggtccccgtttacgggtttaccgggggtttacctacggttaacggtttcccggtttaccgtaccggttacggtacccttaccgtacgtaaccccgtaacgtacccccggttaccctacccgttaaacgttcccgttacccgtccccttacccttacctaacctttaccgttaccgttaccggtacgtaaccgtaacaaaccgggttaaccggtacgggaaaccgggtacggtacggtactaacgttaacgtttacgtttactacggttacgttaacgttacttacggtaacgtaacgttcgggttaaacgtaccgtttaaagttcgggttacgggttaccggtttaacgggttacccggggacggtaaccgggaaacctacgggtccgttaccggttacccggttaacggtccggtaacgtaacccggtaaccgtacgtaacccgtcccggtaccccggtacgttaccccg

SEQ ID NO: 55445 - DNA, 715 bp, Homo sapiens
  misc_feature: GYAE6OF01DBYAN.35.78.H01.1.454.CMB.1.raw
  modified_base (161)..(161): a, c, t, g, unknown or other
  misc_feature (161)..(161): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (539)..(539): a, c, t, g, unknown or other
  misc_feature (539)..(539): n is a, c, g, or t
tcagtacagatcgtcacgaccggtgctcgatttagtgtgagtagtttgggttgggggtggtagctcaggaagcagagcctggagcatctccactatggcctgggctccactacttctcaccctcctcgctcactgcacgaggttcttgggcctagttttangctgactcacgccccatctgtgtacggacgtcgccggggaagcggtcgaccagtcctccgtgccaccgnagtcaggtcggcagctaataccngtactaactgtgcgacgacggttacggaaaccacgcggcccggacccggtactacccgttaaccccaagttacctcaggtaactacgtaaagtaaggtctaactaaccgaacgtcccgttggtacgggtcctaggtacgttccggttcgttacgtacgggtaccacgtaccgtacgtcctccttacccaacccgtacgttccgtccgttccctaccgtataaccttcgtctacgtacgtactacgtacgacgtaggacggactgggactacgtacttaacgtcgtntccgtaagtttctaaggtcgtagttaacggtacgtaacggttaagtcggttcgggttcggtccggttaacggggacgggtaaccggtaaccgttaacgggtccgttaaccgggtaccccggttagttccggaaacctacccggtaccgaacggttccccggtcccgttacccccgg

SEQ ID NO: 55446 - DNA, 254 bp, Homo sapiens
  misc_feature: GYAE6OF01BEHP1.35.78.H01.1.454.CMB.1.raw
  modified_base (240)..(240): a, c, t, g, unknown or other
  misc_feature (240)..(240): n is a, c, g, or t
  modified_base (246)..(254): a, c, t, g, unknown or other
  misc_feature (246)..(254): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttccccgccctcctcacgatctgtactgagcgggctggcaaggcncatagnnnnnnnnn

SEQ ID NO: 55447 - DNA, 278 bp, Homo sapiens
  misc_feature: GYAE6OF01CNXK1.35.78.H01.1.454.CMB.1.raw
  modified_base (202)..(202): a, c, t, g, unknown or other
  misc_feature (202)..(202): n is a, c, g, or t
  modified_base (245)..(246): a, c, t, g, unknown or other
  misc_feature (245)..(246): n is a, c, g, or t
  modified_base (248)..(278): a, c, t, g, unknown or other
  misc_feature (248)..(278): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctggcactcctgttcccnccctctcacgatctgactgagcgggctggcaaggcgcaatagnncnnnnnnnnnnnnnnnnnnnnnnnnnnnnnnn

SEQ ID NO: 55448 - DNA, 257 bp, Homo sapiens
  misc_feature: GYAE6OF01A1UAR.35.78.H01.1.454.CMB.1.raw
  modified_base (247)..(257): a, c, t, g, unknown or other
  misc_feature (247)..(257): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaaggctgccccctcggtcactctcgttcccgccctcctcacgatctgtactgagcgggctggcaaggcgcatagnnnnnnnnnnn

SEQ ID NO: 55449 - DNA, 674 bp, Homo sapiens
  misc_feature: GYAE6OF01CD0Y4.35.78.H01.1.454.CMB.1.raw
  modified_base (174)..(174): a, c, t, g, unknown or other
  misc_feature (174)..(174): n is a, c, g, or t
  modified_base (381)..(381): a, c, t, g, unknown or other
  misc_feature (381)..(381): n is a, c, g, or t
  modified_base (663)..(663): a, c, t, g, unknown or other
  misc_feature (663)..(663): n is a, c, g, or t
tcagtacagatcgtcacgaccggtgctcgatttagtgtgagtagtttgggtttgggggggatcagtcctggtggtagctcaggaagcagagcctggagcatctccactatggcctgggctccactacttctcaccctcctcgctcactgcacaggttcttgggcctagttttangctgactcacgcccctatctgtgtcggagtccgtaccgggggaagtacggtcgacctatcctccgtcgccaccccgcagcaggtcggacacgacctacttaaccgagacctaaactagtggtcgacgtaggtacggtaacccaaacgccggccggaccccgggctaacccgttaccccagtacctcgatacttacgtaagtaaggtnaactaacgaaccgtcctcgggtcggtcctagtacgttcgttcgtcggtcggtaccctagtacgacgtcgtcccttacctacccttaacctccgttacccgtccccttacccgtactaccttacgtcctacgtacgtacgtacgaacggtacgtacggacggtacggcgtacgtaacgttacttacgttacgtacgttacgtacgttcgttagtacggtagtacggtacagtagtgtcggtcgtcggtcggtacggacgtaccgaacgtctacggtacgtacncggtacaccgg

SEQ ID NO: 55450 - DNA, 300 bp, Homo sapiens
  misc_feature: GYAE6OF01A40BP.35.78.H01.1.454.CMB.1.raw
  modified_base (283)..(283): a, c, t, g, unknown or other
  misc_feature (283)..(283): n is a, c, g, or t
  modified_base (290)..(300): a, c, t, g, unknown or other
  misc_feature (290)..(300): n is a, c, g, or t
tcagtacagatcgtcacgaccggtgctcgatttagtgtgagtagtttgggtttgggggtgttgtggtctccactcccgccttgacgggctgctatctgcctccctcactatctctggactcaagactgaggacgaggctgactattactgtcagtcttatgatggtagcaagtatgtggtcttcggcggagggaccaagctgaccgtctaggtcagcccaagactgccccctggtcactctgttcccaccctctcacgatctgtactgagcggctggcaaggngcatagnnnnnnnnnnn

SEQ ID NO: 55451 - DNA, 259 bp, Homo sapiens
  misc_feature: GYAE6OF01DAOTB.35.78.H01.1.454.CMB.1.raw
  modified_base (240)..(240): a, c, t, g, unknown or other
  misc_feature (240)..(240): n is a, c, g, or t
  modified_base (246)..(259): a, c, t, g, unknown or other
  misc_feature (246)..(259): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactcgccccctggtcactctcgttcccaccctcctcacgatctgtactgagcggctggacaggcncatagnnnnnnnnnnnnnn

SEQ ID NO: 55452 - DNA, 249 bp, Homo sapiens
  misc_feature: GYAE6OF01B1XUI.35.78.H01.1.454.CMB.1.raw
  modified_base (210)..(210): a, c, t, g, unknown or other
  misc_feature (210)..(210): n is a, c, g, or t
  modified_base (246)..(249): a, c, t, g, unknown or other
  misc_feature (246)..(249): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttccccaccctcctnacgatctgtactgagcgggctggcaaggcgcatagnnnn

SEQ ID NO: 55453 - DNA, 251 bp, Homo sapiens
  misc_feature: GYAE6OF01ECK5A.35.78.H01.1.454.CMB.1.raw
  modified_base (246)..(251): a, c, t, g, unknown or other
  misc_feature (246)..(251): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttccccaccctcctcacgatctgtactgagcgggctggcaaggcgcatagnnnnnn

SEQ ID NO: 55454 - DNA, 686 bp, Homo sapiens
  misc_feature: GYAE6OF01CAY1J.35.78.H01.1.454.CMB.1.raw
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
tcagtacagatcgtcacgaccggtgctcgatttagtgtgagtagtttgggtttgggggggatcagtcctggtggtagctcaggaagcagagcctggagcatctccactatggcctgggctccactacttctcaccctcctcgctcactgcactaggttcttgggcctagttttatgctgactcacgccccactctgtcgtcggagtcgtccggggaagcggtcgacctatcctcctgccacccgcagcaggtggcagcacttaccagaccaactangtncgtagtcgtaaccacgacggcccggcccggacctaccgttccccaaatcctacgtcgtaactcgtaaagtaaggtgaactaaccaaaaccggtcccgttacggtccggtcctagttacgttccggttctcgttccgggtacctacgtcgacaccgtcccgtaccctaccaacttccgtccgtcccttaccctacctacttaccgtcctacgtcgtaacctacgtaacgtacgtacggaacggccgtacgtcgttacctaacgttaacgttactcgttactacgttacttacgtaggtacgttacggagtaagttacgtagttcgggtccggttacggacggggtaacggtacggtaacggcgttaccggtccgggttaacccgtaccgtggtaacccgtaccccggg

SEQ ID NO: 55455 - DNA, 270 bp, Homo sapiens
  misc_feature: GYAE6OF01AMPMC.35.78.H01.1.454.CMB.1.raw
  modified_base (204)..(204): a, c, t, g, unknown or other
  misc_feature (204)..(204): n is a, c, g, or t
  modified_base (251)..(270): a, c, t, g, unknown or other
  misc_feature (251)..(270): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatggtggtcttcggcggagggaccaagctgaccgtcctaggtcagcccaagactcgcccctggtcactctcgttcccnccctctcacgtatctcgtactgaggcgggctggcaaggcgactatgnnnnnnnnnnnnnnnnnnnn

SEQ ID NO: 55456 - DNA, 341 bp, Homo sapiens
  misc_feature: GYAE6OF01BQ2PO.35.78.H01.1.454.CMB.1.raw
  modified_base (120)..(120): a, c, t, g, unknown or other
  misc_feature (120)..(120): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (303)..(341): a, c, t, g, unknown or other
  misc_feature (303)..(341): n is a, c, g, or t
tcagtacagatcgtcacgaccggtgctcgatttagtgtgagtagtttgggtttggggggtgtggtggtctccactccgcttgacgaggctgactattactgtcagtcttatgagtggtanacaagtagtgtggtcttcggggacggacgggaccaagcgtacggacccgttcgtaggtcacgacccaaagtcctcccggtcccccgtggtacctcgttccttcccgttacccccacccttcctacgtaaccggtnttcccgtagttaccgngcgggtcggtcgtacggacgagcgactagagnnnnnnnnnnnnnnnnnnnnnnnnnnnnnnnnnnnnnnn

SEQ ID NO: 55457 - DNA, 317 bp, Homo sapiens
  misc_feature: GYAE6OF01CPD5D.35.78.H01.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (265)..(266): a, c, t, g, unknown or other
  misc_feature (265)..(266): n is a, c, g, or t
  modified_base (269)..(317): a, c, t, g, unknown or other
  misc_feature (269)..(317): n is a, c, g, or t
tcagtacagatcgtcacgaccggtgctcgatttagtgtgagtagtttgggtttgggggggtgtggtggtctccactcccgccttgacgaggctgactattactgtcagtcttatgatggtagcaagtatggtggtcttcgggcggagggaccaagctgaccgtcctaggtcacgacccaagcctccgcccctggtctacttctccgtccccaccctcctcacgatctgtacgtggngccggggntcggacgaaggcactaagtgnncannnnnnnnnnnnnnnnnnnnnnnnnnnnnnnnnnnnnnnnnnnnnnnnn

SEQ ID NO: 55458 - DNA, 292 bp, Homo sapiens
  misc_feature: GYAE6OF01CK80A.35.78.H01.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (254)..(254): a, c, t, g, unknown or other
  misc_feature (254)..(254): n is a, c, g, or t
  modified_base (259)..(292): a, c, t, g, unknown or other
  misc_feature (259)..(292): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatggtggtcttcgggcggagggaccaagtctgacccgtctaggtcacgcccaaagcctcgccccctgtacnctctcgtcccncccttccnacgntctaagtctgacggcggtatggaccgaaggctanagagnnnnnnnnnnnnnnnnnnnnnnnnnnnnnnnnnn

SEQ ID NO: 55459 - DNA, 262 bp, Homo sapiens
  misc_feature: GYAE6OF01CF5BY.35.78.H01.1.454.CMB.1.raw
  modified_base (239)..(239): a, c, t, g, unknown or other
  misc_feature (239)..(239): n is a, c, g, or t
  modified_base (243)..(262): a, c, t, g, unknown or other
  misc_feature (243)..(262): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgcggtcttcggcggagggaccaaggctgaccgtcctaggtcagcccaagactgccccctggtcactctcgttcccgccctctcacgatctgtactgagcggctggcaggcnatgnnnnnnnnnnnnnnnnnnnn

SEQ ID NO: 55460 - DNA, 271 bp, Homo sapiens
  misc_feature: GYAE6OF01DUK4A.35.78.H01.1.454.CMB.1.raw
  modified_base (249)..(271): a, c, t, g, unknown or other
  misc_feature (249)..(271): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaaggctcgcccctggtcactctcgttcccgccctccgtacacgatctgtactgagtcggctggcaaggcgcagtagnnnnnnnnnnnnnnnnnnnnnnn

SEQ ID NO: 55461 - DNA, 801 bp, Homo sapiens
  misc_feature: GYAE6OF01DD90O.35.78.H01.1.454.CMB.1.raw
  modified_base (176)..(176): a, c, t, g, unknown or other
  misc_feature (176)..(176): n is a, c, g, or t
tcagtacagatcgtcacgaccggtgctcgatttagtgtgagtagtttgggtttgggggggatcagtcctggtggtagctcaggaagcagagcctggagcatctccactatcggcctgggctccactacttctcaccctcctcgctcactgcacgtaggttctgggcctagttttangctcgactcgaccgcccctacgttcgtgtcggtacggagttccggtaccggggaagtcgggtacgacctacttccgtccgtacgacccgacccgacgacgcgtaagggtcggacacgactaacctaccgaactacctaacgttcgtacgtacgtacgtaacggtaaccggtaaccgaccggccggtcccgggaccccggtaccttacccgttaccctacgttacgttagtttacgttacgttttacgtttaacggtaacgtaacgtaacggtaaccggtaacccggttccgttccggggtttccggtttccgtttcggtttccgttcgttcgtccgtcctacgtaccgtacgttaccgttaccgtttaccttaccttacgttcccgtcccgtaccctcctactacctcgtcgtacgtacgtacgtaggtacgtacggtacgggaacgtacggtacgttacttacgttacgtttaagtttacgttacgttacgttacgttattacgtacgtaacgttacctaaccgtacgttccgtaccggttcggttacgggtaccggggtacggggtacgggtaccgtacggtacccgtaccgtaccgttacgacgtacgaccggtacggtccg

SEQ ID NO: 55462 - DNA, 276 bp, Homo sapiens
  misc_feature: GYAE6OF01CHSCW.35.78.H01.1.454.CMB.1.raw
  modified_base (128)..(128): a, c, t, g, unknown or other
  misc_feature (128)..(128): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (253)..(276): a, c, t, g, unknown or other
  misc_feature (253)..(276): n is a, c, g, or t
tcagtacagatcgtcacgaccggtgctcgatttagtgtgagtagtttgggtttgggggggtgtggtggtctccactcccgcttggacgaggctgactattactgtcagtcttatgatggtagcaagtntgtggtcttggcggagggaccaagctgaccgtcctagcagcccaagactcgcccctgtcactctcgttcccgccctctcacgattctgtactggacggcggngtggacaacggccanactagnannnnnnnnnnnnnnnnnnnnnnnn

SEQ ID NO: 55463 - DNA, 675 bp, Homo sapiens
  misc_feature: GYAE6OF01EV89D.35.78.H01.1.454.CMB.1.raw
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (529)..(529): a, c, t, g, unknown or other
  misc_feature (529)..(529): n is a, c, g, or t
tcagtacagatcgtcacgaccggtgctcgatttagtgtgagtagtttgggtttgggggggtgtggtggtctccactcccgccttggacggggctgctatctgcctcctcactatctctggactcaagactgaggacgaggctgacttattactgtcagttcttatgattggagacaagttatggttggtccttcggggacgggacgggaaccaaggtcctcgggaacccgttcgtacgggtcaacggaccccaaagtccttccggccccccgttgggtacctaaccgtttccgttacccgtttaccccctaaccccgtttcccgtacctaaccggtaactttccgttacgttaaccggtagggttaaccgggccgggggttaccgttacgggaaccggaaaccggggttcggaccgtaattaggactnatcgcncngncacgcgacgtactcncgnctcgctcgtnangtagacncacgacgagtacgacgtacnctacacncgtntanacgtacgagtcgtcgtacangacgagacgacgactagagtacgtacggacagacgtacgacgtaacgtaatacgtactacgacgtacgtacgtagtagtaccgttaacgtcgtaacgacgtaactacgtacgtacgtaacgtcggtaaccgtactacggtcgtcgg

SEQ ID NO: 55464 - DNA, 369 bp, Homo sapiens
  misc_feature: GYAE6OF01BF50I.35.78.H01.1.454.CMB.1.raw
  modified_base (305)..(305): a, c, t, g, unknown or other
  misc_feature (305)..(305): n is a, c, g, or t
  modified_base (308)..(369): a, c, t, g, unknown or other
  misc_feature (308)..(369): n is a, c, g, or t
tcagtacagatcgtcacgaccggtgctcgatttagtgtgagtagtttggggtttgggggggtgtggtggtctccactcccgccttgacgaggctgactattactgtcagtcttatgatggtagcaagtatgtggtctcgggcggaggaccaagtctggacccgtccgtaggtcacgaccctaacgctcccggcccccgtggtctacctccttcccgttacccccaccccttccaccgaacgtacttcctaggttaccgagggacggggccgggtcgtagggaccgaaacgggtccgacaaagtgntcnnnnnnnnnnnnnnnnnnnnnnnnnnnnnnnnnnnnnnnnnnnnnnnnnnnnnnnnnnnnnn

SEQ ID NO: 55465 - DNA, 246 bp, Homo sapiens
  misc_feature: GYAE6OF02JYWPX.35.78.H01.1.454.CMB.1.raw
  modified_base (243)..(246): a, c, t, g, unknown or other
  misc_feature (243)..(246): n is a, c, g, or t
tcagtacagatcgtcacgaccggtgctcgatttagtgtgagtagtttgggtttggggtgtggtggtctccactccgccttgacgaggctgactattactgtcagtcttatgatggtagcaagtatgtggtcttcggcggagggaccaagctgaccgtcctaggtcagcccaagactgcccctcggtcactctgttcccgccctcctcacgatctgtactgagcgggctggcaaggcgcatagnnnn

SEQ ID NO: 55466 - DNA, 245 bp, Homo sapiens
  misc_feature: GYAE6OF02GHXNU.35.78.H01.1.454.CMB.1.raw
  modified_base (244)..(245): a, c, t, g, unknown or other
  misc_feature (244)..(245): n is a, c, g, or t
tcagtacagatcgtcacgaccggtgctcgatttagtgtgagtagtttgggtttggggtgtggtggtctccactcccgccttgacgaggctgactattactgtcagtcttatgatggtagcaagtatgtggtcttcggtggagggaccaagctgaccgtcctaggtcagcccaagactgccccctcggtcactctgttcccgcctcctcacgatctgtactgagcgggctggcaaggcgcatagnn

SEQ ID NO: 55467 - DNA, 243 bp, Homo sapiens
  misc_feature: GYAE6OF02GMZ3Q.35.78.H01.1.454.CMB.1.raw
  modified_base (240)..(243): a, c, t, g, unknown or other
  misc_feature (240)..(243): n is a, c, g, or t
tcagtacagatcgtcacgaccggtgctcgatttagtgtgagtagttgggttgggtgtggtggtctccactcccgccttgacgaggctgattattattgttgctcatatgcaggtagtagcactaatgtcttcggaactgggaccaaggtcaccgtcctaggtcagcccaaggccaacccactgtcactctgttcccacctcctcacgatctgtactgagcgggctggcaaggcgcatagnnnn

SEQ ID NO: 55468 - DNA, 245 bp, Homo sapiens; identical to SEQ ID NO: 55345
  misc_feature: GYAE6OF02HRLUS.35.78.H01.1.454.CMB.1.raw
  modified_base (244)..(245): a, c, t, g, unknown or other
  misc_feature (244)..(245): n is a, c, g, or t

SEQ ID NO: 55469 - DNA, 248 bp, Homo sapiens; identical to SEQ ID NO: 55369
  misc_feature: GYAE6OF02F5PLY.35.78.H01.1.454.CMB.1.raw
  modified_base (246)..(248): a, c, t, g, unknown or other
  misc_feature (246)..(248): n is a, c, g, or t

SEQ ID NO: 55470 - DNA, 250 bp, Homo sapiens
  misc_feature: GYAE6OF02IPPZT.35.78.H01.1.454.CMB.1.raw
  modified_base (243)..(250): a, c, t, g, unknown or other
  misc_feature (243)..(250): n is a, c, g, or t
tcagtacagatcgtcacgaccggtgctcgatttagtgtgagtagtttgggttgggggtgtggtggtctccactcccgccttgacgaggctgactattactgtcagtcttatgatggtagcaagtatgtggtcttcggcggagggaccaagctgaccgtcctaggtcagcccaagactgcccctcggtcactctgttcccacctcctcacgatctgtactgagcgggctggcaaggcgcatagnnnnnnnn

SEQ ID NO: 55471 - DNA, 250 bp, Homo sapiens
  misc_feature: GYAE6OF02FNOC9.35.78.H01.1.454.CMB.1.raw
  modified_base (245)..(250): a, c, t, g, unknown or other
  misc_feature (245)..(250): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcgcatagnnnnnn

SEQ ID NO: 55472 - DNA, 247 bp, Homo sapiens
  misc_feature: GYAE6OF02H8H0V.35.78.H01.1.454.CMB.1.raw
  modified_base (244)..(247): a, c, t, g, unknown or other
  misc_feature (244)..(247): n is a, c, g, or t
tcagtacagatcgtcacgaccggtgctcgatttagtgtgagtagtttgggtttggggtgtggtggtctccactcccgccttgacgaggctgactattactgtcagtcttatgatggtagcaagtatgtggtcttcggcggagggaccaagctgaccgtcctaggtcagcccaagactgcccctcggtcactctgttcccaccctcctcacgatctgtactgagcgggctggcaaggcgcatagnnnn

SEQ ID NO: 55473 - DNA, 246 bp, Homo sapiens
  misc_feature: GYAE6OF02GUM59.35.78.H01.1.454.CMB.1.raw
  modified_base (245)..(246): a, c, t, g, unknown or other
  misc_feature (245)..(246): n is a, c, g, or t
tcagtacagatcgtcacgaccggtgctcgatttagtgtgagtagtttgggtttggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccaccctcctcacgatctgtactgagcgggctggcaaggcgcatagnn

SEQ ID NO: 55474 - DNA, 297 bp, Homo sapiens
  misc_feature: GYAE6OF02JDZFD.35.78.H01.1.454.CMB.1.raw
  modified_base (293)..(297): a, c, t, g, unknown or other
  misc_feature (293)..(297): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactgccccctggtcactctgttcccgcctcctcacgatctgtactgagcgggctggcaaggcgcatagnnnnn

SEQ ID NO: 55475 - DNA, 248 bp, Homo sapiens; identical to SEQ ID NO: 55369
  misc_feature: GYAE6OF02HJT2J.35.78.H01.1.454.CMB.1.raw
  modified_base (246)..(248): a, c, t, g, unknown or other
  misc_feature (246)..(248): n is a, c, g, or t

SEQ ID NO: 55476 - DNA, 248 bp, Homo sapiens
  misc_feature: GYAE6OF02J1TMK.35.78.H01.1.454.CMB.1.raw
  modified_base (240)..(248): a, c, t, g, unknown or other
  misc_feature (240)..(248): n is a, c, g, or t
tcagtacagatcgtcacgaccggtgctcgatttagtgtgagtagtttggtttgggggtggtggtggtcgtccgactccgccttgacgaggctgactattactgtcagtcttatgatggtagcaagtatgtggtcttcggcgagggaccaagctgaccgtcctaggtcagcccaagactgcccctcggtcactctgttcccgcctcctcacgatctgtctgagcggctgcaggcgcatagnnnnnnnnn

SEQ ID NO: 55477 - DNA, 247 bp, Homo sapiens; identical to SEQ ID NO: 55366
  misc_feature: GYAE6OF02ID270.35.78.H01.1.454.CMB.1.raw
  modified_base (246)..(247): a, c, t, g, unknown or other
  misc_feature (246)..(247): n is a, c, g, or t

SEQ ID NO: 55478 - DNA, 297 bp, Homo sapiens
  misc_feature: GYAE6OF02HJEDB.35.78.H01.1.454.CMB.1.raw
  modified_base (294)..(297): a, c, t, g, unknown or other
  misc_feature (294)..(297): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnnnn

SEQ ID NO: 55479 - DNA, 247 bp, Homo sapiens; identical to SEQ ID NO: 55362
  misc_feature: GYAE6OF02GJLIV.35.78.H01.1.454.CMB.1.raw
  modified_base (246)..(247): a, c, t, g, unknown or other
  misc_feature (246)..(247): n is a, c, g, or t

SEQ ID NO: 55480 - DNA, 245 bp, Homo sapiens
  misc_feature: GYAE6OF02G3M72.35.78.H01.1.454.CMB.1.raw
  modified_base (244)..(245): a, c, t, g, unknown or other
  misc_feature (244)..(245): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctctcacgatctgtactgagcgggctggcaaggcgcatagnn

SEQ ID NO: 55481 - DNA, 248 bp, Homo sapiens; identical to SEQ ID NO: 55399
  misc_feature: GYAE6OF02ID5NK.35.78.H01.1.454.CMB.1.raw
  modified_base (246)..(248): a, c, t, g, unknown or other
  misc_feature (246)..(248): n is a, c, g, or t

SEQ ID NO: 55482 - DNA, 248 bp, Homo sapiens; identical to SEQ ID NO: 55399
  misc_feature: GYAE6OF02JEEEK.35.78.H01.1.454.CMB.1.raw
  modified_base (246)..(248): a, c, t, g, unknown or other
  misc_feature (246)..(248): n is a, c, g, or t

SEQ ID NO: 55483 - DNA, 261 bp, Homo sapiens
  misc_feature: GYAE6OF02JCKQA.35.78.H01.1.454.CMB.1.raw
  modified_base (244)..(261): a, c, t, g, unknown or other
  misc_feature (244)..(261): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccacctcctcacgatctgtactgagcgggctggcaaggcgcatagnnnnnnnnnnnnnnnnnn

SEQ ID NO: 55484 - DNA, 249 bp, Homo sapiens; identical to SEQ ID NO: 55390
  misc_feature: GYAE6OF02I7U84.35.78.H01.1.454.CMB.1.raw
  modified_base (245)..(249): a, c, t, g, unknown or other
  misc_feature (245)..(249): n is a, c, g, or t

SEQ ID NO: 55485 - DNA, 378 bp, Homo sapiens
  misc_feature: GYAE6OF02IKK85.35.78.H01.1.454.CMB.1.raw
  modified_base (328)..(328): a, c, t, g, unknown or other
  misc_feature (328)..(328): n is a, c, g, or t
  modified_base (330)..(378): a, c, t, g, unknown or other
  misc_feature (330)..(378): n is a, c, g, or t
tcagtacagatcgtcacgaccggtgctcgattttagtgtgagtagtttgggttttgggggggttgggtggtggtctccactcccgccttgacgggctgctatcgtgcctccctcgacctatctctggaccttcggaagacctgaggacgaggctgacctagtttactgtcagtcttatgatcggtagcaagtactgtgtcttcggcggaggccagctgaccgtcctaggtcagcccaagactgccccctcggtctacttcgtcggttaccccgccctcctcacgattacctgtttaactgagccgggctggcaaaggcgacactaagncnnnnnnnnnnnnnnnnnnnnnnnnnnnnnnnnnnnnnnnnnnnnnnnnn

SEQ ID NO: 55486 - DNA, 249 bp, Homo sapiens
  misc_feature: GYAE6OF02GT98B.35.78.H01.1.454.CMB.1.raw
  modified_base (246)..(249): a, c, t, g, unknown or other
  misc_feature (246)..(249): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctcctcacgatctgtactgagcgggctggcaaggcgcatagnnnn

SEQ ID NO: 55487 - DNA, 250 bp, Homo sapiens
  misc_feature: GYAE6OF02IPWBO.35.78.H01.1.454.CMB.1.raw
  modified_base (245)..(250): a, c, t, g, unknown or other
  misc_feature (245)..(250): n is a, c, g, or t
tcagtacagatcgtcacgaccggtgctcgatttagtgtgagtagtttgggtttgggggtgtggtggtctccactcccgccttgacgaggctgactattattgttgctcatatgcaggtagtagcactaatgtcttcggaactgggaccaaggtcaccgtcctaggtcagcccaaggccaaccccactgtcactctgttcccgccctcctacgatctgtactgagcgggctggcaaggcgcatagnnnnnn

SEQ ID NO: 55488 - DNA, 264 bp, Homo sapiens
  misc_feature: GYAE6OF02FPCCA.35.78.H01.1.454.CMB.1.raw
  modified_base (245)..(264): a, c, t, g, unknown or other
  misc_feature (245)..(264): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnnnnnnnnnnnnnnnnnnnn

SEQ ID NO: 55489 - DNA, 254 bp, Homo sapiens
  misc_feature: GYAE6OF02GARPO.35.78.H01.1.454.CMB.1.raw
  modified_base (245)..(254): a, c, t, g, unknown or other
  misc_feature (245)..(254): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnnnnnnnnnn

SEQ ID NO: 55490 - DNA, 245 bp, Homo sapiens
  misc_feature: GYAE6OF02GXC61.35.78.H01.1.454.CMB.1.raw
  modified_base (244)..(245): a, c, t, g, unknown or other
  misc_feature (244)..(245): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgccctctcacgatctgtactgagcgggctggcaaggcgcatagnn

SEQ ID NO: 55491 - DNA, 266 bp, Homo sapiens
  misc_feature: GYAE6OF02GSC9Q.35.78.H01.1.454.CMB.1.raw
  modified_base (248)..(266): a, c, t, g, unknown or other
  misc_feature (248)..(266): n is a, c, g, or t
tcagtacagatcgtcacgaccggtgctcgatttagtgtgagtagtttgggtttgggggtgtggtggtctccactcccgccttgacgaggtctgactattactgtcagtcttatgatggtagcaagtatgtggtcttcggcggagggaccaagcttgaccgtcctaggtcagcccaagactgccccctcggtcactctgttcccaccctcctcacgatctgtactgagcgggctggcaaggcgcatagnnnnnnnnnnnnnnnnnnn

SEQ ID NO: 55492 - DNA, 282 bp, Homo sapiens
  misc_feature: GYAE6OF02GQFHJ.35.78.H01.1.454.CMB.1.raw
  modified_base (241)..(241): a, c, t, g, unknown or other
  misc_feature (241)..(241): n is a, c, g, or t
  modified_base (247)..(282): a, c, t, g, unknown or other
  misc_feature (247)..(282): n is a, c, g, or t
tcagtacagatcgtcacgaccggtgctcgatttagtgtgagtagtttgggtttgggggttggtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctctcacgatctgtactgagcgggctggcaaggcncatagnnnnnnnnnnnnnnnnnnnnnnnnnnnnnnnnnnnn

SEQ ID NO: 55493 - DNA, 245 bp, Homo sapiens
  misc_feature: GYAE6OF02GI3PJ.35.78.H01.1.454.CMB.1.raw
  modified_base (244)..(245): a, c, t, g, unknown or other
  misc_feature (244)..(245): n is a, c, g, or t
tcagtacagatcgtcacgaccggtgctcgatttagtgtgagtagtttgggtttggggtgtggtggtctccactcccgccttgacgaggctgactattactgtcagtcttatgatggtagcaagtatgtggtcttcggcggagggaccaagctgaccgtcctaggtcagcccaagactgcccctcggtcactctgttcccaccctcctcacgatctgtactgagcgggctggcaaggcgcatagnn

SEQ ID NO: 55494 - DNA, 249 bp, Homo sapiens; identical to SEQ ID NO: 55390
  misc_feature: GYAE6OF02GTDP9.35.78.H01.1.454.CMB.1.raw
  modified_base (245)..(249): a, c, t, g, unknown or other
  misc_feature (245)..(249): n is a, c, g, or t

SEQ ID NO: 55495 - DNA, 247 bp, Homo sapiens; identical to SEQ ID NO: 55362
  misc_feature: GYAE6OF02G84VV.35.78.H01.1.454.CMB.1.raw
  modified_base (246)..(247): a, c, t, g, unknown or other
  misc_feature (246)..(247): n is a, c, g, or t

SEQ ID NO: 55496 - DNA, 266 bp, Homo sapiens
  misc_feature: GYAE6OF02J0OAN.35.78.H01.1.454.CMB.1.raw
  modified_base (245)..(266): a, c, t, g, unknown or other
  misc_feature (245)..(266): n is a, c, g, or t
tcagtacagatcgtcacgaccggtgctcgatttagtgtgagtagtttgggtttgggggtggtggtggtctccactcccgccttgacgaggctgactattactgtcagtcttatgatggtagcaagtatgtggtcttcggccggagggaccaagctgaccgtcctaggtcagcccaagactgccccctggtcactctgttcccgcctctcacgatctgtactgagcgggctggcaaggcgcatagnnnnnnnnnnnnnnnnnnnnnn

SEQ ID NO: 55497 - DNA, 247 bp, Homo sapiens
  misc_feature: GYAE6OF02IIPQC.35.78.H01.1.454.CMB.1.raw
  modified_base (246)..(247): a, c, t, g, unknown or other
  misc_feature (246)..(247): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccacctcctcacgatctgtactgagcgggctggcaaggcgcatagnn

SEQ ID NO: 55498 - DNA, 247 bp, Homo sapiens
  misc_feature: GYAE6OF02HBX6I.35.78.H01.1.454.CMB.1.raw
  modified_base (245)..(247): a, c, t, g, unknown or other
  misc_feature (245)..(247): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagccaagactgccccctcggtcactctgttcccaccctcctcacgatctgtactgagcgggctggcaaggcgcatagnnn

SEQ ID NO: 55499 - DNA, 295 bp, Homo sapiens
  misc_feature: GYAE6OF02HYCJR.35.78.H01.1.454.CMB.1.raw
  modified_base (294)..(295): a, c, t, g, unknown or other
  misc_feature (294)..(295): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcgcatagnn

SEQ ID NO: 55500 - DNA, 250 bp, Homo sapiens; identical to SEQ ID NO: 55363
  misc_feature: GYAE6OF02I100Y.35.78.H01.1.454.CMB.1.raw
  modified_base (246)..(250): a, c, t, g, unknown or other
  misc_feature (246)..(250): n is a, c, g, or t

SEQ ID NO: 55501 - DNA, 245 bp, Homo sapiens
  misc_feature: GYAE6OF02IU8A4.35.78.H01.1.454.CMB.1.raw
  modified_base (240)..(245): a, c, t, g, unknown or other
  misc_feature (240)..(245): n is a, c, g, or t
tcagtacagatcgtcacgaccggtgctcgatttagtgtgagtagttggtttggggtgtggtggtctccactccgccttgacgaggctgactattactgtcagtcttatgatggtagcaagtatgtggtcttcggcggagggaccaagctgaccgtcctaggtcagcccaagactgcccctcggtcactctgttcccgcctcctcacgatctgtactgagcggctggcaaaggcgcatagnnnnnn

SEQ ID NO: 55502 - DNA, 248 bp, Homo sapiens
  misc_feature: GYAE6OF02HCMSX.35.78.H01.1.454.CMB.1.raw
  modified_base (238)..(238): a, c, t, g, unknown or other
  misc_feature (238)..(238): n is a, c, g, or t
  modified_base (244)..(248): a, c, t, g, unknown or other
  misc_feature (244)..(248): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccacctcctcacgatctgtactgagcgggctggcaaggcncatagnnnnn

SEQ ID NO: 55503 - DNA, 247 bp, Homo sapiens
  misc_feature: GYAE6OF02IWIPZ.35.78.H01.1.454.CMB.1.raw
  modified_base (245)..(247): a, c, t, g, unknown or other
  misc_feature (245)..(247): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgcctcctcacgatctgtactgagcgggctggcaaggcgcatagnnn

SEQ ID NO: 55504 - DNA, 170 bp, Homo sapiens
  misc_feature: GYAE6OF02FPAYP.35.78.H01.1.454.CMB.1.raw
  modified_base (167)..(170): a, c, t, g, unknown or other
  misc_feature (167)..(170): n is a, c, g, or t
tcagtacagatcgtcacgaccggtgctcgatttagtgtgagtagtttgggtttgggggtgtggtggtctccactcccgccttgacggggctgctatctgcctccctcggtcactctgttcccaccctcctcacgatctgtactgagcgggctggcaaggcgcatagnnnn

SEQ ID NO: 55505 - DNA, 249 bp, Homo sapiens; identical to SEQ ID NO: 55359
  misc_feature: GYAE6OF02H6ETI.35.78.H01.1.454.CMB.1.raw
  modified_base (246)..(249): a, c, t, g, unknown or other
  misc_feature (246)..(249): n is a, c, g, or t

SEQ ID NO: 55506 - DNA, 300 bp, Homo sapiens
  misc_feature: GYAE6OF02JW83E.35.78.H01.1.454.CMB.1.raw
  modified_base (292)..(300): a, c, t, g, unknown or other
  misc_feature (292)..(300): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactgccccctggtcactctgttcccgcctcctcacgatctgtactgagcggctggcaaggcgcatagnnnnnnnnn

SEQ ID NO: 55507 - DNA, 247 bp, Homo sapiens; identical to SEQ ID NO: 55362
  misc_feature: GYAE6OF02FRIHT.35.78.H01.1.454.CMB.1.raw
  modified_base (246)..(247): a, c, t, g, unknown or other
  misc_feature (246)..(247): n is a, c, g, or t

SEQ ID NO: 55508 - DNA, 258 bp, Homo sapiens
  misc_feature: GYAE6OF02HDTBJ.35.78.H01.1.454.CMB.1.raw
  modified_base (244)..(258): a, c, t, g, unknown or other
  misc_feature (244)..(258): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgccctctcacgatctgtactgagcgggctggcaaggcgcatagnnnnnnnnnnnnnnn

SEQ ID NO: 55509 - DNA, 246 bp, Homo sapiens
  misc_feature: GYAE6OF02IY5X7.35.78.H01.1.454.CMB.1.raw
  modified_base (244)..(246): a, c, t, g, unknown or other
  misc_feature (244)..(246): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgcctcctcacgatctgtactgagcgggctggcaaggcgcatagnnn

SEQ ID NO: 55510 - DNA, 247 bp, Homo sapiens
  misc_feature: GYAE6OF02IZZL2.35.78.H01.1.454.CMB.1.raw
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactcgccccctggtcactctcgttcccgccctcctcacgatctgtactgagcgggctggcaaggcncatagn

SEQ ID NO: 55511 - DNA, 297 bp, Homo sapiens
  misc_feature: GYAE6OF02IX27H.35.78.H01.1.454.CMB.1.raw
  modified_base (294)..(297): a, c, t, g, unknown or other
  misc_feature (294)..(297): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcgcatagnnnn

SEQ ID NO: 55512 - DNA, 244 bp, Homo sapiens
  misc_feature: GYAE6OF02F3ZZF.35.78.H01.1.454.CMB.1.raw
  modified_base (242)..(244): a, c, t, g, unknown or other
  misc_feature (242)..(244): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctccgtcagcccaaggctgccccctggtcactctgttcccaccctcctcacgatctgtgagcgggctggcaaggcgcatagnnn

SEQ ID NO: 55513 - DNA, 521 bp, Homo sapiens
  misc_feature: GYAE6OF02G3SCP.35.78.H01.1.454.CMB.1.raw
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
tcagtacagatcgtcacgaccggtgctcgatttagtgtgagtagtttgggtttgggggtggtagctcaggaagcagagcctggagcatctccactatggcctgggctccactacttctcaccctcctcgctcactgcacaggttcttgggccagttttatgctgactcagccccactctgtgtcggagtctccggggaagacggtgaccatctcctgcacccgcagcagtggcagcattaccagcaactatgtgcagtggtaccaacagcgcccgggcagttcccccaatactctgatctataaaggtgatcaaagaccctcgtggggtccctgactcggttctcgtgggtcatcgacagctcctccaactctcgccctcctcactatctctggactcaagactgaggacgaggctgactattactntcagttcttatgattgganactaagtatggtgtcttgggcggagggaccaagctcgaccgttcgtacggtcacggccaagtacctcgtcccccg

SEQ ID NO: 55514 - DNA, 247 bp, Homo sapiens; identical to SEQ ID NO: 55366
  misc_feature: GYAE6OF02GHKOR.35.78.H01.1.454.CMB.1.raw
  modified_base (246)..(247): a, c, t, g, unknown or other
  misc_feature (246)..(247): n is a, c, g, or t

SEQ ID NO: 55515 - DNA, 249 bp, Homo sapiens
  misc_feature: GYAE6OF02JBL93.35.78.H01.1.454.CMB.1.raw
  modified_base (244)..(249): a, c, t, g, unknown or other
  misc_feature (244)..(249): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccacctcctcacgatctgtactgagcgggctggcaaggcgcatagnnnnnn

SEQ ID NO: 55516 - DNA, 247 bp, Homo sapiens
  misc_feature: GYAE6OF02F8C0M.35.78.H01.1.454.CMB.1.raw
  modified_base (245)..(247): a, c, t, g, unknown or other
  misc_feature (245)..(247): n is a, c, g, or t
tcagtacagatcgtcacgaccggtgctcgatttagtgtgagtagtttgggtttgggggtgtggtggtctccactcccgccttgacgaggctgattattactgtcagtcttatgatggtagcaagtatgtggtcttcggcggagggaccaagctgaccgtcctaggtcagcccaagactgccccctcggtcactctgttcccgcctcctcacgatctgtactgagcgggctggcaaggcgcatagnnn

SEQ ID NO: 55517 - DNA, 246 bp, Homo sapiens; identical to SEQ ID NO: 55346
  misc_feature: GYAE6OF02FKPNY.35.78.H01.1.454.CMB.1.raw
  modified_base (246)..(246): a, c, t, g, unknown or other
  misc_feature (246)..(246): n is a, c, g, or t

SEQ ID NO: 55518 - DNA, 247 bp, Homo sapiens; identical to SEQ ID NO: 55355
  misc_feature: GYAE6OF02G7EBV.35.78.H01.1.454.CMB.1.raw
  modified_base (245)..(247): a, c, t, g, unknown or other
  misc_feature (245)..(247): n is a, c, g, or t

SEQ ID NO: 55519 - DNA, 251 bp, Homo sapiens
  misc_feature: GYAE6OF02INDLV.35.78.H01.1.454.CMB.1.raw
  modified_base (245)..(251): a, c, t, g, unknown or other
  misc_feature (245)..(251): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctctcacgatctgtactgagcggctggcaaggcgcatagnnnnnnn

SEQ ID NO: 55520 - DNA, 247 bp, Homo sapiens; identical to SEQ ID NO: 55362
  misc_feature: GYAE6OF02FIVH3.35.78.H01.1.454.CMB.1.raw
  modified_base (246)..(247): a, c, t, g, unknown or other
  misc_feature (246)..(247): n is a, c, g, or t

SEQ ID NO: 55521 - DNA, 250 bp, Homo sapiens
  misc_feature: GYAE6OF02IWR0P.35.78.H01.1.454.CMB.1.raw
  modified_base (246)..(250): a, c, t, g, unknown or other
  misc_feature (246)..(250): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcgcatagnnnnn

SEQ ID NO: 55522 - DNA, 596 bp, Homo sapiens
  misc_feature: GYAE6OF02JADJB.35.78.H01.1.454.CMB.1.raw
  modified_base (236)..(236): a, c, t, g, unknown or other
  misc_feature (236)..(236): n is a, c, g, or t
tcagtacagatcgtcacgaccggtgctcgatttagtgtgagtagtttgggtttgggggggatcagtcctggtggtagctcaggaagcagagcctggagcatctccactatggcctgggctccactacttctcaccctcctcgctcactgcacaggttcttgggccagttttatgctgactcagccccatctgtgtcggagtctccggggaagacggtgaccatctcctgcacccgnagcagtggcagcataccagcaactatgtgcagtggtaccaacagccggcccgggcacgttcccccaatacctctgactctaagtaaaggtgaatacaaagaccctcgtcgggtccctgtactcggttctcgtggtccatcgacacgcctcctccactctcgccctcctctactactcctcgtcggacctacgaacgtacgtacggaaggaccggaggtctacgtaactttattaaccgttcgtactacggtttcttaagtggttaacgtggtagtacgtaagttgttggttcggttccggttcgggacgggacggaccgtacggtccgtaccggacccgttaccggtaggtccaacccgg

SEQ ID NO: 55523 - DNA, 512 bp, Homo sapiens
  misc_feature: GYAE6OF02HWU49.35.78.H01.1.454.CMB.1.raw
tcagtacagatcgtcacgaccggtgctcgatttagtgtgagtagtttgggtttgggggtggtagctcaggaagcagagcctggagcatctccactatggcctgggctccactacttctcaccctcctcgctcactgcacaggttcttgggccagttttatgctgactcagccccactctgtgtcggagtctccggggaagacggtgaccatctcctgcacccgcagcagtggcagcattaccagcaactatgtgcagtggtaccaacagcgcccgggcagttcccccaatactctgatctataaaggtgatcaaagaccctctggggtccctgatcggttctctgggtccatcgacagctcctccaactctgcctccctcactatctctggactcaagactgaggacgaggctgacttattactgtcagttcttatgatggtagacaagtatggttggtcttcgggcggagggcaagctgaccgtcgtaggtcagcccaagcctcgcccccg

SEQ ID NO: 55524 - DNA, 297 bp, Homo sapiens
  misc_feature: GYAE6OF02HPLCO.35.78.H01.1.454.CMB.1.raw
  modified_base (294)..(297): a, c, t, g, unknown or other
  misc_feature (294)..(297): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatgttagcaagtatgtggtcttcggcggagggaccaagctgaccgtcctaggtcagcccaagactgccccctggtcactctgttcccgccctcctcacgatctgtactgagcgggctggcaaggcgcatagnnnn

SEQ ID NO: 55525 - DNA, 246 bp, Homo sapiens
  misc_feature: GYAE6OF02G4FLW.35.78.H01.1.454.CMB.1.raw
  modified_base (245)..(246): a, c, t, g, unknown or other
  misc_feature (245)..(246): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttccgccctcctcacgatctgtactgagcgggctggcaaggcgcatagnn

SEQ ID NO: 55526 - DNA, 248 bp, Homo sapiens
  misc_feature: GYAE6OF02G0BEL.35.78.H01.1.454.CMB.1.raw
  modified_base (246)..(248): a, c, t, g, unknown or other
  misc_feature (246)..(248): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaaggccaaccccactgtcactctgttcccaccctcctcacgatctgtactgagcgggctggcaaggcgcatagnnn

SEQ ID NO: 55527 - DNA, 249 bp, Homo sapiens; identical to SEQ ID NO: 55394
  misc_feature: GYAE6OF02G2P9W.35.78.H01.1.454.CMB.1.raw
  modified_base (245)..(249): a, c, t, g, unknown or other
  misc_feature (245)..(249): n is a, c, g, or t

SEQ ID NO: 55528 - DNA, 521 bp, Homo sapiens
  misc_feature: GYAE6OF02F6PHJ.35.78.H01.1.454.CMB.1.raw
  modified_base (236)..(236): a, c, t, g, unknown or other
  misc_feature (236)..(236): n is a, c, g, or t
tcagtacagatcgtcacgaccggtgctcgatttagtgtgagtagtttgggtttgggggggatcagtcctggtggtagctcaggaagcagagcctggagcatctccactatggcctgggctccactacttctcaccctcctcgctcactgcacaggttcttgggccagttttatgctgactcagccccatctgtgtcggagtctccggggaagacggtgaccatctcctgcacccgnagcagtggcagcattaccagcaactatgtgcagtggtaccaacagcgcccgggcagttccccaatactctgatctataaaggtgatcaaagaccctcgtcgggtccctgatcggttctcgtggtccatcgacagctcctcaactctcgcctcctcactactctctggactcaagactgagacgagctagactatactgtcagttcttatgatggtatacgagttatggtcggttcgttcgggcggaggtaccgaagtcgtacggaccgtccgtacggtcaaccgg

SEQ ID NO: 55529 - DNA, 250 bp, Homo sapiens; identical to SEQ ID NO: 55363
  misc_feature: GYAE6OF02I720L.35.78.H01.1.454.CMB.1.raw
  modified_base (246)..(250): a, c, t, g, unknown or other
  misc_feature (246)..(250): n is a, c, g, or t

SEQ ID NO: 55530 - DNA, 529 bp, Homo sapiens
  misc_feature: GYAE6OF02IKWQN.35.78.H01.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagtacagatcgtcacgaccggtgctcgatttagtgtgagtagtttgggtttggggggtggtagctcaggaagcagagcctggagcatctccactatggcctgggctccactacttctcaccctcctcgctcactgcacaggttcttgggccagttttatgctgactcagccccactctgtgtcggagtctccggggaanacggtgaccatctcctgcacccgnagcagtggcagcattacagcaactatgtgcagtggtaccaacagcgcccgggcagttcccccaatactctgatctataaaggtgatcaaagacccctctggggtccctgatcggttctctgggtccatcgacagctcctccaactctcgcctccctcactatctctggactcaagactgaggacgaggctgacttattactgtcagttcttatgatggtagctaagtattgtgtcgttcgggcgggtagggacctaagcgtgacccgttccgtacggtcacgacccgaagccgtcgtccccccg

SEQ ID NO: 55531 - DNA, 245 bp, Homo sapiens
  misc_feature: GYAE6OF02ITJKT.35.78.H01.1.454.CMB.1.raw
  modified_base (238)..(238): a, c, t, g, unknown or other
  misc_feature (238)..(238): n is a, c, g, or t
  modified_base (244)..(245): a, c, t, g, unknown or other
  misc_feature (244)..(245): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccacctcctcacgatctgtactgagcgggctggcaaggcncatagnn

SEQ ID NO: 55532 - DNA, 246 bp, Homo sapiens; identical to SEQ ID NO: 55365
  misc_feature: GYAE6OF02GC9G2.35.78.H01.1.454.CMB.1.raw
  modified_base (245)..(246): a, c, t, g, unknown or other
  misc_feature (245)..(246): n is a, c, g, or t

SEQ ID NO: 55533 - DNA, 713 bp, Homo sapiens
  misc_feature: GYAE6OF02HEAJS.35.78.H01.1.454.CMB.1.raw
  modified_base (155)..(155): a, c, t, g, unknown or other
  misc_feature (155)..(155): n is a, c, g, or t
  modified_base (173)..(173): a, c, t, g, unknown or other
  misc_feature (173)..(173): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (268)..(268): a, c, t, g, unknown or other
  misc_feature (268)..(268): n is a, c, g, or t
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
  modified_base (428)..(428): a, c, t, g, unknown or other
  misc_feature (428)..(428): n is a, c, g, or t
  modified_base (459)..(459): a, c, t, g, unknown or other
  misc_feature (459)..(459): n is a, c, g, or t
tcagtacagatcgtcacgaccggtgctcgatttagtgtgagtagtttgggtttggggggtagtcgagtcctggtggtagctcaggaagcagagcctggagcatctccactatggcctgggctccactacttctcaccctcctcgctcactgcacngttctgggccagttttangctgactcacgccccactctgtgtcggagtctaccgggganacggtgaccatctccngccaccgcagctagcgcagtcattaccaagctaaactntgtgcaggtcggaaccaaacncggccgccccgggtcaccggttcccccaatactcctanactctaagtaaaaggtntaataccaaaaggtcccctacggtcgggttcccagtacggttcgttcccgtgttccggggtacctagtacgacacgtccctccnccgtaactctcgtccctccctctaccttacnccgttactcggactacgaagtaacgtacggaacggacgacggctaccgtaagttactttaacgttgtacccgttaagttaccttaaggttctaaacggttacttaccgtaaccgttacctaccccggtttaggttccgggtttaccgggttcccgggggttaacccgggggggaaacccgtaggggttccgtaacccggggttacccgtttaacccgggttaaccggttacccggttaaccgtaacccccgggg

SEQ ID NO: 55534 - DNA, 244 bp, Homo sapiens
  misc_feature: GYAE6OF02GF27I.35.78.H01.1.454.CMB.1.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcggctggcaaggcncatagn

SEQ ID NO: 55535 - DNA, 250 bp, Homo sapiens
  misc_feature: GYAE6OF02GSYLX.35.78.H01.1.454.CMB.1.raw
  modified_base (245)..(250): a, c, t, g, unknown or other
  misc_feature (245)..(250): n is a, c, g, or t
tcagtacagatcgtcacgaccggtgctcgatttagtgtgagtagtttgggtttgggggtgtggtggtctccactcccgccttgacgagactgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnnnnnn

SEQ ID NO: 55536 - DNA, 264 bp, Homo sapiens
  misc_feature: GYAE6OF02FGGT1.35.78.H01.1.454.CMB.1.raw
  modified_base (243)..(243): a, c, t, g, unknown or other
  misc_feature (243)..(243): n is a, c, g, or t
  modified_base (248)..(264): a, c, t, g, unknown or other
  misc_feature (248)..(264): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgttcctaggtcagcccaagactgccccctggtcactctgttccccgccctcctcacgatcgtgtactgagcgggctggcaaggcncatgnnnnnnnnnnnnnnnnn

SEQ ID NO: 55537 - DNA, 250 bp, Homo sapiens
  misc_feature: GYAE6OF02IJYLM.35.78.H01.1.454.CMB.1.raw
  modified_base (247)..(250): a, c, t, g, unknown or other
  misc_feature (247)..(250): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctcctcacgatctgtactgagcgggctggcaaggcgcatagnnnn

SEQ ID NO: 55538 - DNA, 533 bp, Homo sapiens
  misc_feature: GYAE6OF02IP8PF.35.78.H01.1.454.CMB.1.raw
  modified_base (173)..(173): a, c, t, g, unknown or other
  misc_feature (173)..(173): n is a, c, g, or t
  modified_base (213)..(213): a, c, t, g, unknown or other
  misc_feature (213)..(213): n is a, c, g, or t
  modified_base (417)..(417): a, c, t, g, unknown or other
  misc_feature (417)..(417): n is a, c, g, or t
tcagtacagatcgtcacgaccggtgctcgatttagtgtgagtagtttgggtttgggggggatcagtcctggtggtagctcaggaagcagagcctggagcatctccactatggcctgggctccactacttctcaccctcctcgctcactgcacaggttcttgggccagttttangctgactcagccccatctgtgtcggagtctccgggggaanacggtgaccatctcctgcacccgcagcagtggcagcattaccagcaactatgtgcagtggtaccaacagcgcccgggcacgttcccccaatactctgatctaataaaggtgatacaaacgccctctcgggtccctgactcggttctcgtcgggtccatcgacagctccctccaactctcgcctccctcactactctctgacctnaagactgagacgagctgactattactgtcagttcttagtgagttgagtactagttagtggtggttccgttcgggcggtacggacgagcgtaccggtaccgtccgtaggtctaccgg

SEQ ID NO: 55539 - DNA, 269 bp, Homo sapiens
  misc_feature: GYAE6OF02II818.35.78.H01.1.454.CMB.1.raw
  modified_base (241)..(241): a, c, t, g, unknown or other
  misc_feature (241)..(241): n is a, c, g, or t
  modified_base (247)..(256): a, c, t, g, unknown or other
  misc_feature (247)..(256): n is a, c, g, or t
  modified_base (258)..(269): a, c, t, g, unknown or other
  misc_feature (258)..(269): n is a, c, g, or t
tcagtacagatcgtcacgaccggtgctcgatttagtgtgagtagtttgggtttggggggtgtggtggtcgtccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcncatagnnnnnnnnnnannnnnnnnnnnn

SEQ ID NO: 55540 - DNA, 250 bp, Homo sapiens
  misc_feature: GYAE6OF02FWJB1.35.78.H01.1.454.CMB.1.raw
  modified_base (239)..(239): a, c, t, g, unknown or other
  misc_feature (239)..(239): n is a, c, g, or t
  modified_base (245)..(250): a, c, t, g, unknown or other
  misc_feature (245)..(250): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcncatagnnnnnn

SEQ ID NO: 55541 - DNA, 273 bp, Homo sapiens
  misc_feature: GYAE6OF02HERLR.35.78.H01.1.454.CMB.1.raw
  modified_base (253)..(273): a, c, t, g, unknown or other
  misc_feature (253)..(273): n is a, c, g, or t
tcagtacagatcgtcacgaccggtgctcgatttagtgtgagtagtttgggtttgggggggtgtggtggtctccactcccgccttgacgaggctgactattactgtcagtcttatgatggtagcaagtatgtggtcttcgggcggagggaccaagctgaccgtcctaggtcagcccaagactgccccctggtcactctgttcccgccctcctcaccgatctgtactggagcgggctgggacaagggcgcaatgnnnnnnnnnnnnnnnnnnnnn

SEQ ID NO: 55542 - DNA, 282 bp, Homo sapiens
  misc_feature: GYAE6OF02JGVGW.35.78.H01.1.454.CMB.1.raw
  modified_base (247)..(250): a, c, t, g, unknown or other
  misc_feature (247)..(250): n is a, c, g, or t
  modified_base (252)..(282): a, c, t, g, unknown or other
  misc_feature (252)..(282): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgcccccctggtcactctgttcccaccctcctcacgatctgtactgagcgggctggcaaggcgcatagnnnnannnnnnnnnnnnnnnnnnnnnnnnnnnnnnn

SEQ ID NO: 55543 - DNA, 302 bp, Homo sapiens
  misc_feature: GYAE6OF02IC5U7.35.78.H01.1.454.CMB.1.raw
  modified_base (296)..(302): a, c, t, g, unknown or other
  misc_feature (296)..(302): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagactcgccccctggtcactctcgttcccgccctctcacgatctgtactggagcgggctggcaaggcgcatagnnnnnnn

SEQ ID NO: 55544 - DNA, 253 bp, Homo sapiens
  misc_feature: GYAE6OF02FPFPD.35.78.H01.1.454.CMB.1.raw
  modified_base (246)..(253): a, c, t, g, unknown or other
  misc_feature (246)..(253): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctcctcacgatctgtactgagcgggctggcaaggcgcatagnnnnnnnn

SEQ ID NO: 55545 - DNA, 250 bp, Homo sapiens
  misc_feature: GYAE6OF02IIARC.35.78.H01.1.454.CMB.1.raw
  modified_base (240)..(240): a, c, t, g, unknown or other
  misc_feature (240)..(240): n is a, c, g, or t
  modified_base (246)..(250): a, c, t, g, unknown or other
  misc_feature (246)..(250): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccgccctcctcacgatctgtactgagcgggctggcaaggcncatagnnnnn

SEQ ID NO: 55546 - DNA, 709 bp, Homo sapiens
  misc_feature: GYAE6OF02JGW7O.35.78.H01.1.454.CMB.1.raw
  modified_base (164)..(164): a, c, t, g, unknown or other
  misc_feature (164)..(164): n is a, c, g, or t
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (285)..(285): a, c, t, g, unknown or other
  misc_feature (285)..(285): n is a, c, g, or t
  modified_base (423)..(423): a, c, t, g, unknown or other
  misc_feature (423)..(423): n is a, c, g, or t
  modified_base (448)..(448): a, c, t, g, unknown or other
  misc_feature (448)..(448): n is a, c, g, or t
tcagtacagatcgtcacgaccggtgctcgatttagtgtgagtagtttgggtttgggggtggtagctcaggaagcagagcctggagcagtctccactatggcctgggctccactacttctcaccctcctcgcctcacctgcacacggttcttgggccagttttangctgactcagccccatctgtgtcggagtctccggggaancgggtnaccatctcctgcacccgnagcagtcggcagtactattaccagctaactatggtcgcgtacggtcggtaaccaaacnggcccgaccccgggctacgttacccccaaatccgtctagactacctaataaagggtcactaacgtaaaacgtaccccgtgtacggggttacccctggtaacgttcggttacctcggtcgggttaccagttaccgaacncggtcccttacctacccaacttccnccgtcccttaccctctaactaacgtcctacgtacggtaacctacgtaacgtacgtacggaacgtacggtaacgtcgtacgacgttataccgtactacgtcgttaccttaagtcgtacgttacggttaacgcttaaacgttcgtacgggttcgtacccggtcgggtaacggaccgggttaaccaacggtccgttaaccggtaacccgtacggttacggttaccgtcggaaccccgtaaacggtcccgttacccgtcccccgg

SEQ ID NO: 55547 - DNA, 331 bp, Homo sapiens
  misc_feature: GYAE6OF02GDRRF.35.78.H01.1.454.CMB.1.raw
  modified_base (310)..(331): a, c, t, g, unknown or other
  misc_feature (310)..(331): n is a, c, g, or t
tcagtacagatcgtcacgaccggtgctcgatttagtgtgagtagtttgggtttgggggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcacgcccaagactccgccccctggtccactctcgttccccaccctcctcacgtactctgtacgtgaggccgggactggcaagggccgcatagnnnnnnnnnnnnnnnnnnnnnn

SEQ ID NO: 55548 - DNA, 346 bp, Homo sapiens
  misc_feature: GYAE6OF02F8K69.35.78.H01.1.454.CMB.1.raw
  modified_base (191)..(191): a, c, t, g, unknown or other
  misc_feature (191)..(191): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (312)..(346): a, c, t, g, unknown or other
  misc_feature (312)..(346): n is a, c, g, or t
tcagtacagatcgtcacgaccggtgctcgatttagtgtgagtagtttgggtttggggggtggtgggtggtctccactccgccttgacggggctgctatctgcctccctcactatctctggactcaagactgaggacgaggctgactattactgtcagtcttatgatggtagcaagtatgtggtcttcgggnggagggaccaagctgaccgtctaggtcagcccaagactcgccccctggcactctcgtcccncctcctnacgnttcctgtactgacggcggcttggcaagggtccgacactaggcagctgannnnnnnnnnnnnnnnnnnnnnnnnnnnnnnnnnn

SEQ ID NO: 55549 - DNA, 363 bp, Homo sapiens
  misc_feature: GYAE6OF02IBO80.35.78.H01.1.454.CMB.1.raw
  modified_base (196)..(196): a, c, t, g, unknown or other
  misc_feature (196)..(196): n is a, c, g, or t
  modified_base (320)..(324): a, c, t, g, unknown or other
  misc_feature (320)..(324): n is a, c, g, or t
  modified_base (327)..(363): a, c, t, g, unknown or other
  misc_feature (327)..(363): n is a, c, g, or t
tcagtacagatcgtcacgaccggtgctcgattttagtgtgagtagtttggggtttggggggtgtggtggtctcccactcccgccttgacggggctgcttatctgcctccctcactatctctggactcaagactgaggacgaggcttgactattactgttcagtcttatgtatggtagcaagtatgtggtcttcggnggagggaccaaggctgaccgtcctaggtcaggcccaagacctcgccccctggtccactctcgttccccgccctcctcacgacttcctagttacctggacgcggggctggcaaggcgacatacgnnnnnagnnnnnnnnnnnnnnnnnnnnnnnnnnnnnnnnnnnnn

SEQ ID NO: 55550 - DNA, 294 bp, Homo sapiens
  misc_feature: GYAE6OF02FLNC8.35.78.H01.1.454.CMB.1.raw
  modified_base (292)..(294): a, c, t, g, unknown or other
  misc_feature (292)..(294): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcggcggagggaccaagctgaccgtcctaggtcagcccaagctgccccctggtcactctgttcccacctcctcacgatctgtactgagcgggctggcaaggcgcatagnnn

SEQ ID NO: 55551 - DNA, 279 bp, Homo sapiens
  misc_feature: GYAE6OF02I7YFR.35.78.H01.1.454.CMB.1.raw
  modified_base (239)..(239): a, c, t, g, unknown or other
  misc_feature (239)..(239): n is a, c, g, or t
  modified_base (249)..(279): a, c, t, g, unknown or other
  misc_feature (249)..(279): n is a, c, g, or t
tcagtacagatcgtcacgaccggtgctcgatttagtgtgagtagtttgggtttgggggtgtggtggtctccactccgccttgacgaggctgactattactgtcagtcttatgatggtagcaagtatgtggtcttggcggagggaccaagctgaccgtcctaggtcagcccaagactgccccctggtcactctgttcccaccctcctcacgatctgtactgagcggctaggcaagggtcncaagtagcannnnnnnnnnnnnnnnnnnnnnnnnnnnnnn

SEQ ID NO: 55552 - DNA, 248 bp, Homo sapiens
  misc_feature: GYAE6OF02FKBDD.35.78.H01.1.454.CMB.1.raw
  modified_base (247)..(248): a, c, t, g, unknown or other
  misc_feature (247)..(248): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctcggtcactctgttcccgccctcctcacgatctgtactgagcgggctggcaaggcgcatagnn

SEQ ID NO: 55553 - DNA, 270 bp, Homo sapiens
  misc_feature: GYAE6OF02IAY6T.35.78.H01.1.454.CMB.1.raw
  modified_base (252)..(270): a, c, t, g, unknown or other
  misc_feature (252)..(270): n is a, c, g, or t
tcagtacagatcgtcacgaccggtgctcgatttagtgtgagtagtttgggtttgggggtgtgtggtctccactcccgccttgacgaggctgactattactgtcagtcttatgatggtagcaagtatgtggtcttcggcggagggaccaagctgaccgtcctaggtcagcccaagactcgcccccctcggtcactctcgttccccgccctcctcacgtatctgtactggagcgggctggacaaggcgcatagnnnnnnnnnnnnnnnnnnn

SEQ ID NO: 55554 - DNA, 307 bp, Homo sapiens
  misc_feature: GYAE6OF02G4CSY.35.78.H01.1.454.CMB.1.raw
  modified_base (301)..(307): a, c, t, g, unknown or other
  misc_feature (301)..(307): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagcaagtatgtggtcttcgggcggagggaccaagctgaccgtcctaggtccagcccaagacctcgccccctggtccactctcgttccccaccctcctcacgatctgtactgagcgggctggcaaggcgcatagnnnnnnn

SEQ ID NO: 55555 - DNA, 764 bp, Homo sapiens
  misc_feature: GYAE6OF02I3XMU.35.78.H01.1.454.CMB.1.raw
  modified_base (163)..(163): a, c, t, g, unknown or other
  misc_feature (163)..(163): n is a, c, g, or t
  modified_base (235)..(235): a, c, t, g, unknown or other
  misc_feature (235)..(235): n is a, c, g, or t
tcagtacagatcgtcacgaccggtgctcgatttagtgtgagtagtttgggtttgggggggtggtagctcaggaagcagagcctggagcatctccactatggcctgggctccactacttctcaccctcctcgctcactgcacaggttcttgggcctagttttangctgactcacgcccctactctggtgtcggagtcgtccggggaagacggtgaccatcctccgtcgccacccgnagcaggtcggacacgacacttaccagacaactatgtcgcgtagtacggtaaccaacgcggccggccccggcgtacccgttacccccgacctaccgtccacgtccgtacggaacgtaaccaaccgttaaaaccggtcccttcggttacggggtttacctaggtaccgtttccggttccttcggtaccggtccttaccgtagtacccgaaccgtacccttcccgtaaccttaacgtttcccgtacccgtaccccttaccccgtaaacctaccgttccgttaccgtacggtaactacggaacggtacgtacgggaacgggtacgacggtctacgaccttactcgtcgtacgttacgttcggtttacgacggtacgacgtctcggttcggttcgggttacggggttccggggacggggtaaccgtacggtaccggtaccggtacccgttacgtaacggcccgaacggtacccgtacggtcccgtcccggtccccttcggttaccccgtaccgttccccgttcccgtacccccg

SEQ ID NO: 55556 - DNA, 253 bp, Homo sapiens
  misc_feature: GYAE6OF02FLZ6W.35.78.H01.1.454.CMB.1.raw
  modified_base (247)..(253): a, c, t, g, unknown or other
  misc_feature (247)..(253): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttccccgccctcctcacgatctgtactgagcgggctggcaaggcgcatagnnnnnnn

SEQ ID NO: 55557 - DNA, 256 bp, Homo sapiens
  misc_feature: GYAE6OF02JDK5M.35.78.H01.1.454.CMB.1.raw
  modified_base (240)..(240): a, c, t, g, unknown or other
  misc_feature (240)..(240): n is a, c, g, or t
  modified_base (245)..(256): a, c, t, g, unknown or other
  misc_feature (245)..(256): n is a, c, g, or t
tcagtacagatcgtcacgaccggtgctcgatttagtgtgagtagtttgggtttgggggtgtggtggtctccactcccgccttgacgaggctgattattattgttgctcatatgcaggtagtagcactaatgtcttcggaactgggaccaaggtcaccgtcctaggtcagcccaaggccaaccccactgtcactctgttcccgccctcctcacgatctgtactgagcgggctggcaaggcncatgnnnnnnnnnnnn

SEQ ID NO: 55558 - DNA, 368 bp, Homo sapiens
  misc_feature: GYAE6OF02HPUGL.35.78.H01.1.454.CMB.1.raw
  modified_base (172)..(172): a, c, t, g, unknown or other
  misc_feature (172)..(172): n is a, c, g, or t
  modified_base (178)..(178): a, c, t, g, unknown or other
  misc_feature (178)..(178): n is a, c, g, or t
  modified_base (191)..(191): a, c, t, g, unknown or other
  misc_feature (191)..(191): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (308)..(368): a, c, t, g, unknown or other
  misc_feature (308)..(368): n is a, c, g, or t
tcagtacagatcgtcacgaccggtgctcgatttagtgtgagtagtttgggtttgggggggtgtgggtggtctccactcccgccttgacggggctgctatctgcctccctcactatctctggactcaagactgaggcgaggctgactattactgtcagtcttatgagtggtancaagtntgtggtcttcggnggagggaccaagctgaccgtccgtaggtcagcccaagactcgccccctggtcactctcgtcccgccctctcacgtactcntactgaggcgggactggccaagggcgtcagtagcngnnnnnnnnnnnnnnnnnnnnnnnnnnnnnnnnnnnnnnnnnnnnnnnnnnnnnnnnnnnnn

SEQ ID NO: 55559 - DNA, 257 bp, Homo sapiens
  misc_feature: GYAE6OF02GOMPD.35.78.H01.1.454.CMB.1.raw
  modified_base (244)..(257): a, c, t, g, unknown or other
  misc_feature (244)..(257): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactgccccctggtcactctgttcccaccctctcacgatctgtactgagcgggctggcaaggcgcatagnnnnnnnnnnnnnn

SEQ ID NO: 55560 - DNA, 382 bp, Homo sapiens
  misc_feature: GYAE6OF02H191Q.35.78.H01.1.454.CMB.1.raw
  modified_base (351)..(382): a, c, t, g, unknown or other
  misc_feature (351)..(382): n is a, c, g, or t
tcagtacagatcgtcacgaccggtgctcgatttagtgtgagtagtttgggtttgggggtgtggtggtctccactcccgccttgacggggctgctatctgcctccctcactatctctggactcaagactgaggacgaggctgactattactgtcagtcttatgatggtagacaagtatggtggttcttcgggcggagggaaccaagtctacgaccgtcctaggcacggaccccaagacctccgccccctggttccacttcgtccgttccctcccctcctacaacgtattcttcggtaccttaggcgggcggggaccgtcgggacgtaaaggggccgacctaagttggcacgnnnnnnnnnnnnnnnnnnnnnnnnnnnnnnnn

SEQ ID NO: 55561 - DNA, 638 bp, Homo sapiens
  misc_feature: GYAE6OF02I305R.35.78.H01.1.454.CMB.1.raw
  modified_base (160)..(160): a, c, t, g, unknown or other
  misc_feature (160)..(160): n is a, c, g, or t
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagtacagatcgtcacgaccggtgctcgatttagtgtgagtagtttgggtttgggggtggtagctcaggaagcagagcctggagcatctccactatggcctgggctccactacttctcaccctcctcgctcactgcacaggttcttgggccaattttangctgactcagccccactctgtgtcggggtctccggggganacggttaccctctcctgccacccgnaacngtgcagcatccgccaanactatgtgcattggtaccagcagccggcccggcacgtcccccatcattcgtctatttttgaagtattagtacgaaacgccctcgtcggggttccctggtttcggttctcgtggctcctatcgactcgttccctacctaactttcctcgtacccctccctcctaccctacttcccgtcgtcggacgtacgaaagtacgtcgggaagggacggaacggtcgtacgtacgtaactttagttcgttaccgtgtttacttagtggtaatactaccgtactaccttcgttgtaccggttcggtcggggacgggggtacgacgggtctacggtaccgttcctaacgtccgtaacgcccgtagccgtccgaccccgttccgtacctccttccgttccccg

SEQ ID NO: 55562 - DNA, 772 bp, Homo sapiens
  misc_feature: GYAE6OF02JMRDM.35.78.H01.1.454.CMB.1.raw
  modified_base (161)..(161): a, c, t, g, unknown or other
  misc_feature (161)..(161): n is a, c, g, or t
  modified_base (602)..(602): a, c, t, g, unknown or other
  misc_feature (602)..(602): n is a, c, g, or t
  modified_base (683)..(683): a, c, t, g, unknown or other
  misc_feature (683)..(683): n is a, c, g, or t
tcagtacagatcgtcacgaccggtgctcgatttagtgtgagtagtttgggtttggggggtggtagctcaggaagcagagcctggagcatctccactatggcctggctccactacttctcaccctcctcgctcactgcacaggttcttgggcctagttttangctgactcacgccccactctgtgtcggagtcgtaccggggaagtacggtacgacctactccgttccgtcggaccacccgcgacgccgtaggtgggccacggtcacgtttaccaagtaccaaacttacgtgtcgacgtacggttaccggtaaaccacgaccggtcccggcccggcctaccggtaacccctaagtacctcgtagtataccgtaaggtaacgtgtaacgtaccgaacgtacctccggtacggtccgtacgtaccgtcggtttctcggttacgtaccacgttaccgactaccgtacctacccgtacctaccgttactaccgtccctacccgtccgtactacgttccgtacgtacggtaccctaactaacggtcagggtaccgtacgacgttaccgtaccgttaatacgttactaccgtcgttactttacgttacncgttaggttaacgggaccttaaggtaaacggttgttacggtagggttttccccgaggggtaaccggaccgggttaaaaccncgggtttaccgtaaccgggtaacccggttaaccgtacgggtaacccgaacccggtcccggaaacggttcccccgaccccggttacccgg

SEQ ID NO: 55563 - DNA, 358 bp, Homo sapiens
  misc_feature: GYAE6OF02G4AOE.35.78.H01.1.454.CMB.1.raw
  modified_base (171)..(171): a, c, t, g, unknown or other
  misc_feature (171)..(171): n is a, c, g, or t
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (332)..(358): a, c, t, g, unknown or other
  misc_feature (332)..(358): n is a, c, g, or t
tcagtacagatcgtcacgaccggtgctcgatttagtgtgagtagtttgggtttggggggtgtggtggtctccactcccgccttgacggggctgctatctgccctccctcactatctctggactcaagactgaggacgaggctgactattactgtcagtcttatgatggtancaagtatgtggtcttcgggcggagggacctaagctgaccgttcctagggtcacgacccaagtaccgtccgtcccccgtaggtccactcctcgttccccgccctcctacacgatcgtgttacctgngccggggcttggcgaagggtcncataaggntctncnnnnnnnnnnnnnnnnnnnnnnnnnnn

SEQ ID NO: 55564 - DNA, 263 bp, Homo sapiens
  misc_feature: GYAE6OF02GPKR7.35.78.H01.1.454.CMB.1.raw
  modified_base (248)..(263): a, c, t, g, unknown or other
  misc_feature (248)..(263): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagactcgccccctggtcactctgttccccaccctcctcacgatctgtactgagcgggctggcaaggcgacatagnnnnnnnnnnnnnnnn

SEQ ID NO: 55565 - DNA, 285 bp, Homo sapiens
  misc_feature: GYAE6OF02F7J2X.35.78.H01.1.454.CMB.1.raw
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (250)..(285): a, c, t, g, unknown or other
  misc_feature (250)..(285): n is a, c, g, or t
tcagtacagatcgtcacgaccggtgctcgatttagtgtgagtagtttgggtttgggggggtgtggtggtctccactcccgccttgacgaggctgactattactgtcagtcttatgatggtagcaagtatgtggtcttcggcggagggaccaagctgaccgtcctaggtcagcccaaagactgccccctggtcactctcgttcccgccctcctcacgatcngtacngacgcgggctggcaaggcgcatagnnnnnnnnnnnnnnnnnnnnnnnnnnnnnnnnnnnn

SEQ ID NO: 55566 - DNA, 285 bp, Homo sapiens
  misc_feature: GYAE6OF02HOHS6.35.78.H01.1.454.CMB.1.raw
  modified_base (254)..(285): a, c, t, g, unknown or other
  misc_feature (254)..(285): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggaggaccaagctgaccgtcctaggtcagcccaagctgcccccctggtcactctcgttcccgcccttcctcacgattctgtactggagcgggctagggccaagggcacagtagcnnnnnnnnnnnnnnnnnnnnnnnnnnnnnnnn

SEQ ID NO: 55567 - DNA, 256 bp, Homo sapiens
  misc_feature: GYAE6OF02G6OIQ.35.78.H01.1.454.CMB.1.raw
  modified_base (245)..(245): a, c, t, g, unknown or other
  misc_feature (245)..(245): n is a, c, g, or t
  modified_base (251)..(256): a, c, t, g, unknown or other
  misc_feature (251)..(256): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcgggcggagggaccaagctgaccgtcctaggtcagcccaagactcgccccctcggtcactctcgttccccaccctcctcacgatctgtactgagcgggctggcaaggcncatagnnnnnn

SEQ ID NO: 55568 - DNA, 527 bp, Homo sapiens
  misc_feature: GYAE6OF02HGJEP.35.78.H01.1.454.CMB.1.raw
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (377)..(378): a, c, t, g, unknown or other
  misc_feature (377)..(378): n is a, c, g, or t
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
tcagtacagatcgtcacgaccggtgctcgatttagtgtgagtagtttgggtttgggggtgtggtggtcttccactcccgccttgtacggggctgctatctgcctccctcactatcgtctggacgtcaagactgaggaccggaggctggactattactgtcagtcttatgatggtagcaagtatggtcggtcttcggcggaagggaccaaggctaggacccgtcctaagggtccagccccaagacctgccccctagggtcaacgtctagttccccgccctcctacacgtatcctgtacctgaagtacggggcttcgggactaaacgggccganaagtacgtacncgatcntagncncaangtcngtnanctanagtcnntagcngtaccgngacntacgnanancangtacngtagtnagncgtnagtgaacgngtgacnacgtacacgactagagacagagactacagacatactacacancngacgacgtactactactaccgacacgctacgtacactcgtacgc

SEQ ID NO: 55569 - DNA, 327 bp, Homo sapiens
  misc_feature: GYAE6OF02JA3K1.35.78.H01.1.454.CMB.1.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (304)..(327): a, c, t, g, unknown or other
  misc_feature (304)..(327): n is a, c, g, or t
tcagtacagatcgtcacgaccggtgctcgatttagtgtgagtagtttgggtttggggggtgtggtggtctccactcccgccttgacggggctgctatctgcctccctcactatctctggactcaagctgagacgaggctgactattactgtcagtcttatgatggtagcaagtatggtggtcttcgggcggagggaccaagctgacccgtctaggtcacgcccaagcctcgcccccctcggtccactcctcgttccccgccctcctcacgatctgtactgngccggctggacaggcactanagnnnnnnnnnnnnnnnnnnnnnnnn

SEQ ID NO: 55570 - DNA, 252 bp, Homo sapiens
  misc_feature: GYAE6OF02GX2ZC.35.78.H01.1.454.CMB.1.raw
  modified_base (243)..(243): a, c, t, g, unknown or other
  misc_feature (243)..(243): n is a, c, g, or t
  modified_base (248)..(252): a, c, t, g, unknown or other
  misc_feature (248)..(252): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaagacctcgccccctggtcactctcgttccccaccctcctcacgatctgtactgagcgggctggcaaggcncatgnnnnn

SEQ ID NO: 55571 - DNA, 266 bp, Homo sapiens
  misc_feature: GYAE6OF02IGGTR.35.78.H01.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (240)..(266): a, c, t, g, unknown or other
  misc_feature (240)..(266): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttggcggagggaccaagctgaccgtcctaggtcagcccaagacctgccccctggtcactctgttcccncctctcacgatctgactgagcggctggcaaggcnatagnnnnnnnnnnnnnnnnnnnnnnnnnnn

SEQ ID NO: 55572 - DNA, 555 bp, Homo sapiens
  misc_feature: GYAE6OF02FULH0.35.78.H01.1.454.CMB.1.raw
  modified_base (200)..(200): a, c, t, g, unknown or other
  misc_feature (200)..(200): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
tcagtacagatcgtcacgaccggtgctcgatttagtgtgagtagtttgggtttggggggtggtagctcaggaagcagagcctggagcatctccactatggcctgggctccactacttctcaccctcctcgctcactgcacaggttcttgggccagttttatgctgactcagcccactctgtgtcggagtctccggggaanacggtgaccatctcctgcatccgcagcagtggcagcattaccagcaactatgtgcagtcggtaccaacagccgcccgggctacgttccccaatacctctgactctagtaaaggtgatacaaacgtaccctcgtcggggtccctgtacgttcggttctcgtcgggtccattcgacacgcctccctacccaacttctcgtcccttccctactacttactctcgtggacctcaacgtctagaggacgagctgattagttctgtntacgtnttatgagttggtanacgtaagtgtgttcgtcgtcggacggacggaccacggtcgtcgtaccgtcgtagccgacgaccacgcgtcccgg

SEQ ID NO: 55573 - DNA, 274 bp, Homo sapiens
  misc_feature: GYAE6OF02FNPY1.35.78.H01.1.454.CMB.1.raw
  modified_base (240)..(240): a, c, t, g, unknown or other
  misc_feature (240)..(240): n is a, c, g, or t
  modified_base (246)..(274): a, c, t, g, unknown or other
  misc_feature (246)..(274): n is a, c, g, or t
tcagtacagatcgtcacgaccggtgctcgatttagtgtgagtagtttggggtttggggggtgtggtggtctccactcccgccttgacgaggctgactattactgtcagtcttatgatggtagcaagtatgtggtcttcggcggagggaccaagctgaccgtctaggtcagcccaagactgccccctggtcactctcgttcccgccctctcacgatctgtactgagcgggctggcaaggcncatagnnnnnnnnnnnnnnnnnnnnnnnnnnnnn

SEQ ID NO: 55574 - DNA, 260 bp, Homo sapiens
  misc_feature: GYAE6OF02IIRA7.35.78.H01.1.454.CMB.1.raw
  modified_base (250)..(260): a, c, t, g, unknown or other
  misc_feature (250)..(260): n is a, c, g, or t
tcagtacagatcgtcacgaccggtgctcgatttagtgtgagtagtttgggtttgggggtgtggtggtctccactcccgccttgacgaggctgactattactgtcagtcttatgatggtagcaagtatgtggtcttcggcggagggaccaagctgaccgtcctaggtcagcccaaagctgccccctggtcactctgttccccgtcctcctcacgtatcgtgtactgagccgggctggcaaggcgacatagnnnnnnnnnnn

SEQ ID NO: 55575 - DNA, 315 bp, Homo sapiens
  misc_feature: GYAE6OF02HCQBT.35.78.H01.1.454.CMB.1.raw
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (294)..(315): a, c, t, g, unknown or other
  misc_feature (294)..(315): n is a, c, g, or t
tcagtacagatcgtcacgaccggtgctcgatttagtgtgagtagtttgggtttggggggtgtggtggtctccactcccgccttgacggggctgctatctgcctccctcactatctctggactcaagactgaggacgaggctgactattactgtcagtcttatgatggtagcaagtatgtggtctcggcggaggaccagctgacccgtctagtcagcccaagacctcgcccccgtgtcactctcgttcccacctcctcacgatctgtactgagcggtntgcaaggcnctagtagnnnnnnnnnnnnnnnnnnnnnn

SEQ ID NO: 55576 - DNA, 355 bp, Homo sapiens
  misc_feature: GYAE6OF02G7RHB.35.78.H01.1.454.CMB.1.raw
  modified_base (266)..(266): a, c, t, g, unknown or other
  misc_feature (266)..(266): n is a, c, g, or t
  modified_base (274)..(275): a, c, t, g, unknown or other
  misc_feature (274)..(275): n is a, c, g, or t
  modified_base (277)..(277): a, c, t, g, unknown or other
  misc_feature (277)..(277): n is a, c, g, or t
  modified_base (279)..(282): a, c, t, g, unknown or other
  misc_feature (279)..(282): n is a, c, g, or t
  modified_base (284)..(284): a, c, t, g, unknown or other
  misc_feature (284)..(284): n is a, c, g, or t
  modified_base (288)..(355): a, c, t, g, unknown or other
  misc_feature (288)..(355): n is a, c, g, or t
tcagtacagatcgtcacgaccggtgctcgatttagtgtgagtagtttgggtttggggggtgtggtggtctccactcccgccttgacgaggctgactattactgtcagtcttatgatggtagcaagtatgtggtcttcggcggagggaccaagctgaccgtcctaggtcagcccaagacctcggccccccttaggtccaaccttcttccgttccccacccttcctcacgattcctgtactgaggcgggcttcgggacaacgggtccnctaatagnnangnnnngnatgnnnnnnnnnnnnnnnnnnnnnnnnnnnnnnnnnnnnnnnnnnnnnnnnnnnnnnnnnnnnnnnnnnnn

SEQ ID NO: 55577 - DNA, 773 bp, Homo sapiens
  misc_feature: GYAE6OF02FVQHJ.35.78.H01.1.454.CMB.1.raw
  modified_base (162)..(162): a, c, t, g, unknown or other
  misc_feature (162)..(162): n is a, c, g, or t
  modified_base (222)..(222): a, c, t, g, unknown or other
  misc_feature (222)..(222): n is a, c, g, or t
tcagtacagatcgtcacgaccggtgctcgatttagtgtgagtagtttgggtttgggggtggtagctcaggaagcagagcctggagcatctccactatggcctgggctccactacttctcaccctcctcgctcactgcacgaggttcttgggcctagttttangctgactcacgccccactcgtggtgttacggacgttccggtccgggggaagtaccgggtnaacccgtacttcctcccgtcgcccaaccccggctaggctaggtcggacctaggacctaacttaacccgagtacctaaacttgtgtcgcgtacggtacggtaacccaacgcggcccgggaccccgggtacttacccgttaacccccgaattccgtacgttcgaacttacggtaaacgtaacggttagaacttaacccgtaaacgtcccttacggtccgggttaccctacgtacgttcccggtttcgaccggtcgggtaccaggtacccggacctacggtccttaccccgtacctaaccgttccgacccgtcccccttacccgtacttacctaccgttcgttaacctacggtactaccgaaaccgtagacggaacggaccggacgttacgagttaactttacgttacctacgttctacggttattacggtacggtacgttacgtacgtaccgtaagttcgttagggtcgttacgggttaccggacggtacgaaccggtgtacccgtcgtaccggttacacgtaccgacccgactacccgccgtacccgtcccg

SEQ ID NO: 55578 - DNA, 278 bp, Homo sapiens
  misc_feature: GYAE6OF02FFS1V.35.78.H01.1.454.CMB.1.raw
  modified_base (240)..(240): a, c, t, g, unknown or other
  misc_feature (240)..(240): n is a, c, g, or t
  modified_base (245)..(248): a, c, t, g, unknown or other
  misc_feature (245)..(248): n is a, c, g, or t
  modified_base (250)..(251): a, c, t, g, unknown or other
  misc_feature (250)..(251): n is a, c, g, or t
  modified_base (253)..(253): a, c, t, g, unknown or other
  misc_feature (253)..(253): n is a, c, g, or t
  modified_base (257)..(278): a, c, t, g, unknown or other
  misc_feature (257)..(278): n is a, c, g, or t
tcagtacagatcgtcacgaccggtgctcgatttagtgtgagtagtttgggtttggggggtgtggtggtctccactcccgccttgacgaggctgattattattgttgctcatatgcaggtagtagcactaatgtcttcggactgggaccaaggtcaccgtctaggtcagcccaaggcccaacccccatgtcactctgttccccaccctcctcacgatctgtactgagcgggctggcaggcncatgnnnntnngnctannnnnnnnnnnnnnnnnnnnnn

SEQ ID NO: 55579 - DNA, 157 bp, Homo sapiens
  misc_feature: GYAE6OF01ANZ61.2.68.G02.1.454.CMB.1.raw
  modified_base (154)..(157): a, c, t, g, unknown or other
  misc_feature (154)..(157): n is a, c, g, or t
tcagacgctcgacacacgaccggtgctcgatttagtcgatagtgaagggaaagggaccgaaggtggaaatcaaacgaactgtggctgcaccatctgtcttcatcttcccgccatctgatgtcgagcgtctgagcgggctggcaaggcgcatagnnnn

SEQ ID NO: 55580 - DNA, 154 bp, Homo sapiens
  misc_feature: GYAE6OF01DUQ2B.2.68.G02.1.454.CMB.1.raw
  modified_base (153)..(154): a, c, t, g, unknown or other
  misc_feature (153)..(154): n is a, c, g, or t
tcagacgctcgacacacgaccggtgctcgatttagtcgatagtgaagggaaagggaccaaggtggaaatcaaacgaactgtggctgcaccatctgtcttcatcttcccgccatctgatgtcgagcgtctgagcgggctggcaaggcgcatagnn

SEQ ID NO: 55581 - DNA, 617 bp, Homo sapiens
  misc_feature: GYAE6OF01B93NR.51.43.D10.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (309)..(309): a, c, t, g, unknown or other
  misc_feature (309)..(309): n is a, c, g, or t
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggcccaggacagacggcaggatttccnggtgggganacaacattggaaagtaaaagtgtaacactggtaccagcaggaggccaggccaggcccctgtgttggtcgtctatgattataacgaccggccctnagggatccctgaccgattctctggctccatctcgtgggaacacggccactctgaccatcagcagggtcgaaggccgggatggacggccgatattactgtacgaggtgtagggtaaagtagtagtgatcaagtttatggtaccgttgggaaaggttcgggaaacctaagggtcctaacccggtcccgtaagggtcccaaccgggtacccgaaacgggacccccaaacccccgtacgttcggttaccccaaaccgtttcccttaccggtttaccccccaacccctttcccttccgttacccggtaaccgg

SEQ ID NO: 55582 - DNA, 525 bp, Homo sapiens
  misc_feature: GYAE6OF01DIASE.51.43.D10.1.454.CMB.1.raw
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctggtgggggagacaacattggaagtaaaagtgtacactggtaccagcagaggccaggccaggcccctgtgttggtcgtctatgattataacgaccggccctcagggatccctgaccgattctctggctccatctctgggaacacggtcactctgaccatcagcagggtcgaagccggggatggaggccgactattactgtacaggtgtgggaaagtagtagtgatcattatgtcttcggaagtggaccaaggtcaccgtctaggtcagcccaaggcccaacccactcgtcactctcgttcccaccctcctctcgtacg

SEQ ID NO: 55583 - DNA, 591 bp, Homo sapiens
  misc_feature: GYAE6OF01EAA6U.51.43.D10.1.454.CMB.1.raw
  modified_base (218)..(218): a, c, t, g, unknown or other
  misc_feature (218)..(218): n is a, c, g, or t
  modified_base (356)..(356): a, c, t, g, unknown or other
  misc_feature (356)..(356): n is a, c, g, or t
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttccgtgtggggganacaacattggaagtaaaagtgtacactggtaccagcagaggcaggccaggccctgtgtgtcgtctatgattataaccggccggccctcgagggactcccgtagaccgtattcctcgtggcctccatctcgtgggaacncggccactctcgaccatcgagcgagggtacgaacgggccggggatcggacggccgtaacttattaacgtcgtcgtagggtggtagggaaagttaggtagtgattctaatttagtgttacgttacgggaaggtcgggaacctaagggtaccaccgtcgtacggtcaccgacccgaacggcccaaccccacgtcgacctactccgttccgttaccccacccttcctccgtcggtacg

SEQ ID NO: 55584 - DNA, 611 bp, Homo sapiens
  misc_feature: GYAE6OF01EIZVC.51.43.D10.1.454.CMB.1.raw
  modified_base (219)..(219): a, c, t, g, unknown or other
  misc_feature (219)..(219): n is a, c, g, or t
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtcggccccaggacagacggccaggatttcctggtggggganacaacattggaaagtaaaagtgtacactggtaccagcagaggccaggccaggccctgtgttggtcgtctatgattataacgaccggccctcgagggactcccgtagaccgattctctggcctcatctctgggaacacggccactcgtcgaccatcagcgagggtacgaacggccggggatcggagggccgtaactacgttactgtacgaggtaggtagggaaagttggtagtgattcattatgttcttacgggaagtcgggaaccgaaggtccgaccggtccgtaggtccgacgacccgaaaccgggccctaaacccccgagttcgtacctaaccgttacccgtttccggttaccccccaacccccgtttcccttcccgttccgttaaccgg

SEQ ID NO: 55585 - DNA, 124 bp, Homo sapiens
  misc_feature: GYAE6OF01CTUAT.51.43.D10.1.454.CMB.1.raw
  modified_base (124)..(124): a, c, t, g, unknown or other
  misc_feature (124)..(124): n is a, c, g, or t
tcagcgatcgtatacacgaccggtgctcgatttagactagcagtaagggctggcaaggcgcatagctgcctggtcaaggactacttcctcgtagcactctgagcgggctggcaaggcgcatagn

SEQ ID NO: 55586 - DNA, 632 bp, Homo sapiens
  misc_feature: GYAE6OF01B0KT3.51.43.D10.1.454.CMB.1.raw
  modified_base (218)..(218): a, c, t, g, unknown or other
  misc_feature (218)..(218): n is a, c, g, or t
  modified_base (298)..(298): a, c, t, g, unknown or other
  misc_feature (298)..(298): n is a, c, g, or t
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctggtggggganacaacagttggaaagtaaaagtgtaacactggtaccagcagaggccaggccaggccctggtgttggtcgtctatgattanaacgccggccctcgagggactccctgaccgtattcctcgtggcctccacttctcgtacggggaacaccggccactctacgaccatcagcgagggcgaaggccggggatggacggaccgattattacgtggtgaggtggtagggtaaagtagtagtgtattgaatttagtcgttacgttacgggaaggttcggggaaccaagggttccgacccggttccgtacgggttaccaacgaccccgaaagggacccccaaacccccgacgttccgtaccttaacccgttccgtttacccgttaccccctacccccttccccgttcgttacccggtaaccg

SEQ ID NO: 55587 - DNA, 787 bp, Homo sapiens
  misc_feature: GYAE6OF01EUNL7.51.43.D10.1.454.CMB.1.raw
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcacgtcccacccgttcggtcgtccgtacggtcggccccgaggaccacggaccggccgtagggttactttccggtggggtaggggggaacaaccgtaacgtaaggttaaggtaaaaggttaaaaggtcggttaacgaacgtcggtaaccgacgacgacggaacggccgaacggcccgaccggtcccgttggttcggttacggtccgttcttaggtagtaagttaacggacccggtacccggcccgtacggacgggtaccttcccgtacgaccgtcttactcggtaccgtcctcgtacgtccgtacggtacgggaaccgtaccggacctaccgtaccgtacgaacctacgacgtaacggaccggtaggggtaacgggaaccgggcggggtaaggtaccgggaaccggtaaccgtacgttaacgtacgtgtacggtagggtaggtaacggggtaagtagtaggtagtatacgtagttacgtggttacggtacgggtaacgtacgggtaacctaacgggttcccaaccgggttccggtaacgaccgacccgtaacgaacccgtaccctaaccgtcttacgcccttacgtacccgttcccttaccccgtacccgttcgtccgtaccgtacccg

SEQ ID NO: 55588 - DNA, 125 bp, Homo sapiens
  misc_feature: GYAE6OF02GJQ61.51.43.D10.1.454.CMB.1.raw
  modified_base (124)..(125): a, c, t, g, unknown or other
  misc_feature (124)..(125): n is a, c, g, or t
tcagcgatcgtatacacgaccggtgctcgatttagactagcagtaagggctggcaaggcgcatagctgcctggtcaaggactacttcctcgtagcactctgagcgggctggcaaggcgcatagnn

SEQ ID NO: 55589 - DNA, 660 bp, Homo sapiens
  misc_feature: GYAE6OF02H4O3P.51.43.D10.1.454.CMB.1.raw
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccacctcggtgtcagtcggccccaggacaggacggccaggtatttcctggtgggggagacaactagttaggaaagtaaaagtgtaacacgtggtaccagcagaggccaggccaggccctgtgttggtcgtctatgattataacggaccggcctcgaggggactccccgtagaccgtattctcgtggcctcctatctcgtagggaaccacggccactctacggaccatcgagcgagggtcgaaggcgggagtcggaacgggtccgacgttacttacgtgtacgagggttgtagggaaaggttagtaggtaggtattactaatttagttggttacgtttacgggaacgggttaggggtaaccgtaacgggttaccgtacccggttaccgttacgggtaccgtaccgtacccgaaccgggtccccaaacccccgtagttccggtacctaccgttaccgttaccgttcccccctaaccccgttccttaccctccggtaaccg

SEQ ID NO: 55590 - DNA, 929 bp, Homo sapiens
  misc_feature: GYAE6OF02JW7EE.51.43.D10.1.454.CMB.1.raw
  modified_base (220)..(220): a, c, t, g, unknown or other
  misc_feature (220)..(220): n is a, c, g, or t
  modified_base (328)..(328): a, c, t, g, unknown or other
  misc_feature (328)..(328): n is a, c, g, or t
tcagcgatcgtatacacgaccggtgctcgatttagactagcagtaagggcgtgggcctaaggaagcagcactggtggtgcctcagccatggcctggaccgttctcctcctcggcctcctctctcactgcacagtctctgtgacatcctatgtgctgactcagccaccctcggtgtcagtcggccccaggacagacggccaggactttcctggtggggganacaacagttgggaaagttaaaagtgtaacacgtggtaaccagcaagaggccaggcccaggccccgtgtcgttggtcgtcgtatgattataacgaccgccctgacgggntcccgtgaccgattctctggctccattctccgttggggaaaccctacggggaccctacgttccgtagaaccccgtattaccgaagggcccgtaaggggggtttacccgaaacggggtaccccgggggggtaatttaccgggggaaaccggggtaccccgggaaccggtttaaaccgtttaaaccggtttacggggttaaccccggttaaacgggggttaggggtttaacgggggggaaaaaccggttttagggttaaacgggttacgggtaacgtttacccggtaaagtttttaaacgggttcggttttaccgggtttttaaacgggggtaaaccggttttaacggggggggtaaacccttaaacccgggggtttaccggtaaaacccccgggtttaccccggtttaaacgggggttaacccgtaccgggtaccccccgttaaaaacggggggcccccccttaaaaccccccgggttacggttaaacccggtttccccgggtaaaaccccgttttccccgggtttacccgggtttaacccccccccgtccccccgtttttaacccccggttaccccgtttacccgggtttaaacccccggg

SEQ ID NO: 55591 - DNA, 808 bp, Homo sapiens
  misc_feature: GYAE6OF02F4VGR.51.43.D10.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (385)..(385): a, c, t, g, unknown or other
  misc_feature (385)..(385): n is a, c, g, or t
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccgtcggtgtcaggtcgccccaggacagacggcaggtacttccgnggtggggganacaacgtagttaggaaacgtaaaatgtaacacgtaggtaccagacaggaacgccgacggccgacggcccttggtcgtggtcgtctatgtaattacgaaccgaccggtcctacggaggactccgtagaccgtattcgctaggtccaccattcctacgagggaaccnccggtactacgtcgtaccgacctaatccgaacgcggtaacgggtacccggtaacggggaccgggtaaaggttcggggaaccgggtacccggtaaacgtttaacggtttaaaccggttacggttaaccgttaggggtaccggggtttaaggggttaaaaaggttaacgggttaggttaacgttaagttacctttaaagttacgtttacggttacggttttacggggaaaccgggttaacggggtaacccgtttaaccggggtaccccttaaaccggttcccgggttaacccggttaacccggtaccggtaacccggacccggtaaccccgaaaccccgttacccgttaccgttacccgtaaccgtttacccgttacccggtttaacccccctccccgtttacccgtttacgtacccggttaccg

SEQ ID NO: 55592 - DNA, 850 bp, Homo sapiens
  misc_feature: GYAE6OF02HVZRW.51.43.D10.1.454.CMB.1.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (429)..(429): a, c, t, g, unknown or other
  misc_feature (429)..(429): n is a, c, g, or t
tcagcgatcgtatacacgaccggtgctcgatttagactagcagtaaggggcgtgggcctaaggaacgcagcactggtggtgcctcagccatggcctggaccgttctcctcctcggcctcctctctcactgcacagtctctgtgacatcctatgtgctgactcacgccaccctcggtgtcaggtcggccccgaggacaggacggccaggtactttccgnggtgggganacaacgtagtaggaaagtaaagtgtaacacgtacggtaccagcgaagacggaccaggccacgggccccttgttcggttcggtcgtcttagtagtaattaacgtaaccggtacccggccttacggaacgggtacctaccccgtaggtaccccgtagtttccgtacgtcggtcctaccgtacgttccgtcggtacgggaaaccnccgggtaccctaacgtcgtacggaacctagtaccgaacggtaccggtacgggggtaccgaaacggggcccggggtaagtaccgggaacgggtacccgtaacgtttacgttaacgtcggtaccggtaggggttacggtaacgggggtaaaacgtttagggttaacgttaacgggtactacgtttaaagttttacggttacggtttaccggtttaacggggaaacggtttccggggaaaaccgttaacggggttacccggtaaccggtttcccgggttaacgggttacccgaccgggtaacccggtaaccgggcccccctaaaaccccgtcgggtttaccgttacccgttaacccgttcccggtttaccccggtttaccccccgtaccccggtttacccgtttacccggtacccgttaccggg

SEQ ID NO: 55593 - DNA, 861 bp, Homo sapiens
  misc_feature: GYAE6OF02FOL1X.51.43.D10.1.454.CMB.1.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (842)..(842): a, c, t, g, unknown or other
  misc_feature (842)..(842): n is a, c, g, or t
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcacgcccacccgtcggtgtcagtcggccccaggacaggacggcctaggactttccgnggtgggganaacaactagttaggaagtaaaagtgactacgtacggtaccagcaagacggccgaacggtcccgaacgggtcccctaggttacggttcgggttaccgttactaagttaggtaacttttaacgtaaacccgggtacccggtaccccgttacggaaacgggggtaccttacccccggtaagggtaacccggtttaatttcccgttaccgggttaaccggggtcccgttaaccccttaaccggtttcccgttaaacggggttaccggggaaaaccccgtaccccggggtaccccgtaactttcccgaaaccgggtaaacccctaagtttacccgaaacgggaccgggttaaaccgggggtaacccggaaaccgggggtacccggggggtaaagtaccgggaaccggggtacccggttaaacgtttacgttacgggaccgtttaccgggtaggggtaagggttcggggttaaagggtaaaggttcggtaagtgtactaagtacgtttatacggttacgtttaagggacgttacgggactaacgtccgtaccggtactaggtaccacgaacccggaacgtacccaacccgtgtaccgttaccgccttaccgtcccttaccccncccgttacctaccgtaccg

SEQ ID NO: 55594 - DNA, 767 bp, Homo sapiens
  misc_feature: GYAE6OF02GL12J.51.43.D10.1.454.CMB.1.raw
tcagcgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcacgcccacccgtcggtgtcagtcggccccaggacacggacggccaggtactttccgtgggtaggggacaacaatagttaggaaagtaaagtgtacacgtagtacgagacagacggccagggccacggcccgtgtcggttggtcgtcgtagtgtaattacgtaaccggaccgtccccgtagtaacggggacttaccccgtggtaacccgtattcccgttacgtcggggtacccttccgtaactttcccgttaaccgggtacggggtaaaccgacccggtccctaaccgtcgtaccgacccgtaacttcccggaacggtcccggggtaaacggggtacccgggtaaacgggggcccgggggtaagtccgggaaccgggtaccgtaactttacgttacggttacggtcggtaacgggtagggtaacgggtaaagttcggttaagttaagtacttacgtagttatcgggttactacggggtaaggtcggtaacgttacgggtactacccggtacgtagaccggtacgaccgtaccggtacccaacccgtagtccgtacccgtagttcccgttaccggtcccccttcccgttccgttccggtaggtaccccg

SEQ ID NO: 55595 - DNA, 448 bp, Homo sapiens
  misc_feature: GYAE6OF01DF57E.37.29.C07.1.454.CMB.1.raw
  modified_base (252)..(252): a, c, t, g, unknown or other
  misc_feature (252)..(252): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (441)..(448): a, c, t, g, unknown or other
  misc_feature (441)..(448): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaaatgaacagcctgagagccgaggacacggccgtatattactgttacgaaagataggtactctggttcggcgtacttttttaangtccatctttgaccactgggccagggaaccctggtcaccgtctcctcacgcctccaccaagggcccatccggtccttccccctggccgccctgcctccaggacncaccctcganagcacgacgcggcctgggctgcctggtcaaggctacttccatctacactactgagcggctggcaaggcgcatagnnnnnnnn

SEQ ID NO: 55596 - DNA, 407 bp, Homo sapiens
  misc_feature: GYAE6OF01BKFU4.37.29.C07.1.454.CMB.1.raw
  modified_base (403)..(407): a, c, t, g, unknown or other
  misc_feature (403)..(407): n is a, c, g, or t
tcagtagtgtagatcacgaccggtgctcgatttagagtgctacgaagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctgggggccgagggaccacggtcaccgtctcctcagcctccaccaagggcccatcggtcttccccctggcgcccctgctccaggagcacctccgagagcacagcggccctgggctgcctggtcaaggactacttccatctacactactgagcgggctggcaaggcgcatagnnnnn

SEQ ID NO: 55597 - DNA, 468 bp, Homo sapiens
  misc_feature: GYAE6OF01BELCK.37.29.C07.1.454.CMB.1.raw
  modified_base (250)..(250): a, c, t, g, unknown or other
  misc_feature (250)..(250): n is a, c, g, or t
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
  modified_base (459)..(468): a, c, t, g, unknown or other
  misc_feature (459)..(468): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgtacttttttaangtccattctttgaccacgtggggccagggaaccctggtccaccgtctcctcacgcctccaaccaagggccccatccggtccttcccccgtggccncccctgcctccgagggacgccaccctccgagacgccaacnggccggccctgggcctgccctggtcaaaggctacttccatctacactactgagcggctggcaaggcgacatagnnnnnnnnnn

SEQ ID NO: 55598 - DNA, 465 bp, Homo sapiens
  misc_feature: GYAE6OF01E0GKM.37.29.C07.1.454.CMB.1.raw
  modified_base (454)..(465): a, c, t, g, unknown or other
  misc_feature (454)..(465): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgtacgaaaatggcctacggatatgactactattgggactggtacttcgatctctggggccgtggcaccctggtcactgtctcctcagcctccaccaagggcccatccggtcttccccctggccgccctgctccgaggacgccacctccgagagccacgagccggccctggggcctcggccctgggtccaaggtaccttacttccactctacactactgaggcgggctgggccaaggccgcatagnnnnnnnnnnnn

SEQ ID NO: 55599 - DNA, 440 bp, Homo sapiens
  misc_feature: GYAE6OF01CS19M.37.29.C07.1.454.CMB.1.raw
  modified_base (250)..(250): a, c, t, g, unknown or other
  misc_feature (250)..(250): n is a, c, g, or t
  modified_base (433)..(440): a, c, t, g, unknown or other
  misc_feature (433)..(440): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgtacttttttaangtccatctttgaccactggggccagggaaccctggtcaccgtctcctcagcctccaccaaggcccatccggtcttcccctggcgccctgctccaggacgcacctcgagagcacacgcggccctgggctgcctgtcaaggactactccatctacactactgagcgggctggcaaggcgcatagnnnnnnnn

SEQ ID NO: 55600 - DNA, 409 bp, Homo sapiens
  misc_feature: GYAE6OF01ERKHB.37.29.C07.1.454.CMB.1.raw
  modified_base (309)..(309): a, c, t, g, unknown or other
  misc_feature (309)..(309): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (401)..(401): a, c, t, g, unknown or other
  misc_feature (401)..(401): n is a, c, g, or t
  modified_base (406)..(409): a, c, t, g, unknown or other
  misc_feature (406)..(409): n is a, c, g, or t
tcagtagtgtagatcacgaccggtgctcgatttagagtgctacgaagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggtccggtttcgactacgtgggccagggaaccctggtcaccgtctcctcagcctccacaagggcccatcggtctcccctggcnccctgctccaggngcacctccgagngcacagcggccctggctcgcctggcaaggactactccatctacactactgagcggctggcaaggcgnatagnnnn

SEQ ID NO: 55601 - DNA, 504 bp, Homo sapiens
  misc_feature: GYAE6OF01EA7TN.37.29.C07.1.454.CMB.1.raw
  modified_base (494)..(504): a, c, t, g, unknown or other
  misc_feature (494)..(504): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgttacttttttaatgtcctattctttgaccacgtggggccagggaaccctggtcaccgtctcctcacgccctccaccgaacgggccccagttccggtccttcccccgtggccgccctgcctccgaggcgccacccgtccgagacgccacgacggccggcccgtgggcctcggccgtgggtacaaacggtaccttaccttccacttcctaacctacctacgtggacggccgggcgtcgggacaacgggcacgagtagnnnnnnnnnnn

SEQ ID NO: 55602 - DNA, 492 bp, Homo sapiens
  misc_feature: GYAE6OF01CN62I.37.29.C07.1.454.CMB.1.raw
  modified_base (479)..(492): a, c, t, g, unknown or other
  misc_feature (479)..(492): n is a, c, g, or t
tcagtagtgtagatcacgaccggtgctcgatttagagtgctacgaagggaaggggctggagtgggtctcaggcattagtattgatggtgataccacatactacgcagactccgtgaagggccggttcaccatctcccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccaagggcccatccggtccttccccctggccgcccctgcctccaggacgccaccgtccgagacgccacacggcggccctggggacctcggcctgggtcaaagggaccttaccgttcccaatcctaacctacttaacgtggacgccggggctgggaccaaggccgtcagtagnnnnnnnnnnnnnn

SEQ ID NO: 55603 - DNA, 486 bp, Homo sapiens
  misc_feature: GYAE6OF01CIL5O.37.29.C07.1.454.CMB.1.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (441)..(441): a, c, t, g, unknown or other
  misc_feature (441)..(441): n is a, c, g, or t
  modified_base (462)..(486): a, c, t, g, unknown or other
  misc_feature (462)..(486): n is a, c, g, or t
tcagtagtgtagatcacgaccggtgctcgatttagagtgctacgaagggaggggctggagtgggtctcaggcattagtattgatggtgataccacatactacgcagactccgtgaagggccggtttaccatctccagagacaagtccaagaacacgctgtatctgacaaatgaacagcctgagagccgagacacggcctatatactgttcgaaantaggtactcgtggttcggcgtacttttttaangtccatcttttgaccactgggggccagggaaccctggtcaccgtctcctnacgccctaccaaccgaagggcccatccggtcttcccccctggccgccctgacctccagggacncaccgtcgagagcactaggccgccgtgggctntcccgtggtaccaaaggcctaacttccatcctacactactgagccgggnttgggacaaggcgactagagnnnnnnnnnnnnnnnnnnnnnnnnn

SEQ ID NO: 55604 - DNA, 600 bp, Homo sapiens
  misc_feature: GYAE6OF01C1364.37.29.C07.1.454.CMB.1.raw
  modified_base (574)..(600): a, c, t, g, unknown or other
  misc_feature (574)..(600): n is a, c, g, or t
tcagtagtgtagatcacgaccggtgctcgatttagagtgctacgaagggaaggggctggagtgggtctcaggcattagtattgatggtgataccacatactacgcagactccgtgaagggccgtttacatctcagagacaagtccaaagaacacgctgtatctgacaaatgaacagcctgagacgcgaggacgacgcgtatatactgtacgaaagataggtacttcgttggttcggtactttactttttaatcgtcctattctttcgacctacggtggggaccgacgggaaccctggtccacccgtcctcctacaccgtcctccaacccgaacgggccctacgttccggttcccttcccccgtggcccgtccctcgcctcccggaggtaccaccgacccgtaccggagacgcctaacggaccgggcccggtcccggtcgggccgtaccggtcccgtacgggtaaccctaacgggtacccttaccttaccgtaaccttaccgtaaccttaaccgtacgttacgggaaccgggtccgggtacgtacgggaacgaacggggtccaacgtacgtagcnnnnnnnnnnnnnnnnnnnnnnnnnnn

SEQ ID NO: 55605 - DNA, 524 bp, Homo sapiens
  misc_feature: GYAE6OF01CL4HV.37.29.C07.1.454.CMB.1.raw
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (374)..(374): a, c, t, g, unknown or other
  misc_feature (374)..(374): n is a, c, g, or t
  modified_base (501)..(524): a, c, t, g, unknown or other
  misc_feature (501)..(524): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttacgaaagataggtactctggttcggcgtacttttttaangtcctatcttttgaccncgtggggccagggaaccctggtccaccgtctcctcacgcctcccaccaacgggccccagttccggtcccttccccccgtggcccgtcccctgcctcccgagggacnccaacccgtccgagcgacacgacgccggcccgtgggcctcggtccctgggtaccaaacggtaccttaccttacccattacctaccacttacgtgacggtccgggctcgggacaacggcgacatacgnnnnnnnnnnnnnnnnnnnnnnnn

SEQ ID NO: 55606 - DNA, 559 bp, Homo sapiens
  misc_feature: GYAE6OF01EHNSH.37.29.C07.1.454.CMB.1.raw
  modified_base (253)..(253): a, c, t, g, unknown or other
  misc_feature (253)..(253): n is a, c, g, or t
  modified_base (396)..(396): a, c, t, g, unknown or other
  misc_feature (396)..(396): n is a, c, g, or t
  modified_base (532)..(559): a, c, t, g, unknown or other
  misc_feature (532)..(559): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttacgaaagataggtactcgtgggttcggcgttactttttaangtacctattctttgacctacgtcgggggaccaacgggtaaccccgtggtaccctaccgttccttccctcgacgcccctacccaccgaacgggcccctagtccggttcccttcccccgtggccctccctcgcctccgagggccnccaccctccggagacgccacgcggccggcccgtgggctcgccgtgggtacgaacggtctaccgttccacttaccgaacctacgtacgtcggcggggcccggtcggtcggaaccggaacggccgaacgtagtacgcnnnnnnnnnnnnnnnnnnnnnnnnnnnn

SEQ ID NO: 55607 - DNA, 498 bp, Homo sapiens
  misc_feature: GYAE6OF01AJD6D.37.29.C07.1.454.CMB.1.raw
  modified_base (254)..(254): a, c, t, g, unknown or other
  misc_feature (254)..(254): n is a, c, g, or t
  modified_base (357)..(357): a, c, t, g, unknown or other
  misc_feature (357)..(357): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
  modified_base (468)..(489): a, c, t, g, unknown or other
  misc_feature (468)..(489): n is a, c, g, or t
  modified_base (491)..(498): a, c, t, g, unknown or other
  misc_feature (491)..(498): n is a, c, g, or t
tcagtagtgtagatcacgaccggtgctcgatttagagtgctacgaagggaaggggtcgtggagtgggtctcaggcattagtattgatggtgataccacatactacgcagactccgtgaagggtccggtttaccatctccagagacaagtccaagaacacgctgtatctgcaaatgaacagcctgagagccgaggacacggccgtatattactgttacgaaagataggtactctggttcggcgtacttttttaangtcctatctttgaccacgtggggccagggaaccctggtccaccgtctcctcagcctccaccaagggcccatcgtcctccccgtggccgccctgcctcaggacnccacccgtccgagagccacgaggccggccctgggcctgtccgtagggtacaaaggtcctaccgttccattcctacactacgngacgcggtctcggctaaggcacatcgncnnnnnnnnnnnnnnnnnnnnnncnnnnnnnn

SEQ ID NO: 55608 - DNA, 554 bp, Homo sapiens
  misc_feature: GYAE6OF01DNMOW.37.29.C07.1.454.CMB.1.raw
  modified_base (255)..(255): a, c, t, g, unknown or other
  misc_feature (255)..(255): n is a, c, g, or t
  modified_base (538)..(554): a, c, t, g, unknown or other
  misc_feature (538)..(554): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgacaaatgaacagcctgagagccggaggacgacggcctatattactgttacgaagagtaggtactcgtggttcggtcgttattttttaancgtcctattcttcgacctacggtcgggaccgacgggtaaccctggtacctaccggtctcccgtcaccgtcccctaccgaaccgaaccgggccctacgttcccggttcccttccccgtggcccgtccctcgcctaccgaggccgaccacccgtacgagacgcgacgacgcccgggccgtacggcgtcgaccgtagtacgaaacggtccttaccttccgaactcctaaccgtactacggtcggacgggtcggaccgtcgggaaccgaagggccgtagtaagtcgnnnnnnnnnnnnnnnnn

SEQ ID NO: 55609 - DNA, 643 bp, Homo sapiens
  misc_feature: GYAE6OF01A04W0.37.29.C07.1.454.CMB.1.raw
  modified_base (570)..(570): a, c, t, g, unknown or other
  misc_feature (570)..(570): n is a, c, g, or t
  modified_base (575)..(576): a, c, t, g, unknown or other
  misc_feature (575)..(576): n is a, c, g, or t
  modified_base (591)..(591): a, c, t, g, unknown or other
  misc_feature (591)..(591): n is a, c, g, or t
  modified_base (622)..(622): a, c, t, g, unknown or other
  misc_feature (622)..(622): n is a, c, g, or t
  modified_base (630)..(630): a, c, t, g, unknown or other
  misc_feature (630)..(630): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
tcagtagtgtagatcacgaccggtgctcgatttagagtgctacgaagggaaggggctggagtgggtctcaggcattacgtattgatcggtgataccacatactacgcagactccgtgaagggccggtttaccatctccagagacaacgtccaagaacacgctgtatctgcaaatgaacagcctgagagccgaggacacggccgtatattacgtgtcgtgaacgggaccttctaacgccccttatagccgagccgactcggtccgtcggttacgtttcgacggaccgttcggggccacgggtaacccttcggtccaccggttcctccgtacgacgtcccttacgaaaccgtaacgggcccacgttcccggtccttcccccgtggcccgtcccctcggaccgttccgacgggacgtcccaacccgtccggagaccgaccgaccgacggccggtcccgtgggtccctcgggacccgtcggtacaaacgggtacctttaacctttccgacttccctaacaacgttccgaggacggtccgggtctacgggacgtaaacgggccgacgagtagcgnagcgnngcgcgtgcgacgcgngcgcgtctcgtacgtcgtcgtacacgtcacncgcgtacncatacncgngtcg

SEQ ID NO: 55610 - DNA, 545 bp, Homo sapiens
  misc_feature: GYAE6OF01CQ7E7.37.29.C07.1.454.CMB.1.raw
  modified_base (253)..(253): a, c, t, g, unknown or other
  misc_feature (253)..(253): n is a, c, g, or t
  modified_base (350)..(350): a, c, t, g, unknown or other
  misc_feature (350)..(350): n is a, c, g, or t
  modified_base (513)..(514): a, c, t, g, unknown or other
  misc_feature (513)..(514): n is a, c, g, or t
  modified_base (516)..(545): a, c, t, g, unknown or other
  misc_feature (516)..(545): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgacaaatgaacagcctgagagccgaggacacggccgtatattactgttacgaaagataggtactcgtggttcgacgtacttttttaangtccattctttgaccacgtggggccagggaccctggtccaccgtctcctcacgccctacccaccgaacgggccccagttccggtcccttccccccgnggcccgtccctgcctaccgagggacgccacccgtccggaagacgccaacgacggccggtccccgtgggcctcgaccgtggtacaaacggtccttaccgttccattcctaactacttacgtggacgggccgggtctacgggacgtaacggccgaacgagtgacnncnnnnnnnnnnnnnnnnnnnnnnnnnnnnnn

SEQ ID NO: 55611 - DNA, 702 bp, Homo sapiens
  misc_feature: GYAE6OF01EFTO8.37.29.C07.1.454.CMB.1.raw
  modified_base (265)..(265): a, c, t, g, unknown or other
  misc_feature (265)..(265): n is a, c, g, or t
  modified_base (666)..(666): a, c, t, g, unknown or other
  misc_feature (666)..(666): n is a, c, g, or t
  modified_base (668)..(670): a, c, t, g, unknown or other
  misc_feature (668)..(670): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (677)..(700): a, c, t, g, unknown or other
  misc_feature (677)..(700): n is a, c, g, or t
  modified_base (702)..(702): a, c, t, g, unknown or other
  misc_feature (702)..(702): n is a, c, g, or t
tcagtagtgtagatcacgaccggtgctcgatttagagtgctacgaaggggaagggggctgggagtgggtctcaggcattagtattgatggtgataccacatactacgcagactccgtgaagggccggtttaccatctccagagacaagtccaagaacacgctgtatctgacaaatgaaacagcctggagaggccgaggacgacggccgttaatattactgttacgaaagtataggtactcgttggttcgagtttaactttttaancgtcctattctttacgacctacggtcggggaccgaacggggtaaccccttggtaccctaccgttcctacctaccgaccgcccctaccccgaaccgaaccggggacccctacgtttcccgggtttcccccttccccccggtgggccccgtcccgttcgtcccgtacccggagggacctaccgaccccggttacccggaagtaccggaccgaacggcccgggtcccgggtccccggttggggacccttccgggtcccggttacgggtacggtaaaaccggtacccttttacccgtaacccttaacgtaccgttaaccctaaacccgtttacggtccgggaacgggggtcccgggggtaccttaacgggggaacccgaaggggtaccccgaagtaacggtagcngnnngcngncnnnnnnnnnnnnnnnnnnnnnnnngn

SEQ ID NO: 55612 - DNA, 462 bp, Homo sapiens
  misc_feature: GYAE6OF01B13MQ.37.29.C07.1.454.CMB.1.raw
  modified_base (250)..(250): a, c, t, g, unknown or other
  misc_feature (250)..(250): n is a, c, g, or t
  modified_base (448)..(462): a, c, t, g, unknown or other
  misc_feature (448)..(462): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgtacttttttaangtccatctttgaccactggggccagggaaccctggtcaccgtctcctcagcctccaccaagggccccatccggtccttcccccgtggccgccctgcctccagggacgccaccgtccgagacgcacagccggccctgggctgcctggtcaaggctacttccatctacactactgacggcgggctggcaaggcgcatagnnnnnnnnnnnnnnn

SEQ ID NO: 55613 - DNA, 770 bp, Homo sapiens
  misc_feature: GYAE6OF01C1CMO.37.29.C07.1.454.CMB.1.raw
  modified_base (707)..(707): a, c, t, g, unknown or other
  misc_feature (707)..(707): n is a, c, g, or t
  modified_base (717)..(717): a, c, t, g, unknown or other
  misc_feature (717)..(717): n is a, c, g, or t
  modified_base (722)..(722): a, c, t, g, unknown or other
  misc_feature (722)..(722): n is a, c, g, or t
  modified_base (727)..(727): a, c, t, g, unknown or other
  misc_feature (727)..(727): n is a, c, g, or t
  modified_base (729)..(729): a, c, t, g, unknown or other
  misc_feature (729)..(729): n is a, c, g, or t
  modified_base (733)..(733): a, c, t, g, unknown or other
  misc_feature (733)..(733): n is a, c, g, or t
  modified_base (739)..(739): a, c, t, g, unknown or other
  misc_feature (739)..(739): n is a, c, g, or t
  modified_base (743)..(744): a, c, t, g, unknown or other
  misc_feature (743)..(744): n is a, c, g, or t
  modified_base (746)..(746): a, c, t, g, unknown or other
  misc_feature (746)..(746): n is a, c, g, or t
  modified_base (753)..(753): a, c, t, g, unknown or other
  misc_feature (753)..(753): n is a, c, g, or t
  modified_base (758)..(760): a, c, t, g, unknown or other
  misc_feature (758)..(760): n is a, c, g, or t
  modified_base (764)..(764): a, c, t, g, unknown or other
  misc_feature (764)..(764): n is a, c, g, or t
  modified_base (768)..(768): a, c, t, g, unknown or other
  misc_feature (768)..(768): n is a, c, g, or t
tcagtagtgtagatcacgaccggtgctcgatttagagtgctacgaagggaaggggctggagtgggtctcaggcatttagtattgatggtgataccacatactacgcagactccgtgaacgggtccggtttaccatctccagagacaagtaccaagaacacgctgtatctgacaaatgaacagcctgagacgaccgagacaccggacgtattattacgtcgttacgaaaagtagttaggtaccttcgttcggttcggtaccgtttaaccttttttttaatcgttaccttatttcgttttacgaccgtaacggttccgggggaccgaacgggtacccgttggtaccctacccggttctaccctccaccgtccctaccgacccggtaacgggccctacggtcccggtttcccttaccccggtcggccctcccgtcgtccttacggaacggccgtaaccgaccccgttaccgaacggaccgaccgaaccgtaacggggccccggggttacccgtacggggtccccgtttaccgggaccccgggtttacgggttaacccgggaaaaccggtttaacccgtttaacccctttacccggttaaacgttaaccccttaaccgttaaacccgttttcggaaccgggggtacccgggtacccggggttaaccggccgggtaaacccgggaaggggtaccaaccggtttaaggtaacncgacgagcangcgcncgctncngagntatcgnagtnncncgagcgngtacnnncganctgngc

SEQ ID NO: 55614 - DNA, 606 bp, Homo sapiens
  misc_feature: GYAE6OF01DS39Q.37.29.C07.1.454.CMB.1.raw
  modified_base (257)..(257): a, c, t, g, unknown or other
  misc_feature (257)..(257): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (571)..(572): a, c, t, g, unknown or other
  misc_feature (571)..(572): n is a, c, g, or t
  modified_base (575)..(580): a, c, t, g, unknown or other
  misc_feature (575)..(580): n is a, c, g, or t
  modified_base (582)..(584): a, c, t, g, unknown or other
  misc_feature (582)..(584): n is a, c, g, or t
  modified_base (586)..(589): a, c, t, g, unknown or other
  misc_feature (586)..(589): n is a, c, g, or t
  modified_base (591)..(599): a, c, t, g, unknown or other
  misc_feature (591)..(599): n is a, c, g, or t
  modified_base (601)..(604): a, c, t, g, unknown or other
  misc_feature (601)..(604): n is a, c, g, or t
  modified_base (606)..(606): a, c, t, g, unknown or other
  misc_feature (606)..(606): n is a, c, g, or t
tcagtagtgtagatcacgaccggtgctcgatttagagtgctacgaagggaaggggctggagtgggtctcaggcattagtattgatggtgataccacatactacgcagactccgtgaagggtccggtttaccatctcagagacaagtccaagaacacgctgtatctgacaaatgaacagcctgagagccgaggacacggccgtatattactgttacgaaagagtaggtacttcgtggttcggacgttacttttttaangttcctattctttgaccgacgttgggggaccacgggaacccttggtccaacccgttctccctcacgccctcccaaccgaacggggcccctaagtcccggtttcccttcccccgtgggcccgccctcgtcctacccgaggaccgccacccgttccgagtacgacgacgacggccggcccgtgggtacctcggcccgttcgggtaccaaacgggtaccctttaacttccctaagttacctaacctcccgttaagtcggacgggtccgggcgtacgggtaaccgaggggtcccgactaacggttaacgcgntnacgnngannnnnngnnntnnnntnnnnnnnnncnnnngn

SEQ ID NO: 55615 - DNA, 437 bp, Homo sapiens
  misc_feature: GYAE6OF02IB2YA.37.29.C07.1.454.CMB.1.raw
  modified_base (249)..(249): a, c, t, g, unknown or other
  misc_feature (249)..(249): n is a, c, g, or t
  modified_base (347)..(347): a, c, t, g, unknown or other
  misc_feature (347)..(347): n is a, c, g, or t
  modified_base (432)..(437): a, c, t, g, unknown or other
  misc_feature (432)..(437): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgacttttttaangtccatctttgaccactggggccagggaaccctggtcaccgtctcctcagcctccaccaagggcccatcggtcttcccctggcgccctgcctccaggncacctccgagagcacagccggcctgggctgcctggtcaaggctacttccatctacactactgagcgggctggcaaggcgcatagnnnnnn

SEQ ID NO: 55616 - DNA, 496 bp, Homo sapiens
  misc_feature: GYAE6OF02GU31D.37.29.C07.1.454.CMB.1.raw
  modified_base (359)..(359): a, c, t, g, unknown or other
  misc_feature (359)..(359): n is a, c, g, or t
  modified_base (421)..(421): a, c, t, g, unknown or other
  misc_feature (421)..(421): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (453)..(454): a, c, t, g, unknown or other
  misc_feature (453)..(454): n is a, c, g, or t
  modified_base (457)..(457): a, c, t, g, unknown or other
  misc_feature (457)..(457): n is a, c, g, or t
  modified_base (459)..(460): a, c, t, g, unknown or other
  misc_feature (459)..(460): n is a, c, g, or t
  modified_base (465)..(468): a, c, t, g, unknown or other
  misc_feature (465)..(468): n is a, c, g, or t
  modified_base (471)..(476): a, c, t, g, unknown or other
  misc_feature (471)..(476): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (488)..(496): a, c, t, g, unknown or other
  misc_feature (488)..(496): n is a, c, g, or t
tcagtagtgtagatcacgaccggtgctcgatttagagtgctacgaagggaagggctggagtgggtcctcaggcattagtattgatggtgataccgacctatactacgcagactccggtgaagggccggtttaccatctccaggagacaagtccaagaacacggctgtatctgtccaaatgaacagcctgagagcccgaggacacggccgtatattactgttcgaaagatagggtactctggttcgcgactttttagcgtccatcttgaccatggggccaggaaccctggtcacgtctcctcagcctccaaccaggggcccagtccggtccttccccgggccgccctggcctccgagganccacctcgaagacgcacagccggaccttgggactgccgtggtacaaggctactcagtctacnctactgacgcggctggcaacgcganatagntnnacnannatgcnnnngannnnnngtgngngngngnnnnnnnnn

SEQ ID NO: 55617 - DNA, 423 bp, Homo sapiens
  misc_feature: GYAE6OF02HIMSK.37.29.C07.1.454.CMB.1.raw
  modified_base (420)..(423): a, c, t, g, unknown or other
  misc_feature (420)..(423): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattattgtgcgaaagaccccaacggtgaccacattggagcttttgacttctggggccaagggacaacggtcaccgtctcttcagcctccaccaagggcccatcggtcttccccctggcgccctgctccaggagcacctccgagagcacagcggccctgggctgcctggcaaggctacttccatctacactactgagcgggctggcaaggcgcatagnnnn

SEQ ID NO: 55618 - DNA, 481 bp, Homo sapiens
  misc_feature: GYAE6OF02G1UI8.37.29.C07.1.454.CMB.1.raw
  modified_base (251)..(251): a, c, t, g, unknown or other
  misc_feature (251)..(251): n is a, c, g, or t
  modified_base (300)..(300): a, c, t, g, unknown or other
  misc_feature (300)..(300): n is a, c, g, or t
  modified_base (432)..(432): a, c, t, g, unknown or other
  misc_feature (432)..(432): n is a, c, g, or t
  modified_base (459)..(481): a, c, t, g, unknown or other
  misc_feature (459)..(481): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatcctccagagacaagtccaagaacacgcttgtatctgctaaatgaacagcctgagagccgaggacacggccgtatattactgttcgaaagataggtactctggttcggctactttttaangtccattctttgaccactggggccagggaccctggtcaccgttctcctnagccctccaccgaagggcccagtccggtccttcccccgtggccgtccctgcctccgaggacgccacctccgagacgcacgagccgacctgggctcgcctggtacaaggaccttacttccatcctacactacngacggcggctggacaaggccatagtgnnnnnnnnnnnnnnnnnnnnnnn

SEQ ID NO: 55619 - DNA, 501 bp, Homo sapiens
  misc_feature: GYAE6OF02I7FHU.37.29.C07.1.454.CMB.1.raw
  modified_base (379)..(379): a, c, t, g, unknown or other
  misc_feature (379)..(379): n is a, c, g, or t
  modified_base (486)..(501): a, c, t, g, unknown or other
  misc_feature (486)..(501): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgtacttttttaatgtccattctttgaccactggggccagggaaccctggtcaccgtctcctcagcctccaccaagggccccattccggtccttccccccgtggcccgcccccttgcctcccgaggacgccaaccgtcccganacgccgtacacggccggcccgtgggctcggccctagggtccaaacgggtccttacttcccatccttaacgacttactgacggcgggctggacgaaggcgcagtagcnnnnnnnnnnnnnnnn

SEQ ID NO: 55620 - DNA, 466 bp, Homo sapiens
  misc_feature: GYAE6OF02IRISR.37.29.C07.1.454.CMB.1.raw
  modified_base (451)..(466): a, c, t, g, unknown or other
  misc_feature (451)..(466): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgtacttttttaatgtccatctttgaccactggggccagggaacccctggtcaccgtctccctcagccctccaccaagggcccatccggtccttccccctggccgccctgcctccgaggcgccaccctcgagagcaacacgccggcccgtgggctggcctggtcaaggactacttccatctacactactgagcgggctggcaaggcgacatacgnnnnnnnnnnnnnnnn

SEQ ID NO: 55621 - DNA, 443 bp, Homo sapiens
  misc_feature: GYAE6OF02GMI6R.37.29.C07.1.454.CMB.1.raw
  modified_base (251)..(251): a, c, t, g, unknown or other
  misc_feature (251)..(251): n is a, c, g, or t
  modified_base (333)..(333): a, c, t, g, unknown or other
  misc_feature (333)..(333): n is a, c, g, or t
  modified_base (437)..(443): a, c, t, g, unknown or other
  misc_feature (437)..(443): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaaagataggtactctggttcggcgtacttttttaangtccatctttgaccactggggccagggaaccctggtcaccgtctcctcagcctccaccaagggcccatcggtccttcccccnggccgccctgcctccaggagcacctccgagagcacagcggcctgggctgcctggtcaaggctacttccatctacactactgagcgggctggcaaggcgcatagnnnnnnn

SEQ ID NO: 55622 - DNA, 450 bp, Homo sapiens
  misc_feature: GYAE6OF02HK2F2.37.29.C07.1.454.CMB.1.raw
  modified_base (249)..(249): a, c, t, g, unknown or other
  misc_feature (249)..(249): n is a, c, g, or t
  modified_base (353)..(353): a, c, t, g, unknown or other
  misc_feature (353)..(353): n is a, c, g, or t
  modified_base (440)..(450): a, c, t, g, unknown or other
  misc_feature (440)..(450): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgacttttttaangtccatctttgaccactggggccaggggaaccctggtcaccgtctcctcagcctccaccaacgggcccatccggtcttccccctggccgccctgcctccagganccacctccgagagcacagcggcctggctgcctggcaaggactacttccatcacactactgagcgggctgggacaaggcgacagtagnnnnnnnnnnn

SEQ ID NO: 55623 - DNA, 500 bp, Homo sapiens
  misc_feature: GYAE6OF02FSX3V.37.29.C07.1.454.CMB.1.raw
  modified_base (249)..(249): a, c, t, g, unknown or other
  misc_feature (249)..(249): n is a, c, g, or t
  modified_base (476)..(476): a, c, t, g, unknown or other
  misc_feature (476)..(476): n is a, c, g, or t
  modified_base (481)..(500): a, c, t, g, unknown or other
  misc_feature (481)..(500): n is a, c, g, or t
tcagtagtgtagatcacgaccggtgctcgatttagagtgctacgaagggaaggggctggagtgggcgtcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgacttttttaangtccatctttgaccactggggccagggaaccctggtcaccgtctcctcacgccctccaccaagggccccagtccggttccttccccccgtgggccgcccctgcctccaggcgccaccgtccgagacgccacgaggcccggccctggggccttggcccttgggtaccaaaggccttaacctttcccattacctaacaccttactggacgcgggctgggacaagggccnatagnnnnnnnnnnnnnnnnnnnn

SEQ ID NO: 55624 - DNA, 554 bp, Homo sapiens
  misc_feature: GYAE6OF02ITIEL.37.29.C07.1.454.CMB.1.raw
  modified_base (532)..(554): a, c, t, g, unknown or other
  misc_feature (532)..(554): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaaacagcctgagagccgaggacacggccgtatattactgttacgaaagatagtactctggttcggcgtactttttaattgtcctatctttcgaccgactgggggccagggaacccgtcggtcaccgttcctccctcacgccctcccaaccgaacggggccccatccggttcccgttccccccgtcggccgtccccctcggtcctcccgaagggacgccaccccgtccggagacgaccacgacggccggcccgttgggactcgcccgtgggtacgaaacgggtaaccttccgtttacccagtcctaaccgtaacttcgtcggacgggcgggtcgtacggacgaacgggcggtctagtagcnnnnnnnnnnnnnnnnnnnnnnn

SEQ ID NO: 55625 - DNA, 635 bp, Homo sapiens
  misc_feature: GYAE6OF02FJ7HK.37.29.C07.1.454.CMB.1.raw
  modified_base (252)..(252): a, c, t, g, unknown or other
  misc_feature (252)..(252): n is a, c, g, or t
  modified_base (566)..(566): a, c, t, g, unknown or other
  misc_feature (566)..(566): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (591)..(591): a, c, t, g, unknown or other
  misc_feature (591)..(591): n is a, c, g, or t
  modified_base (594)..(594): a, c, t, g, unknown or other
  misc_feature (594)..(594): n is a, c, g, or t
  modified_base (597)..(598): a, c, t, g, unknown or other
  misc_feature (597)..(598): n is a, c, g, or t
  modified_base (603)..(603): a, c, t, g, unknown or other
  misc_feature (603)..(603): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (624)..(625): a, c, t, g, unknown or other
  misc_feature (624)..(625): n is a, c, g, or t
  modified_base (627)..(627): a, c, t, g, unknown or other
  misc_feature (627)..(627): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactcgttggttcggcgtacttttttaangtccatctttgaccacgtgggccaggaaccctggcaccgtctcctcagcctccaccgaagggcccctatccggttcccttcccccgcgggccgtcccctgccgtacccgaggacgccgtacccgtccgaacgacgaccaacgacggcccggtcccgtagggtctcggtccctcggggtaactaaaacgggtaccctttaaccgtttacccgaactttaccgttaaacccgtaacctttaaaccggtcggaacgggtcccggggtaccgtacgggtaacccggaaacgggtacccgaaccgtaaattaacgggancgtgactagacgagacgananacgnagntannacganacgacgngtncatgagagagnncncacacgcg

SEQ ID NO: 55626 - DNA, 514 bp, Homo sapiens
  misc_feature: GYAE6OF02FTXQW.37.29.C07.1.454.CMB.1.raw
  modified_base (252)..(252): a, c, t, g, unknown or other
  misc_feature (252)..(252): n is a, c, g, or t
  modified_base (374)..(374): a, c, t, g, unknown or other
  misc_feature (374)..(374): n is a, c, g, or t
  modified_base (483)..(483): a, c, t, g, unknown or other
  misc_feature (483)..(483): n is a, c, g, or t
  modified_base (488)..(490): a, c, t, g, unknown or other
  misc_feature (488)..(490): n is a, c, g, or t
  modified_base (492)..(514): a, c, t, g, unknown or other
  misc_feature (492)..(514): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaagaacacgctgtatctgacaaatgaacagcctgagagccgaggacacggccgtatattactgttacgaaagataggtactctggttcggcgtacttttttaangtccattctttcgaccacgtcggggccagggaacccctggtccaccgttctcctcagccctaccaccgaagggccccagtccggtcccttcccccgtggccgtccctgcctaccgagggtcncctaaccctccgagacgccacgacgccggcccgtgggctcgccgtggtacaacgggtaccttaccttccattcctacactactggacggcgggctggaccgaggccganagtannntnnnnnnnnnnnnnnnnnnnnnnn

SEQ ID NO: 55627 - DNA, 553 bp, Homo sapiens
  misc_feature: GYAE6OF02FXBA0.37.29.C07.1.454.CMB.1.raw
  modified_base (524)..(553): a, c, t, g, unknown or other
  misc_feature (524)..(553): n is a, c, g, or t
tcagtagtgtagatcacgaccggtgctcgatttagagtgctacgaagggaaggggctggagtgggtctcaggcattagtattgatggtgataccacatactacgcagactccgtgaagggccggtttaccatctccagagacaagtccaaagaacacgctgtatctgcaaatgaacagcctgagagccgaggacacggccttatattactgtgtgaagggacctctacgaccccttatagcagcggctggtcctggtactttgacgacgtggggccagggaaccctggtccaccgtctcctcacgccctaccaccgaacgggccacgtccggtccttccccctgggccgcccctcgcctccgaggcgccacccgtccggacgacgaccacgacggtccggcccgtggggtactcggcccgttgggtaccgaaacgggtaccttaaccttccgtaacttccgtaacctaccttacgtacggacgggtaccgggtacgtcggacgaacgggcctacgaaatgacgnnnnnnnnnnnnnnnnnnnnnnnnnnnnnn

SEQ ID NO: 55628 - DNA, 670 bp, Homo sapiens
  misc_feature: GYAE6OF02IMRIJ.37.29.C07.1.454.CMB.1.raw
  modified_base (379)..(379): a, c, t, g, unknown or other
  misc_feature (379)..(379): n is a, c, g, or t
  modified_base (611)..(611): a, c, t, g, unknown or other
  misc_feature (611)..(611): n is a, c, g, or t
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
  modified_base (626)..(627): a, c, t, g, unknown or other
  misc_feature (626)..(627): n is a, c, g, or t
  modified_base (631)..(631): a, c, t, g, unknown or other
  misc_feature (631)..(631): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (658)..(658): a, c, t, g, unknown or other
  misc_feature (658)..(658): n is a, c, g, or t
  modified_base (667)..(667): a, c, t, g, unknown or other
  misc_feature (667)..(667): n is a, c, g, or t
tcagtagtgtagatcacgaccggtgctcgatttagagtgctacgaagggaaggggctggagtgggtctcaggcattagtattgatggtgataccacatactacgcagactccgtgaagggtccggtttaccatctccagagacaagtccaagaacacgctgtatctgcaaatgaacagcctgagacgccgaggacacggccgttatattactgttacgaaagatacggtactcgttggttcgcgttacttttttatcgtcctattcgtttgacctacgtcgggaccgaacggtaaccctggtacctacccgttcctacctcacgtccctcccgaaccgtaacgggcccctacggttccggttacccccgtttcccccgnggacccgtccccgttggcccttacccggagggaccgacccgtaaccccgtaccggaacggacgtacccgaacgaccggtcccggacccggttggtcctcgggacccgtacgttaaccgaacggttaccttaccgttaccctactacttaacctacgtacgtaggccgggtacgggtcgtacggaccgtaaacggggtcctaaccgtaagtacgtcgagactcgactgactancgctcgngacgngcnngacncgcgtacgngncgactcgcgactcgtntgctacganacg

SEQ ID NO: 55629 - DNA, 824 bp, Homo sapiens
  misc_feature: GYAE6OF02GGGVA.37.29.C07.1.454.CMB.1.raw
  modified_base (733)..(733): a, c, t, g, unknown or other
  misc_feature (733)..(733): n is a, c, g, or t
  modified_base (747)..(747): a, c, t, g, unknown or other
  misc_feature (747)..(747): n is a, c, g, or t
  modified_base (750)..(750): a, c, t, g, unknown or other
  misc_feature (750)..(750): n is a, c, g, or t
  modified_base (757)..(757): a, c, t, g, unknown or other
  misc_feature (757)..(757): n is a, c, g, or t
  modified_base (761)..(761): a, c, t, g, unknown or other
  misc_feature (761)..(761): n is a, c, g, or t
  modified_base (763)..(763): a, c, t, g, unknown or other
  misc_feature (763)..(763): n is a, c, g, or t
  modified_base (774)..(774): a, c, t, g, unknown or other
  misc_feature (774)..(774): n is a, c, g, or t
tcagtagtgtagatcacgaccggtgctcgatttagagtgctacgaagggaagggctggagtgggtctcaggcattagtagtagtggtacttacatatactacgcagactcagtgagggccgattcaccatctccagacgacaacgccaagaactcactgtatctgacaaatgaacagcctgagacgccgaggaccacggctgtgtacttacgtggtacgccggaagacgtcccccttaccgacccttcgaaggtccgaacggtcgaacggtccggttggtaccgtttcggtacgggggcccgaaaccggggtaaccccgtcggttccctaaccccggttcccttaccccgtacctaaccggtcccccttacccgaaaccccggtaaccgggcccccttaacggttcccccggtttacccccgttttaccccccgggtccggtaccccccgttacccccgttacccgttaaccccgaaacggtaccgtaccccctaaccccggttccgggttaccggggggacctaacccgggtaccggtccccggggtacccccggttacggggtcccgttccggtacccggttaccgggtaacccgtaaacgggttaaccccttttaacccggtttacccctacgtttaacccgttaacccgtaaccgttacgtacgggtacgggtacccgggtacgtaccgggtaaccggaaccgggacccgacgtaacgttacgacgacncgtgacgtacgcgnacnagcgacncgcncnccacgtcgtancgtacgcgacgtacgtacgtacgtacgtacgacgacagtacgtcacgtac

SEQ ID NO: 55630 - DNA, 182 bp, Homo sapiens
  misc_feature: GYAE6OF01EQZFB.25.51.E07.1.454.CMB.1.raw
  modified_base (179)..(182): a, c, t, g, unknown or other
  misc_feature (179)..(182): n is a, c, g, or t
tcagactgtacagtcacgaccggtgctcgatttagcatactctacaacacacaaagggcccatcggtcttcccctggcgccctgctccaggagcacctccgagagcacagcggccctgggctgcctggtcaaggactacttccactgtacagtctgagcgggctggcaaggcgcatagnnnn

SEQ ID NO: 55631 - DNA, 491 bp, Homo sapiens
  misc_feature: GYAE6OF01CKRQ7.25.51.E07.1.454.CMB.1.raw
  modified_base (367)..(367): a, c, t, g, unknown or other
  misc_feature (367)..(367): n is a, c, g, or t
  modified_base (427)..(427): a, c, t, g, unknown or other
  misc_feature (427)..(427): n is a, c, g, or t
  modified_base (470)..(470): a, c, t, g, unknown or other
  misc_feature (470)..(470): n is a, c, g, or t
  modified_base (484)..(484): a, c, t, g, unknown or other
  misc_feature (484)..(484): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaaccaggggaaccccttaaatcctgatctacgatgcctcaatttggagcagggtccatcaaagttcactgaagtgatctgggacagtattttagttntccatcagcagcctgacaacctgaagtattttgctaacatatttctgtacaaccaatatnattcgtctccctcactacttttggccagggtaccaaggtgganatcaaacgtactgngctgcac

SEQ ID NO: 55632 - DNA, 489 bp, Homo sapiens
  misc_feature: GYAE6OF01AXV6I.25.51.E07.1.454.CMB.1.raw
  modified_base (202)..(202): a, c, t, g, unknown or other
  misc_feature (202)..(202): n is a, c, g, or t
tcagactgtacagtcacgaccggtgctcgatttagcatactctacaacacacaaaggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggcgagtcaggacattagtcactgtgtaaattggtatcaacagaaaccagggaaccccttaaactcctgatctacgatgcctccaatttggagcagggtccatcaaagttcactggaagtggatctggacagatttagttgtccatcagcagcctgcaacctgaagtattttgcaacatattctgtcacatatgattcgtctccctcactactttcggacctagggaccagggtggagatacaaacgtaactgtaggctgctacc

SEQ ID NO: 55633 - DNA, 565 bp, Homo sapiens
  misc_feature: GYAE6OF01CAFIL.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccaggggaaccccttaaactcctgatctacgatgcctcaatttggaggcagggtccatcaaagttcacgtggaagtggatcgtgggactagtattttagtttgtaccattcagcagcctgacaacctgaagtatttgactaactattatttctgttaccaacctaattatagtacttccgttcctccctacctacctaccgtttttcggacccgtaagggggtaccctaaggggtacgggtaagtaacgtaaccgaaaacggtaacgttcggtaggccttagacccgtaacccg

SEQ ID NO: 55634 - DNA, 536 bp, Homo sapiens
  misc_feature: GYAE6OF01CBSS9.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccaggggaaccccttaaactcctagatctacgatgcctccaatttggagcagggtcccatcaaagttcactggaagtggatctgggacagattttagttgtccatcagcagcctagcaacctgaatattttgactaactattatttctgtacaaccaatatgtatcgttctccctctactacgtttcggaccctagggggaccctaaagggtggaacgtagtaaccgaaaacggtaacctaggttgggacttggaccctaacccg

SEQ ID NO: 55635 - DNA, 499 bp, Homo sapiens
  misc_feature: GYAE6OF01AUIYN.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccaggggaaccccttaaactcctgatctacgatgcctccaatttggagcagggtcccatcaaagttcactggaagtggatctggacagtatttagtttgtccatcagcagcctgctaacctgaacgattttgcaacattatttctgtcacctaatatgattcgtctccctcactacttttggccaggggacccaagggtggagatacaaacgactgtaggctgctacg

SEQ ID NO: 55636 - DNA, 557 bp, Homo sapiens
  misc_feature: GYAE6OF01C2UNB.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcactgccaggcgagtcaggacattagtcactgtagtaaattggtatacaacagaaaccaacgggtaaccccttaactcctagactctacgatcgacctaccaagtttggaggacgtacgggtacccatacaaacgttcacgtggaagtgatcgtaggactagtattttagttgtccatcagacagtcctagacaacctgtaagtatttgactaactattactttctagttaccaactaatatgacttcgtacctcctctacttacgtttcggaccgtaggggtacctaagggtacggagtaacgtaaccgaaacgtacgtagtaggaccgtgccgtaaccg

SEQ ID NO: 55637 - DNA, 526 bp, Homo sapiens
  misc_feature: GYAE6OF01A977R.25.51.E07.1.454.CMB.1.raw
  modified_base (202)..(202): a, c, t, g, unknown or other
  misc_feature (202)..(202): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgganacagaatcaccatcacttgccaggcgagtcaggacattagtcactgtgtaaattggtatcaactagaaaccaggggaaccccttaaatcctagatctacgatgcctcaatttggaggcagggtcccatcaaagttcactggaagtggatctgggactagtattttagttgtcatcagcagcctgctaacctgtaacgtattttgactaacatttatttctgtaccaacctaatatgtattccgtctccctactactacttttcggaccgtaggggacctaagggtggtagactactaaacggtactggtacggctgcctaaccg

SEQ ID NO: 55638 - DNA, 545 bp, Homo sapiens
  misc_feature: GYAE6OF01D35D7.25.51.E07.1.454.CMB.1.raw
  modified_base (202)..(202): a, c, t, g, unknown or other
  misc_feature (202)..(202): n is a, c, g, or t
tcagactgtacagtcacgaccggtgctcgatttagcatactctacaacacacaaagggggcaggagtcagtcccaacgaggacacagcatggacatgagggtccctgctcagctcctgggctcctgctgctctggctctcaggtggcagatgtgacatccagatgacccagtctccatcctccctggctgcttctgtggganacagaatcaccatcacttgccaggcgagtcaggacattagtcactgtagtaaattggtatcaaacagaaaccgaggggaaccccttaaactcctagactctacgatcgcctaccaatttggaggcacgggtcccatacaaagttcaacgtggaagtggatcgtaggactagtattttagttgtcctatcagcagcctgcaactgaagtatttgactaacattatttactagtaccaacctaatactagtacttccgttaccttcccctactacctacgttttcggacccgtaggggacctaagggtaggagataccaaaacgtactggtaggctggcctaacg

SEQ ID NO: 55639 - DNA, 500 bp, Homo sapiens
  misc_feature: GYAE6OF01A1BCL.25.51.E07.1.454.CMB.1.raw
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
  modified_base (473)..(473): a, c, t, g, unknown or other
  misc_feature (473)..(473): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccaggggaaccccttaaactcctgatctacgatgcctccaatttggagcagggtcccatcaaagttcactggaagtggatctggacagtattttagtttgtccatcagcagcctgcaacctgaagtattttgcaacatatttctgtcaccatatnatcgtctccctntactacttttggcctaggggaccaaggtggagtanacaaacgtaactgtaggctgctaaccg

SEQ ID NO: 55640 - DNA, 569 bp, Homo sapiens
  misc_feature: GYAE6OF01ERCP3.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctgggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccgaggggaaccccttaaactcctgatctacgatgcctacctaattggaggcgacgggtcccatcaaagttcactggaagtggatcgtaggactagtattttagttgtccatcagcagcctgacaaccgtgaacgtatttgactaactattactttctagtccaactaatatgtacttcgttcctacccttctaccttaccgttttacgggacccgtaacgggggtacctaaaggggtacgggtaacgtaacgttaccgaaaaccggtacttacgggtaggtaccgttgccctaacccg

SEQ ID NO: 55641 - DNA, 542 bp, Homo sapiens
  misc_feature: GYAE6OF01CSDQ6.25.51.E07.1.454.CMB.1.raw
  modified_base (441)..(441): a, c, t, g, unknown or other
  misc_feature (441)..(441): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctcctggctgcttctgtgggagacagaatcaccatcacttgccaggcgagtcaggacattagtcactgtgtaaattggtatcaacaagaaaccagggaaccccttaaactcctgactctacgatcgacctcctaatttggaggcgacgggtcccagtacaaagttcacgtggaagtggatcgtaggactagtagttttagttcgtcctattcagctagtccgtgaccaaccgtgtaagtattttgactaactattatttcngtacaactatatgacttcgtcctcctctacttacgtttcgaccgtagggacctaagggtcggaagtacgtaacgaaacgtacgtgtaggactcgctaaccg

SEQ ID NO: 55642 - DNA, 518 bp, Homo sapiens
  misc_feature: GYAE6OF01BU2V9.25.51.E07.1.454.CMB.1.raw
  modified_base (203)..(203): a, c, t, g, unknown or other
  misc_feature (203)..(203): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggcgagtcaggacattagtcactgtgtaaattggtatcaacagaaaccaggggaaccccttaaactcctagatctacgatgcctccaatttggagcagggtcccatcaaagttcactggaagtggatcgtgggacagtattttagttgtcctatcagcagcctgcaacctgaagtattttgcaactattatttctgtcacctaatatgtattcgtctccctcactacgttttcggaccgtaggggacctaagggtggacgtactacgaaacgtactaggtggctgcctaaccg

SEQ ID NO: 55643 - DNA, 786 bp, Homo sapiens
  misc_feature: GYAE6OF01CLL64.25.51.E07.1.454.CMB.1.raw
  modified_base (204)..(204): a, c, t, g, unknown or other
  misc_feature (204)..(204): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatccctcctggctgcttctgtaggganacagaatcaccatcactcgccaggcgagtcaggacattagtcactgtagtaaattggtatacgaaacaacggaaaacccgtaacggggtaacccctttaaaactccgtacggaattacctaacgacttacgtaccccttaccgtaaagttttcgggacggtaccgtaacgggttacccctaattaccgtaaaacgtttccgaaacgttgggtaaagtggtaacgttccggtagggtacttaaggttagtttttagtttacgtaccctagtaccgacgtacgtacgtccgtacgtaccgtaactacgtaaagttactttttacgacttaaaccgttatttaacttttaccgttacgttaacctaacccgttaattaacgttacgttaacctttaccgttacccttaccccttaccttaaacccgtttacccgtttttacccggggaacccgggttaaaccgggggtaaacccggttaaagggggttaacgggtaaacggttaaccgttaaaacccggtaaaacccgggttaaaccggttacgggttacccggtaccggtttaaccggacccgtttaaacccgg

SEQ ID NO: 55644 - DNA, 586 bp, Homo sapiens
  misc_feature: GYAE6OF01AW5XI.25.51.E07.1.454.CMB.1.raw
  modified_base (203)..(203): a, c, t, g, unknown or other
  misc_feature (203)..(203): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggcgagtcaggacatagtcactgtgtaaattggtatcaacagaaaccaggggaacccctaaactcctgatctacgatgcctccaatttggaggcagggtccatcaaagttcacgtggaagtggatcgtggactagtattttagttgtctatcagcagcctgactaaccgtgtaagtattttcgactaactattatttcttacgtaccaacctaattatacgtaacttccgttccttaccccgtcctaaccgttaccgtttttacgggacccgttaacgggggtaacccgtaaaggggtcgggtaaacgtaacgtaaccgaaaacccggtaaacgtgggtacggtctacgcccgtaaacccg

SEQ ID NO: 55645 - DNA, 780 bp, Homo sapiens
  misc_feature: GYAE6OF01BSBJZ.25.51.E07.1.454.CMB.1.raw
  modified_base (203)..(203): a, c, t, g, unknown or other
  misc_feature (203)..(203): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggcgagtcgaggactattagtcactgtagtaaattggtatacaacaagaaaccgaacggggtaacccccttaaactcctagactacgtaacgatcgacccttaccgtaaagtttcgggaacggtccgtaacggggtccccaagttaccgtaaaacggtttcaaccgttagggtaaaggttcgggtaagttaccggttagggggtaacctaagggtttaacgtttttttaaggttttacgttacccttaacgttaccgtaacggtaccgtaaccggtacccgttacgtaacccgtaaacccgttaggtaaacgtttaacgttttttacggaacctaaaccgttaattttaacttttaccgttacgttaaccctaaaccttaaagttaacgttacggttaacctttacccgttcccttacccccttacctaacccgtttaaccgtttttaccgggaccccggtaacgggggtaacccgtaaggggttacggaacggtaaccgtaaccgaaaaccggttaacgttacgggtacggtaccttacggtacccgtaacccg

SEQ ID NO: 55646 - DNA, 564 bp, Homo sapiens
  misc_feature: GYAE6OF01BMW9K.25.51.E07.1.454.CMB.1.raw
  modified_base (204)..(204): a, c, t, g, unknown or other
  misc_feature (204)..(204): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtcctccatcctccctggctgcttctgtggganacagaatcaccatcacttgccaggcgagtcaggacattagtcactgtagtaaattggtatacaaacagaaaccgacgggaaccccttaaactcctagactctacgatcgcctacaatttggagccagggtcccaatcaaagttcacgtagaagtgatcgtaggactagtatttagttcgtctatcagcagcctagacaactgaatatttagactaactatatttctgtacctaacctaatacttgacttaccgtcctcccgtactaccgttacgttttcggaccgtaacggggtacctaagggtacggtaacgacgttaaccgaaaccgtaacgtcggttaacgcgttacgcctaacccg

SEQ ID NO: 55647 - DNA, 603 bp, Homo sapiens
  misc_feature: GYAE6OF01DUNYX.25.51.E07.1.454.CMB.1.raw
  modified_base (207)..(207): a, c, t, g, unknown or other
  misc_feature (207)..(207): n is a, c, g, or t
tcagactgtacagtcacgaccggtgctcgatttagcatactctacaacacacaaagggggcaggagtcagtcccaacgaggacacagcatggacatgagggtccctgctcagctcctgggctcctgctgctctggctctcaggtggcagatgtgacatccagatcgacccagtcctccatccctccctggctgtcttctggtggganacagaatccaccatcacttgccaggcgagtcaggacattagtctactgtagtaaattggtaatacaaacaacgaaaccgtaacgggtaaccccttaaactcctagactactacgatcgacctaccgtaagtttggaggtaccgacgggtacccagtacaaacgttcacgtaggaagtgagtcgtaggactagttagttttagttcgtacctagtacagctacgtcctagacctaacgtagtaagttactttacgacttaactactttacttccgtagtacctaaccgtaattacgtagtacttcgttcccttacctactacttacgttcgaccgtaacgggacctagggtacgacgtaaccgtaacgaaacgtacgtcggtagacctgcctaaccg

SEQ ID NO: 55648 - DNA, 684 bp, Homo sapiens
  misc_feature: GYAE6OF01BR3PP.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatcgacccagtcctccactccctccctggtctcgtccttgtggtgggacgacagaactcacctactctacgttcgccgaggccgtagcgaaggactagttagtcagtgtagtaaattggtaactacaaacgaacgaaaccgaacggtaaaccccttaaacgtcctagactcgtaagtactcgactaccgttaagttcggaggccgacggttaccagtacaagtctagtacggaagtcgtagtcggaggtaacagtttagttttaacgttcgtaccagtacgtacgtacgtacgtccgtagtaaccaacgttaggtaacgtttacgtttaaccgaacttaaccttaattttacgtttactacgtaaccttaaacgtatttaacgtaccggtaactttccttaccctcccttaaccgtacgttaaccggttttcggaacccggtaacgggttaaccgtaacgggaaggtaactaccgtaaaactaaccgggtacttcgggtacgaccgtacgtacccgtaacg

SEQ ID NO: 55649 - DNA, 534 bp, Homo sapiens
  misc_feature: GYAE6OF01B4QLV.25.51.E07.1.454.CMB.1.raw
  modified_base (203)..(203): a, c, t, g, unknown or other
  misc_feature (203)..(203): n is a, c, g, or t
  modified_base (433)..(433): a, c, t, g, unknown or other
  misc_feature (433)..(433): n is a, c, g, or t
  modified_base (455)..(455): a, c, t, g, unknown or other
  misc_feature (455)..(455): n is a, c, g, or t
  modified_base (499)..(499): a, c, t, g, unknown or other
  misc_feature (499)..(499): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggccgagtcaggacattagtcactgtgtaattggtatcaacagaaaccgacgggtaacccttaactctagtactctacgatcgcctacctaagtttcggaggcgacggggtcccagtactaagtcacgtaggagtgatcgtaggactagtattttagttacgtcctagtcagcagcctcgacaacctagaagttatttagactaactnttatttctagtcaacctatatnacttcgtcctccctctactacgtttcgaccgtacgggactaggngagactacgaaacgtacgtgtacggctcgctaccg

SEQ ID NO: 55650 - DNA, 558 bp, Homo sapiens
  misc_feature: GYAE6OF01DESSU.25.51.E07.1.454.CMB.1.raw
  modified_base (203)..(203): a, c, t, g, unknown or other
  misc_feature (203)..(203): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggcgagtcaggacattagtcactgtagtaaattggtatcaacagaaaccaggggaaccccttaaactcctagactctacgatgcctccaagtttggaggcacgggtccatacaaagttcacgtggaagtggatcgtggactagtattttagttgtcctatcagcagcctgacaacctagaagtattttgactaactattatttctagtacaacctaattatcgtattccgttacttccctactaccttacgtttcggcccgtaaggggaacccgtaagggtgggaacgtaacgttaccaaaacggtaacgttggtaggtcctgtccctaaccg

SEQ ID NO: 55651 - DNA, 603 bp, Homo sapiens
  misc_feature: GYAE6OF01B63DW.25.51.E07.1.454.CMB.1.raw
  modified_base (569)..(569): a, c, t, g, unknown or other
  misc_feature (569)..(569): n is a, c, g, or t
  modified_base (592)..(592): a, c, t, g, unknown or other
  misc_feature (592)..(592): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatccctccctggctgcttctgtgggagacagaatcaccatcacttgccaggcgagtcaggactattagtcactgtagtaaattggtatacaacaacgaaaccgacgggtaaccccttaaactcctagatctacgtatcgcctacctaagtttcggagtcgacgggtacccaagtaccgtaaaacgttcaacgtagggaacgttggatcggttagggaactaggttaagtttttacggtttcgtacctaagttacgaagaccgtacgtcctacgacctaaaccgttagtaacgttattttacgactaactatttacttactacgtaacctaatatacgtacgtctacctcctacctactacgttcgtcggacggtacggtacgtaggtacganacgtaacgaacgtcgtacggtancgacgtctacc

SEQ ID NO: 55652 - DNA, 573 bp, Homo sapiens
  misc_feature: GYAE6OF01BKL4R.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctggtgggagacagaatcaccatcacttgccaggcgagtcaggacattagtcactgtagtaaattggtatcaacagaaaccgaggggaaccccttaaactcctagactctacgtatgcctacaagtttggaggcgacggggtcccaagtcgtaaacgttcgaacgtagggaagtggtatcgtggactagtattttagttcgtcctatcgagcagtcctacgcaaccctagaacgtatttcgactaacgtattactttcctacggttccaacgtaatagtacgtacttccgtaccttccctactaccttacgttttcggaccgtacgggaccgtaagggtacggtacgactacgaaacgtaacgtgtaggctgctaaccg

SEQ ID NO: 55653 - DNA, 620 bp, Homo sapiens
  misc_feature: GYAE6OF01BEXO6.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctgggctcctgctgctctggctctcaggtggcagatgtgacatccagatgacccagtctccatcctcctggctgcttctgtgggagacagaatcaccatcacttgccaggcgagtcagactatagtcacgtgtagtaaattcggtatacaacaacggaaaccgaacgggtaaaccccttaaacgtcctagactctaacgatcgacctactaagtttaggacggcgtacgggtacctatacgaacgtcgacgtggtaaggtagactacggtaggtacgtagttagttttagttacgtactatacgacgactagtccgtagacctaacgttagaacgttatttacgactaactatttaattccgttagtacctaactagtacttacgtacgttcctaccttaccctacgtacttaccgtttccggaccggtaaaccggggtacgtaacgggtacggtactacgtaaaccgtaaacgtacgttcgggtaggaccctggcctaaacccg

SEQ ID NO: 55654 - DNA, 556 bp, Homo sapiens
  misc_feature: GYAE6OF01BA5FB.25.51.E07.1.454.CMB.1.raw
  modified_base (345)..(345): a, c, t, g, unknown or other
  misc_feature (345)..(345): n is a, c, g, or t
tcagactgtacagtcacgaccggtgctcgatttagcatactctacaacacacaaagggggcaggagtcagtcccaacgaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaagtggagtcccatcaaggttcagcggcngtggatcgtgggacagatttcatcctcaccatcagacagcctgccagcctgtaacgatttcgtcgactaaccgttattattgtactaactaagtttaacggtacttaccctcttccgttccgttaccgggcggggaacgggtacccgtaaggggtaggtacggaacgttacgaaaacccggtaacgttcggttaggcttggcccgtaaccg

SEQ ID NO: 55655 - DNA, 573 bp, Homo sapiens
  misc_feature: GYAE6OF01ASVK0.25.51.E07.1.454.CMB.1.raw
  modified_base (384)..(384): a, c, t, g, unknown or other
  misc_feature (384)..(384): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtagtaaattggtatacaacagaaaccgacgggtaaccccttaaactcctagatactacgatcgcctacctaagtttggacggcgacgggtccatacaagttcacgtgagtgatcgtaggactagtattttagttntcatcgagcagcctgactaaccgtgtaagtctttagactaactattactttctacgtacaacctaatattacgtacttccgtcctcccttataccttacgttttccggaccgtacggggtaacccgtaagggtacggaacgtacgtaaccgaaacggtaacgttaggtacggtcctggaccctaacccg

SEQ ID NO: 55656 - DNA, 666 bp, Homo sapiens
  misc_feature: GYAE6OF01CR97P.25.51.E07.1.454.CMB.1.raw
  modified_base (206)..(206): a, c, t, g, unknown or other
  misc_feature (206)..(206): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatcgacccagtctccatccctcctggctgcttcgtggtggganacagactcaccatcacttgccgaggcgtagtcgaaggtactagttacgtcactgtagttaaattggtaatacaacaacggaaaccgaacgggtaaaccccttaactccgtagtactcctaacgtactcggtacctacctaagtttcggacggtacgtaccggggtaccaacgtacgtaaacgttccgaacgtagggtaaggtcgtagtccggtagggtaactaggtttacgtttttacggttacgtacccgtagtacgtacggtccaacgtccgtacgacctaaccgtagttaacgttacgttttaccggaactaaacgttactttaactttccgtacgtacaaccttaagttactacgtacttaccgtaccttaccctactaccgttaccgttcggaacgtacgggaacgtaggtaggaacgtacgtacgaaacgtacgtacgtaggtctgtcctaacg

SEQ ID NO: 55657 - DNA, 629 bp, Homo sapiens
  misc_feature: GYAE6OF01CQ0H1.25.51.E07.1.454.CMB.1.raw
  modified_base (207)..(207): a, c, t, g, unknown or other
  misc_feature (207)..(207): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatcgacccagtctccatccctcctggctgtcttcgtggtggganacagaatcaccatcacttgccaggcgagtcaggactattagtcaacttgtagtaaattggtatacaacaacgaaaaccgacggggtaacccctttaaactccctagacgtactacgatcgtcctacctaagtttcggaggtccgacgggtacccagtactaaagtttcacgtaggaacgtggatcgtagggactagtattttagttgtcctagtcagacgacgccgtagacctaccgtagaacgttacttttacgactaactatttactttacgtacgtacctaactaagttacttgtaccttaccgttccttaccctacctacgttaccgtttcgggacccgtaacggggtaaccgtaggggtaggtaacgtaacgttaaccgtaaacggtaacgttcgggacgtccgtgaccgtaacccg

SEQ ID NO: 55658 - DNA, 578 bp, Homo sapiens
  misc_feature: GYAE6OF01DNXZH.25.51.E07.1.454.CMB.1.raw
  modified_base (207)..(207): a, c, t, g, unknown or other
  misc_feature (207)..(207): n is a, c, g, or t
  modified_base (418)..(418): a, c, t, g, unknown or other
  misc_feature (418)..(418): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgaccccagtctccatccctccctggcctgcttctggtggganacagaactcaccatcacttgccaggcgagtcaggacattagcactgtagtaaattggtatcaacaagaaaccaggggtaaccccttaaactcctagatctacgatcgacctcctaagtttggaggcgacgggtcccaatacaaagttcaacgtggaagtggatcgtggactagtattttagttcgtacatcagcagcctgacacctgaatnttttacgactaactattactttctgtacacctaattatgtacttccgttcctcccttactaccttcgtttacggacccgtacggggtaaccgtaagggttcggaaacgtaacgttaacccgaaaacggtacgttacggttaggccttgaccctaaacccg

SEQ ID NO: 55659 - DNA, 596 bp, Homo sapiens
  misc_feature: GYAE6OF01CGUOD.25.51.E07.1.454.CMB.1.raw
  modified_base (202)..(202): a, c, t, g, unknown or other
  misc_feature (202)..(202): n is a, c, g, or t
  modified_base (459)..(459): a, c, t, g, unknown or other
  misc_feature (459)..(459): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctcctggctgcttctgtggganacagaatccacatcactgccaggcgagtcaggacattagtcactgtagtaaattggtatacaacaagaaaccgacgggtaaccccttaaactcctagactctacgatcgcctactagtttggaggcgtacgggtcccatacgaaacgttcacgtaggtaagtggatcgtaggactagtattttagttctctatcagcagtcctgaccaaccgtgtaattatttcgactaactattatttctacgtcaactaatagtntactccgttcctcccctactaccgttacgttttccggacccgtaacggggtaaccctaaggggtacggtacggtaaccgtaaccgtaaaccggtaaccgtttacgggaccggttaccgtcggtacccgttaaacccg

SEQ ID NO: 55660 - DNA, 574 bp, Homo sapiens
  misc_feature: GYAE6OF01EEFSQ.25.51.E07.1.454.CMB.1.raw
  modified_base (203)..(203): a, c, t, g, unknown or other
  misc_feature (203)..(203): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggcgagtcaggacattagtcactgtagtaaattggtatcaacagaaaccgaggggtaaccccttaaactcctagatctacgatgcctcctaatttggaggcgacgggtcccatactaaagttcacgtggaagtggatcgtaggactagtacttttagttcgtacctatcagcagcctagacctaacctgaacgtattttcgactaactatttatttctagtaccaactaatatagtacttccgtccttacccttctaaccttcgttttcgggacccgtaaggggtaccctaagggtacggtaggaactacgaaaaccgtaacgttaggtaccggcttcgccgtaacccg

SEQ ID NO: 55661 - DNA, 824 bp, Homo sapiens
  misc_feature: GYAE6OF01DWRMC.25.51.E07.1.454.CMB.1.raw
  modified_base (209)..(209): a, c, t, g, unknown or other
  misc_feature (209)..(209): n is a, c, g, or t
tcagactgtacagtcacgaccggtgctcgatttagcatactctacaacacacaaagggggcaggagtcagtcccaacgaggacacagcatggacatgagggtccctgctcagctccgtggggctcctgctgctctggctctcgaggtggcagatgtgacatccagatcgacccagtctccatccctccgtggctgcttcgtggtggganacagactcaccatcactgaccaggcgagtcgaggacattagtactacgttgtagttaaattggtatacaaacgaacgaaaccgaacgggtaaaccccttaaactccgtagtactactaacggactcgtacctaaccgtaagtttacgggaacggtaccgtacggggtacccctaagtaaccgtaaaacggtttaccaaccggtaagggtaacggtacgggtaacgttcgggttaacgggggaaacctttaaggttttaacgtttttttaaacggttttacggttacccgttaaacgttccggtaacggtacccggtaaacgttcccgttaacggtaacccgttaaaccccgttaagggttaaaacgtttaacgtttttacggaaaccctttaaaaccttaacgttttaacttttacccgttaacggttaacccttaaacccgttaaatttacgttaacggtacctttacccggttaccccttacccttaaccgtaccgtttaacccggtttacggaaacccgggtaacgggggtaaaccgttaaacggggttacgaaacggtaaccgtaaacgtaaaccggtaacttagggacgtaccgtacgtaccgtaacccg

SEQ ID NO: 55662 - DNA, 609 bp, Homo sapiens
  misc_feature: GYAE6OF01D6MY7.25.51.E07.1.454.CMB.1.raw
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttcgtggtgggagacagaatcaccatcacttgccaggcgagtcaggacattagtcactgtagtaaattggtatcaacagaaaccgaggggtaaccccttaaactcctagactctacgatcgctaccaagtttggacggcgagggtccccatactaagtcacgtggaatggatcgnggactagtattttagtntccatcagctagcctagacaaccgtgaagttntttcgactaacgtatttaatttctacgttacaaccctaagttaacttcgtaattccctaccttcccccgtactaaccgtttaaccgttttcgggaaccccggtagggggtaaaccccgtaaggggttacgggtaagtaaccgtaacctaaaacggtaaccgttaggttcggaacctccggtacctaaacccgg

SEQ ID NO: 55663 - DNA, 754 bp, Homo sapiens
  misc_feature: GYAE6OF01BU66T.25.51.E07.1.454.CMB.1.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatccctccctggctgcttcgtggtggganacagaactcacctntcacttgccgaggcgagtcaggactattagtcactgtagtaattggtatacaacacgaaaccgacgggtaacccttaactctagactctacgatacgtacctaccgtaagtttcgggacggtaccggtacgggtccctaagtaccgtaaacgttcaacgttagggtaacggtaggtacgttacggtaggggtaactaggtttaagtttttacggtttacgtacctacgtttacgaggtaccgtacggtcccttaacggtaacccgttaaacccgttaaggtaaacgttttacgttttaacggaacccttaaacgttaacttttaacgtttaccgttaaccgttaacctaaacccctttaaagttacgttaaccggtaaccttttacccgttaccccgttaccccttaaccgttaacccgttttacggttttacccgggaacccgggtaacggggtaacccgtaaggggttcggaaacgttaaccgtaaacgtaaacggtacgttacggtacggtacgtcgtaccgttaaacccg

SEQ ID NO: 55664 - DNA, 640 bp, Homo sapiens
  misc_feature: GYAE6OF01DPA1E.25.51.E07.1.454.CMB.1.raw
  modified_base (209)..(209): a, c, t, g, unknown or other
  misc_feature (209)..(209): n is a, c, g, or t
tcagactgtacagtcacgaccggtgctcgatttagcatactctacaacacacaaagggggcaggagtcagtcccaacgaggacacagcatggacatgacgggtccctgctcagctccgtgggctcctgctgctctggctctcaggtggcagatgtgacatccagatcgacccagtcctccatcctccctggctgtcttcgtggtggganacagactcactatcacttgaccaggcgagtcaggactattagctactgtacgttaagttggtatacaaacgaacgaaaccgaacggggtaaaccccttaaactccgtagactactacgacgtcgtacctacgtaagtttcgggacggtacggtacgggtccaagtacgtaaacgttacgtacgtaggaacgttacggacgtcgtaggacgttagttacgtttttacgttgtacctaagtccgaagtctaacgtccgtacgacctaacgttagtaacgttactttacgactaactacgtttatttccgtacgtactaacgtattacgtactacttccgttcttccctacgtaccgttacgttcggaccgacgggtaacgtaggacggtactaacgtaaccgaacgtaaccggttgtaccgctacgctaaccg

SEQ ID NO: 55665 - DNA, 663 bp, Homo sapiens
  misc_feature: GYAE6OF01CATN3.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcgaggtggccaggatgtgacatccagatcgacccagtcctccactcctccctggctgtcttctggtcggagacagactccacctatcacttgccaggcgagtcgaggacattagcactgtagtaaattggatacaacaacgaaccgaacgggtaacccttaaacgtcctagtactacgtacgtactcgtacctaccaagttttcggacgtaccgtacggggtacccagtaccgtaaagtccgtaacgtaggtaacgtagggtactacggtggtaactaggttaacgtttttacggttacgtaccgtagttacgtacgtactacggtaccgtacgtactaaaccctgtaaacgtttactttacgaactaacggtattttcgtttactagtccaaccgttattactagtaccttccttacccgttctactacgttaccgtttcggaaccggtacggaaccggttaggacggtaacgtagttaacccgaacggttaacgtaggtccgacgttccggaacctaaccg

SEQ ID NO: 55666 - DNA, 659 bp, Homo sapiens
  misc_feature: GYAE6OF01BSEMF.25.51.E07.1.454.CMB.1.raw
  modified_base (364)..(364): a, c, t, g, unknown or other
  misc_feature (364)..(364): n is a, c, g, or t
  modified_base (438)..(438): a, c, t, g, unknown or other
  misc_feature (438)..(438): n is a, c, g, or t
  modified_base (449)..(449): a, c, t, g, unknown or other
  misc_feature (449)..(449): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcgagggtggcagatgtgacatccagatcgacccagtcctccactccctccctgtctgctatcgtggttaggagacagagtccaccatcacgttcggccgggcgagtcgagggtctagtttaggaaaatttgttggccttaggtatcagtacgaaacggaaacccgtagggtaaacctttccctaaccgttcctatacgtctatcgctagctactcctacgtttnacgttacgttcgggtccctatcgtatcgagcggtgtaggtcggtacgtggactagtacttcacgttcacactanccgagcgtacnccgtacggctacggaccgtagaaggttccgttagttacgtaacttaaaccgtttattaaccgttacgtaaacttaaacggtttcgaacggttacggttacccggtaccggttaggttaccgttaccggggttacccggaaccccgggtaaggaaacccggttaagtaccgggtactaaccggttaaccggaaaaccgtgtccgggtaacg

SEQ ID NO: 55667 - DNA, 748 bp, Homo sapiens
  misc_feature: GYAE6OF01EPXGH.25.51.E07.1.454.CMB.1.raw
  modified_base (200)..(200): a, c, t, g, unknown or other
  misc_feature (200)..(200): n is a, c, g, or t
tcagactgtacagtcacgaccggtgctcgatttagcatactctacaacacacaaaggggcaggagtcagtcccaacgaggacacagcatggacatgaggtccctgctcagctcctgggctcctgctgctctggctctcaggtggcagatgtagacatccagatgacccagtctccatcctcctggctgcttctgtggganacagaatcaccatcacttgcctaggcgaagtcaggactattacgtactactgtacgtaaattggtatacgaaacacgaaaccgacggggtaacccttaaacgtccgtagacgttctaacgaagttcggtacccttaccgtaagtttcgggaacggtacgtaacggggtacccctaagttacgtaaaacgttcgaacgtagggtaacggtggtaacgttcgtagggtaaccttaggttaacgtttttacgtttcgtaccctagttacgaacgtcgtaacgtcctacggtacctaaacccgttgtaaacgttacttttcggaactacgtaactttacgtttcgtacggttaccaacgttaaagttacgttacgttaacgttcccggttacccttacccttaccgtaaacccgttaccgttttaaccggggaaccggttaaccgggggtaaacctaaaggggttaccggtaaacgtaaccgttaacccggtaaaaacggttaaccgggttaacgtttacggggtacccgttaacgtacccgttaaacccgg

SEQ ID NO: 55668 - DNA, 720 bp, Homo sapiens
  misc_feature: GYAE6OF01ABYV2.25.51.E07.1.454.CMB.1.raw
tcagactgtacagtcacgaccggtgctcgatttagcatactctacaacacacaaaggggcaggagtcagtcccaacgaggacacagcatggacatgagggtccctgctcagctcctgggctcctgctgctctggctctcaggtgcagatgtgacatccagatcgacccagtctccatcctcctggctgcttctgtgggatacagatcaccattcacttgccaggtcgagtcgaggacattacgtacaccttgtacgtaaagttcggtactacaaacaacggaaacccgtaacggggtaaccccttaaacgtccgtagactactaacgtactacggaccttcccgtaaagttttcgggaacggtccgtaacggggtccccaacgttacgaaacggtttcctaacggtcggtaaaggtggtacttaccggtaggtactaacggtaacgtttttaacggtttcgttaccgaacttcgtagacctacgccgttacgaccgtaaccgtagttaacggtacttttaggaccctaatacgtttatttaccgtagttaccctaacttaactacgttacgtaacgtttcccgttaacctcccgttaacccgttacttaccggtttttacggaaccccggttaacggggtacccgtaaggttacggggaaccttacgtaacccgtaaaacggtaccttcgggtaaccgtcgggtaactcccgtaaacccg

SEQ ID NO: 55669 - DNA, 641 bp, Homo sapiens
  misc_feature: GYAE6OF01DBHZZ.25.51.E07.1.454.CMB.1.raw
  modified_base (196)..(196): a, c, t, g, unknown or other
  misc_feature (196)..(196): n is a, c, g, or t
tcagactgtacagtcacgaccggtgctcgatttagcatactctacaacacacaaagggggcaggagtcagtcccaacgaggacacagcatggacatgagggtccctgctcagctccgtggggctcctgctgctctggctctcaggtggcagatgtgacatccagatgacccagtctccatcctcctggctgcttcnggtggagacagaatcaccatcactgccaggcgagtcaggactattagtctactgtagtaaattggtatacaacaacgaaaccgtacgggtaacccctaaactcctagactactaacgatcgtacctaccgtaagtttcggaggcgtaacgggtaccctaagtaccgaaagtttccgaagttagggaaagtggaactcgtagggactagttattttagttcgtccaatccagcacgcctagactaactagaagtatttcgactaactagttatttcacgttaccaacctaatagtcgtaacttcgtacctccctacgtaacccttacgttttccgggaacccttaagggggaacccctaaaggggtaccggtaaacgtaacgttaaacccggaaaacccggttaaacttcgggttaaccggactttacccggacccttaaacccgg

SEQ ID NO: 55670 - DNA, 777 bp, Homo sapiens
  misc_feature: GYAE6OF01ETCY4.25.51.E07.1.454.CMB.1.raw
  modified_base (212)..(212): a, c, t, g, unknown or other
  misc_feature (212)..(212): n is a, c, g, or t
tcagactgtacagtcacgaccggtgctcgatttagcatactctacaacacacaaagggggcaggagtcagtcccaacgaggacacagcatggacatgaggtccctgctcagctcctggggctcctgctgctctggctctcgaggtggcagatgtgacatcccagatcgaacccagtcctccatccctccctggcctgtcttcgtggtggganacagaactccaaccatctacttcgccagggccgagtcgaaggactattacgtcctaacgttggttaagttaaaattgggtaacttaccgaaacgaaacggaaaaccccggtaaccggggtaaaacccccctttaaaaccgtccgtacggtacttaccgtaacgtacgtccgtacccttacccgtaaagtttcggggaaccggtaccggtaaccggggttacccctaagttaaccgtaaaacgttaccgtaaccgttaaggggtaaacgtcgggtaacgttccggtaaggggtaaccttaaagggttttaacgtttttacggtttacgtacccttaagttaccgtaaggtacccgtaccggtacccgtcggtaacctaaacccgttagtaaacgtttatttaccgaactaacgttatttactttgtaccgtacctaaccgtaagttattacgtacttccgttaccccttaccctacgttaaccgttaccggtttccggaccggttaacggggtaccctaaggggtgaacgtactaacgaaaccgtgtacgtacgcttcgactaccg

SEQ ID NO: 55671 - DNA, 674 bp, Homo sapiens
  misc_feature: GYAE6OF01BDMXW.25.51.E07.1.454.CMB.1.raw
  modified_base (205)..(205): a, c, t, g, unknown or other
  misc_feature (205)..(205): n is a, c, g, or t
  modified_base (667)..(667): a, c, t, g, unknown or other
  misc_feature (667)..(667): n is a, c, g, or t
tcagactgtacagtcacgaccggtgctcgatttagcatactctacaacacacaaagggggcaggagtcagtcccaacgaggacacagcatggacatgaggtccctgctcagctcctggggctcctgctgctctggctctcaggtggcagatgtgacatccagatcgacccagtctccatccctccctggctcgcttctgtggganacagaactccaccatctacgttgccgaggcgagtcgaggtactattagtcctacgttagtagttaaaagtttcggtaataccgaaaccgaacggtaaaacccgtaaccgggggttaaaacccccttaaaccgttacccttaggtacttaccgttaaccggaacgttaccgtacccttacccgtaaaggttttacgggacggtaccgtaaccggggttaccctaacgttaaccgtaaacggtttccaccgttaagggaacggttcggtagtcgtagggtactaggtttacgttttagttgtaccctagttcagtcacgtctcgtaacctacgtagtaagttatttacgacctaacgtattactttactacgtaactaactaatactagtacgttacctcctcctactacctacgtttcgacgtacggacgtaggtacgagacgtaacgaagtacgtgacgtcncgctacg

SEQ ID NO: 55672 - DNA, 768 bp, Homo sapiens
  misc_feature: GYAE6OF01BEICO.25.51.E07.1.454.CMB.1.raw
  modified_base (157)..(157): a, c, t, g, unknown or other
  misc_feature (157)..(157): n is a, c, g, or t
  modified_base (265)..(265): a, c, t, g, unknown or other
  misc_feature (265)..(265): n is a, c, g, or t
tcagactgtacagtcacgaccggtgctcgatttagcatactctacaacacacaaagggggcaggagtcagtcccaacgaggacacagcatggacatgagggtccctgctcagctcctgggctcctgctgctctgctctcaggtggcagatgtgaacntccagatcgacccagttcctccacttccctcctggcttgctttcgtggtggagacagaatccacctatctacttggccgaaggcgagtcgaaggtacctattcgtacncgttaggttagttaaaagtttggtaacttaccgaaaacgaaacggaaaacccggtaaaccggggttaaaccccctttaaaactcccggtaataacttaccgtaacggtacttacgtcccccgttaagtaaacggttttcggaacggtccggtaacgggttaccccaagttaacctaaagtttaccgaggttaaggtaacggtaggtacgttacggtaaggaaccgttagtttaacggttttttacgtttccggtactaccggttagaccgtacgtaccgtaaccgtacgtaccgtaaacttaggtaaacgtttactttaacgacccttaaatattttttcccgttattaccgtaccgtaacttaactaggttaccttaacttcccggtttaccctacgttacctacggtttaacgtttcgacccgggttaacgggacgttaaagggtgtaacgttaacgtaacgtaaacggtccgttaggtacgacgtacccgttcaaacccg

SEQ ID NO: 55673 - DNA, 709 bp, Homo sapiens
  misc_feature: GYAE6OF01BOUYV.25.51.E07.1.454.CMB.1.raw
  modified_base (207)..(207): a, c, t, g, unknown or other
  misc_feature (207)..(207): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatcgacccagtcctccactcctccctggctgcttctggtggganacagaatcaccatcacttgccaggcgagtcgaaggactagttacgtctagtgttagttaaatttggtactacaaacgaacggaaaccgtaaccggggtaaaccccttaaactcctagtactactacgatcgtacctacctaagtttcgggacggtcgacgggtcccaagttacgtaaagttcgacgtaggtaacgtacgggtacttcggtaggtaactagtttacgtttttacgtttcgtaccgtaagtcgtagtcctacggtaccttacggaccttaaaccgtacggttaaacgtttagtttaccgaaccttaacttaacgtttacttttacgtaccttaaccgaaaccgttatacgttacgtaacgtttccttacccgttacccttaccgttaaccgtttaccggtttaccgggaacccggtaacggggtaacctaagggttacggaacgtaccgtaaccgtaaacgtacggtacggttagaccgttcgacccgttaacg

SEQ ID NO: 55674 - DNA, 758 bp, Homo sapiens
  misc_feature: GYAE6OF01BK8KZ.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctgggctcctgctgctctggctctcgaggtggcagatgtgacatccagatcgacccagtcctccactccctccgtggctcgtcttacgtggtagggactacgagtaactccacctatctacgttcgccgaggcgtacgtcgaacggtactacgttacgtcctacgttagtagttaaagttggtaactaccgaaacgaacggaaaaccccggtaaccggggtaaaacccctttaacctccgtaggtaccttacgtaaccgattaccgacccttaccgttaacggtttagggaccggcgtaacggggtacccctaagtaaccgtaaagttccaaggtagggtaagtcggtaacttcgggtaaggacgtaagtttagttttacgtttactacgtacgttacgtacgtacgacgtaccacgtaacctaacccgttaagtaacgtttacgtttacgaaactaactttagttaccgttttacgtacgtaacctaacttaagttacgttagttaccttcccgttaccttacccgtacttaaccgtttacgtttacgggaacccgtacggggaacccgttaagggtacgtaaccggtaacgtaacggtaaaacccgttcggtacgttacgggccctacgtccgttaacccg

SEQ ID NO: 55675 - DNA, 643 bp, Homo sapiens
  misc_feature: GYAE6OF01BZ51S.25.51.E07.1.454.CMB.1.raw
  modified_base (543)..(543): a, c, t, g, unknown or other
  misc_feature (543)..(543): n is a, c, g, or t
  modified_base (566)..(566): a, c, t, g, unknown or other
  misc_feature (566)..(566): n is a, c, g, or t
  modified_base (627)..(627): a, c, t, g, unknown or other
  misc_feature (627)..(627): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatcgaccctagtcctccactccctccctggctgtcttctggtagggagacagaactccaccatcgacttgccgaggcgacgtcgaaggtactattagctacgttagtaagttaagttgtactacaaacgaacggaaacccgtaaccgggtaacccctaacctccgtagtaactaccgtaacgatcgtacccttacgtaagttggacgtcggtaccggtaccagtaacgtaaacgttcgaagtacgggagtaggtactcggtaagggtattagtttagttttagttaccgtaccgtatacgacgcctacgtccctagtaccctaacgtagtacgtttaacttcgaacttaattagtttattccgtataactaactaattanacgttactaccttcctacccttntaccttacgttcgggaacccgacgggtacgtagggaggtaactacgaacgtaaccgtacgnggtcctctagccctac

SEQ ID NO: 55676 - DNA, 687 bp, Homo sapiens
  misc_feature: GYAE6OF01EQXFL.25.51.E07.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (496)..(496): a, c, t, g, unknown or other
  misc_feature (496)..(496): n is a, c, g, or t
tcagactgtacagtcacgaccggtgctcgatttagcatactctacaacacacaaagggggcaggagtcagtcccaacgaggacacagcatggacatgaggtccctgctcagctcctgggctcctgctgctctggctcgtcaggtgcagatgtgacattccgagactgacccagtctccagttccctcctggctcgctttcgnggtaggganacagtaatccaccgatccgaattgaccaggcgacgcaggctattagtcatgtataattcggtatacaacanaaaccgacgggtaaccccttaactcgtanaactcgtanacttcgacctaccgttaagttggaacggccgacgggttaccccattacccgtaaagtttcgaaccgtagggtaagtaggtactaccggttagggaattagggtttacctttttaaggttcgttaccctattaccgtaggaccaggacccttacgctaaacccgttgaaacggtttnttttacggaacctaacggattttactttcgacctaacaaccggttaacgtaattcgtaacgttcccgttccctaaccctacgtttccctacccggttttaggaaccccggttacggggaaaccttaggggaacgttcgggaaacccttaacgaaacccgtaagttccgttaagcgtcccttacggtaaccc

SEQ ID NO: 55677 - DNA, 852 bp, Homo sapiens
  misc_feature: GYAE6OF01BEQKY.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatcgacccagtcctccactccctccctggcctgctttcgtggtagggacacagaactccaacccatcctaacgtttcgacccgaagggccgtagttaccgaagggtaactaagtttacggtactaacgttagttaagttaaaagtttgggttaacttaccgaaaaccgaaacggaaaaaccccggtaaccgggggttaaaaaccccctttaaaaccgttaccgttaacggtaacttaccgtaaccgtaagttccgtaccccgtttaccgtaaaggttttcgggaaccggtaccggtaaccggggttacccctaacgttacgtaaacggtttaccgaacgttaggggtaacggttacgggtaacgttcggtaacgggtaacgttaacggtttaacgttttttacggtttacgtacccgttaacgtccgtaacggtaccgtacggtacccttacggaaccctaaccgttaaggttaaacgtttagttttaacgaaccttaaacgttatttacgttttccgtacgttaaccctaaccgtaaattacgttacgtactttcccgtaccttaccccttacgtacgtttaccggtttcggaacccgggtaacggggtaaccgttaagggtacggtaaacgtacgttaaaccgtaaaccggtacggtttacggaccgggtcctaccgtcctaacccg

SEQ ID NO: 55678 - DNA, 726 bp, Homo sapiens
  misc_feature: GYAE6OF01E3U3B.25.51.E07.1.454.CMB.1.raw
  modified_base (176)..(176): a, c, t, g, unknown or other
  misc_feature (176)..(176): n is a, c, g, or t
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
tcagactgtacagtcacgaccggtgctcgatttagcatactctacaacacacaaagggggcaggagtcagtcccaacgaggacacagcatggacatgagggtccctgctcagctccgtgggctcctgctgctctggctcgtcaggtgcagatgtgacatccagatcgacccagtcnccactcctcccgtggctgcttcgnggtgganacagtaactccaacctatcctacgttgaccgagggtacgaacgtcaaggaactaacgttacgtacctaacgttgttaacgttaaagttacggtaactaacgaaaccgaaacggaaaaccggtaaccgggtaaaccccttaaacgtccgttagaactacgtaacgtactccgtacctacgtaaggttggaacggcggtaacgggtacctaactaacgtaaacgttcgaacgtagggtaacgtggtattccggaggtactagtttagtttagtttacgcctagtccaagtccacgtacctacggtaacctaaccgtagaatttactttacgaactaacgttatttacgttctacgtaccctaataacttagtactaacgttcccttaccctacccgttacgtaacctttacgggtttacccggaaaccgggtaacggggtaaaccttaaggggacgttaaacgtaaccgaaaaccgtaaacggttcgttacggtaccggacgtttacccggtataaacccg

SEQ ID NO: 55679 - DNA, 602 bp, Homo sapiens
  misc_feature: GYAE6OF01CEKZB.25.51.E07.1.454.CMB.1.raw
  modified_base (176)..(176): a, c, t, g, unknown or other
  misc_feature (176)..(176): n is a, c, g, or t
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
  modified_base (377)..(377): a, c, t, g, unknown or other
  misc_feature (377)..(377): n is a, c, g, or t
tcagactgtacagtcacgaccggtgctcgatttagcatactctacaacacacaaagggggcaggagtcagtcccaacgaggacacagcatggacatgagggtccctgctcagctcctgggctcctgctgcctctggctctcaggtggcagatgagacatccagatcgacccagtcnccatccctccctggctgcttcngtgganacagaactcacatcacgtgccaggcgagtcaggactatagtcaactgtagtaaattcggtaatacaacaagaaaccgacgggtaaccccttaaactccgtanactactacgatcncctactaagttggagacgacgggtaccagtacaagttacactgaagtgactgtcgganagtagtttagtcgtacatcgacgacagtcctagactaaccgtgtaaacggttcttttaggaactaacggttaatttctttacctacgttaccaaacctaacgttactagttaacctccttccctaccggtttccaaaccgtttcgttacggacccgtaaggggtaaccgtaagggtacggacgaacttaaccggaaacgtaacttcggaaggtccctggctaacg

SEQ ID NO: 55680 - DNA, 712 bp, Homo sapiens
  misc_feature: GYAE6OF01B9I1T.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatcgacccagtctccatcctccctggctgcttctggtgggagacagactcaccatcacttgccaggcgagtcaggactattagtctatgtagtaattggtatacaacaagaaaccgacggggaacccctttaaactccgtacgtactacgtacgatcgtaccctctaagtttcggacgaccggtacgggtccaagtacgtaaacgttcctaacgtacgggtaaggtcggacgtcggttagggaacgtacggtttaagtttttacggtttcgtactacgttcgtaacgtactacgtccttacgaaccgtaacctaggtaaacttaacgttttacgaacctaacgtaacttttaacgtttaccgtttacgtaacctaaacctaaattggttaaccttacgttacccgtttacccttacccgttaccctaaactttaccggttttacgggacccggtaacggggtaaaccccggtaaggggttaccggaaacttacggtaaaccgtaaaaccgtacggttacggtacgggtactaccggtaccttaaccccg

SEQ ID NO: 55681 - DNA, 653 bp, Homo sapiens
  misc_feature: GYAE6OF01CT2O6.25.51.E07.1.454.CMB.1.raw
tcagactgtacagtcacgaccggtgctcgatttagcatactctacaacacacaaagggggcaggagtcagtcccaacgaggacacagcatggacatccgagggtccctgctcagctcctgggctcctgctgctctggctctcaggtggcagatgtgacatccagatgacccagtctccatcctccctggctgcttctgtgggagacagatcaccatcactgccaggcgagtcaggacagttagtcactgtagtaattggtactacaacgaacgaaaccgaacgggtaacccttaacgtcctagtactactacgatcgacctacgtattggagcgacggtaccagtacaagtcacgtaggagtgacgtcgtaggactagttattttgttacgtctacgtagtacgtcgacgtccgtacgacgtaaccgttagtaacgttacgttttcgaaccttaacgttacttactttacgtacgtacctaacctaacttaacgtagtaccgttccgttacccgttacccttacccgttaacgtttacccggtttaccgggtacccggtaacggggtaaacccgtaagggttacgggtaaaccgtaaggtaacccgtaaaccggtacggttacggtacgggtccgtacggtacccgtaacccg

SEQ ID NO: 55682 - DNA, 629 bp, Homo sapiens
  misc_feature: GYAE6OF01EBNQO.25.51.E07.1.454.CMB.1.raw
  modified_base (60)..(60): a, c, t, g, unknown or other
  misc_feature (60)..(60): n is a, c, g, or t
  modified_base (177)..(177): a, c, t, g, unknown or other
  misc_feature (177)..(177): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
  modified_base (463)..(463): a, c, t, g, unknown or other
  misc_feature (463)..(463): n is a, c, g, or t
  modified_base (496)..(496): a, c, t, g, unknown or other
  misc_feature (496)..(496): n is a, c, g, or t
  modified_base (581)..(581): a, c, t, g, unknown or other
  misc_feature (581)..(581): n is a, c, g, or t
tcagactgtacagtcacgaccggtgctcgatttagcatactctacaacacacaaaggggnaggagtcagtcccaacgaggacacagcatggacatgagggtccctgctcagctcctgggctcctgcctgctctggcttctcaggtggcagatgtgacatccagtatcgacccagtcnccactcctccgtggctggtctttcgtggtgggacgacgagtaactccacactccgtattgacccgtaggccgtagtcgaaggtactagttacgcctagttgttaagttaacgttggtaactacgaaacgaaacggaaaccggtaccgggtaaaccccgtttaaagccgtagtactacgtacgatcgaccttacgtagttaggacggcgacggtaccagtactaagtnacgtagggactgagtcgtaggaatgtaatcctacgtcaccganatccgagccgtactanacctacgtgtataggtatttacgacttaacttnttacgacgtaccgaagtctaacgttaatttagtttcctgtttaaccgtcgttttaccgttcgggccggtaagggtcgtaggggtnttaagaccggttgaaacgggttccaacgggtctaacggcgtcgtaccc

SEQ ID NO: 55683 - DNA, 688 bp, Homo sapiens
  misc_feature: GYAE6OF01BR4JE.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctccgtggggctcctgctgctcgtggctctcaggtgcagatgtgacatccagtactcgaacctagtcctccactccctccgtggctcgtcttcgtggtggacgacagaactccacctagtctacgtcgccgaggcgagtacgacggtactacttagtcctagttgtaagttaagttcgtaatacgaaacgaacgaaaccggtaaccgggtaacccttaactcgtagactcgaacgtctctacctacgttaagtggaccggtaccgacggtacccagtaaaccgtaagttacgtaacggtaggaaggtcggtacgtacggtaaggtacctaaggtttagttttacgttcgtaccgtatacgcgtacgacgtccgtagtacgtacgtagttacgttagttcgaactaacttgttactttacgtacgtaactaacttaacgtattacgttacgttacccttccctaccgttaccttaacggttacccgtttcgggaacccgggtaacgggtacgtaaaggtacgggttaacaaccggttaaaccgaacgttcggtaggtaaccgcgtaccgtccggtac

SEQ ID NO: 55684 - DNA, 724 bp, Homo sapiens
  misc_feature: GYAE6OF01BYNE0.25.51.E07.1.454.CMB.1.raw
  modified_base (210)..(210): a, c, t, g, unknown or other
  misc_feature (210)..(210): n is a, c, g, or t
tcagactgtacagtcacgaccggtgctcgatttagcatactctacaacacacaaagggggcaggagtcagtcccaacgaggacacagcatggacatgagggtccctgctcagctcctgggctcctgctgctctggctctcagggtgcagatcgtgacagtccagatcgacccagtcctccatcctccctggctgtccttctggtgggaanacagaactccaccatcacttcgccgaggtcgagtcgaggactagttagacctatagtacgttaaattggtatacaaacgacgaaaacccgaacggggtaaaccccttaaacgtccgtagtactacgtacgactaccgacccttacgtaagtttcgggacggtaccggtacggggtacccaagttaacgtaaacggttacaaccggtagggtaacgtcggtacgtcggtaggggtaacttaggtttaacgtttttacggtttacggtacctaacgttacgaacgttaccgtaacggtccgtacggaacccgttaaaccgttagtaacgggtttaacttttacggaacctaaacgtttacttttaacgtttactaacgtacgtaaccttaattacgttacgtacttacccgttccttaccgtacttaccgttaccggtttcggaccggtaacgggtacgtagggtacgtaagacgttaaacgaacggtacgttacggtagacctacgcctaacccg

SEQ ID NO: 55685 - DNA, 694 bp, Homo sapiens
  misc_feature: GYAE6OF01AYLDW.25.51.E07.1.454.CMB.1.raw
  modified_base (340)..(340): a, c, t, g, unknown or other
  misc_feature (340)..(340): n is a, c, g, or t
  modified_base (507)..(507): a, c, t, g, unknown or other
  misc_feature (507)..(507): n is a, c, g, or t
tcagactgtacagtcacgaccggtgctcgatttagcatactctacaacacacaaagggggcaggagtcagtcccaacgaggacacagcatggacatgagggtccctgctcagctccgtggggctcctgctgctctggcctctcgaggtggcagatgtcgacatccagatcgacccagtctccactcccgtccctggctgtcttctggtcgggagaacagaactcaccagtctaccgtgccgaggcgagtcgaagactagttagtcgtactggttattaagttggtaacctacgaaacgaacggaaaaccccggtacgggtaaacccccttaacgtccgtntactcgtaacgatcgtaccctaccgtttaagttgggaccggtaccggtaaccgggttaacccaacgttaccgtaaaacgttccgtaagggttaacggtaaggtcgtaacgttccggtaacggggtacttaagttttaggttttacggtttaccgtacttacgttacncgtactacgctaacgtccgaacgttacgtacttagttcctactaacttatttactttactacgtctaacttattaccgtactaccgttcccgtccctcctaaccgttcttaccggttcggaccggtacgggccgttaagggcgtaagaccgttaacgaacgttacggagtaggcgtaccgccgtacg

SEQ ID NO: 55686 - DNA, 476 bp, Homo sapiens
  misc_feature: GYAE6OF02I4V1U.25.51.E07.1.454.CMB.1.raw
  modified_base (392)..(392): a, c, t, g, unknown or other
  misc_feature (392)..(392): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggcctgcttctgtgggagacagaatcaccatcacttgccaggcgagtcaggacattagtcactgtgtaaattggtatcaacagaaaccaggggaaccccttaaatcctagatctacgatgcctccaatttggagcagggtcccatcaaagttcactgaagtgatctgggacagtatttagttgtccatcagcagctgcaactgaantttgcaacatattctgtcaccatactgatcgtctcctcatctttgccagggccaaggtgagatacgaacgactgtggctgctac

SEQ ID NO: 55687 - DNA, 495 bp, Homo sapiens
  misc_feature: GYAE6OF02GIK5C.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccaggggaaccccttaaactcctagatctacgatgcctccaatttggaggcagggtcccatcaaagttcactggaagtggatctgggacagattttagtttgtcatcagcagcctgcaacctgaagtattttgactaacattatttctgtcacctaatatgatcgtctccctctactactttgcctagggaccaaggtgaagtactacaacgactgtgctgcac

SEQ ID NO: 55688 - DNA, 533 bp, Homo sapiens
  misc_feature: GYAE6OF02H50WV.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtggagacagaatcaccatcacttgccaggcgagtcaggacattagtcactgtgtaaattggtatcaaacagaaaccaggggaaccccttaaactcctagatctacgatgcctccaatttggagcagggtcccatcaaagttcactggaagtggatcgtgggacagtattttagtttgtcctatcagcacgcctgacaacctgaagtattttgactaactattatttctgtaccaacctaatatgtattccgtcttcccctatacctacttttcggcctaggggtaccaagggtggaacgtactactaaacgtacgtggtaggcttagactaacccg

SEQ ID NO: 55689 - DNA, 490 bp, Homo sapiens
  misc_feature: GYAE6OF02F7IY3.25.51.E07.1.454.CMB.1.raw
  modified_base (397)..(397): a, c, t, g, unknown or other
  misc_feature (397)..(397): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccaggggaacaccttaaactcctgatctacgatgcctccaatttggagcaggggtcccatcaaagtttcactggaagtggatctggacagattttagtttgtcatcagcagcctgcaacctgaagnttttgcaacattatttctgtcaccaatatgatcgtctccctcactacttttcggccaggggaccaaggtgagatcaaacgacctgtgctgacc

SEQ ID NO: 55690 - DNA, 507 bp, Homo sapiens
  misc_feature: GYAE6OF02IYPUV.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccaggggaaccccttaaactcctagatctacgatgcctcaattggagcagggtcccatcaaagttcactggaagtggatctgggacagaattcactctcacatcagcggcctgccaacctgatgtatttgctaactttattactgccagcagttaattaatttttactcttgtccgtttcctttggcctaggggtacctagggtgagacgagaagcgaacgtgtacggtctgtacc

SEQ ID NO: 55691 - DNA, 556 bp, Homo sapiens
  misc_feature: GYAE6OF02I2GUL.25.51.E07.1.454.CMB.1.raw
  modified_base (204)..(204): a, c, t, g, unknown or other
  misc_feature (204)..(204): n is a, c, g, or t
  modified_base (387)..(387): a, c, t, g, unknown or other
  misc_feature (387)..(387): n is a, c, g, or t
  modified_base (467)..(467): a, c, t, g, unknown or other
  misc_feature (467)..(467): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggcctgcttctgtggganacagaatcaccatcacttgccaggcgagtcaggacattagtcactgtgtaaattggtatcaacagaaaccaggggaaccccttaaactccctagatactacgatcgacctcctaatttggagcacgggtcccatacaaagttcactaggtaagtgatcgtggacagtattttagttgtccatnacgcagcctgactaacctgtaacgtattttagacttaacattactttctgtaccaacctaatatgattcgttctaccctntactacttttcggaccgacggggtaacctaagggtacggaattacgtaacgtaaaccggtacgttacggtaggtacctcgacctaaccg

SEQ ID NO: 55692 - DNA, 198 bp, Homo sapiens
  misc_feature: GYAE6OF02J1M15.25.51.E07.1.454.CMB.1.raw
  modified_base (178)..(198): a, c, t, g, unknown or other
  misc_feature (178)..(198): n is a, c, g, or t
tcagactgtacagtcacgaccggtgctcgatttagcatactctacaacacacaaaggcccatcggtcttcccctggcgccctgctccaggagcacctccgagagcacagcggccctgggctgcctggtcaaggctacttccactgtacagtctgagcgggctggcaaggcgcagtagnnnnnnnnnnnnnnnnnnnnn

SEQ ID NO: 55693 - DNA, 548 bp, Homo sapiens
  misc_feature: GYAE6OF02GDL03.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccaggggaacccttaaactcctgatctacgatgcctctaatttggagcagggtcccatcaagttcactaggaagtgatctagggacagaattcactctacaccatcagcggcctgacacctgatgtatttgctaatttatactgaccagtctaagttattaatttttactcttagttccgtttcccgtttggtcccgtaagggggtaccctaaggggttcgggaacggtacggtacgaacggtccggtaaaccggttggtacgggtactggtacccg

SEQ ID NO: 55694 - DNA, 486 bp, Homo sapiens
  misc_feature: GYAE6OF02HY45V.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccagggagagttcctaagctcctgatctatgctgcctcacgttacactcagggtcccatctcggttcagcgcagtgaatctgggacagagttcactctcactatcagcagcctgcagcctgaagatgtgctaacttattactgtacaaaagtataatactcgccctctcctacgtttcggacggtagggaccaagggtcgagactacaagtaacg

SEQ ID NO: 55695 - DNA, 579 bp, Homo sapiens
  misc_feature: GYAE6OF02GZ2VK.25.51.E07.1.454.CMB.1.raw
  modified_base (203)..(203): a, c, t, g, unknown or other
  misc_feature (203)..(203): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggcgagtcaggacattagtcactgtgtaaattggtatcaacagaaaccaggggaaccccttaaactcctagatctacgatcgcctacaatttggaggcagggtacccatacgaaagttcacgtaggaagtggatcgtgggacagtattttagttgtacctatcagcagcctgcaacctgaagtactttgactaactattattttactgttacaacctaattatagtacttcgttccttacccgtactacttaccgttttcggacccgtaacggggtaaccctaagggttacggtaacgtaacgttaccgtaaaaccggtacgttaggttacgggtaccttaggaccctaacccg

SEQ ID NO: 55696 - DNA, 608 bp, Homo sapiens
  misc_feature: GYAE6OF02HPK3L.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctgggctcctgctgctctggctctcaggtggcagatgtgacatccagatgacccagtctccatcctccctggctgcttctgtgggagacagaatcaccatcacttgccaggcgagtcaggacattagtcactgtagtaaattggtatcaacagaaaccgaacgggaaccccttaaactcctgactactacgactcgccctacctaagtttggacgccgtacgggtcccaagtacaaacgttcaacgtggaagtggtactcggtgggaactagttattttagtttgtacctagtacgagcacgcctagacctaaccgttagaaagttacgttttagacctaaactagtttactttccgttacgtacctaaccgtaaattacgtacgtaacttccgtaccttaccctactaacttccgtttacggaccggtacgggtaaccgtaagggtcgaacgtacgtaacgaaacgtacgtaggtacggtactcgacctacg

SEQ ID NO: 55697 - DNA, 596 bp, Homo sapiens
  misc_feature: GYAE6OF02J0SLJ.25.51.E07.1.454.CMB.1.raw
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (474)..(474): a, c, t, g, unknown or other
  misc_feature (474)..(474): n is a, c, g, or t
tcagactgtacagtcacgaccggtgctcgatttagcatactctacaacacacaaaggggcaggagtcagtcccaacgaggacacagcatggacatgaggtccctgctcagctcctgggctcctgctgctctggctctcaggtggcagatgtgacatccagatgacccagtctccatcctcctggctgcttctgtgganacngaatcaccatcacttgccagcgagtccaggacattacgtcacgtgtagttaaattggtataccaaacgacgaaaccgaacgggtaacccccttaaactcccgttagaacgttccgtaacgacttacgtaccctaccgtaaagtttcggacggactacgggtacccactacgtaaacgttcgaacgtacggtaaggtgtactcgtacgggactagttactttttaggttcgtctaagtcgtcgacgtacgtccttagacctaaccgtgaagttntttacgactaactttaacgtttctagtacctaactaatgtaagtctacgtcctaccgctattccgttcgacgtacggtctacggtgaaccgtatccgaaacgtctaggtgacgtgaccctag

SEQ ID NO: 55698 - DNA, 585 bp, Homo sapiens
  misc_feature: GYAE6OF02GHISJ.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctgtgggagacagaatcaccatcacttgccaggcgagtcaggacattagtcactgtgtaaattggtatcaacagaaaccaggggaaccccttaaactcctgatctacgatgcctcaatttggagcagggtccatcaagttcatggaagtgatcgtgggacagtattttagttgtcctatcagcagcctgacaacctgaagtattttcgactaactattattttcctagttaccaacctaaattactcgtaacttccgttacccttccccttacaacccttacgtttttcgggacccgtaacggggggtaaccctaaaggggtttcgggaacgttaacgttaaccgaaaaccggtacgttagggtaccgggtacgttacggacctaaacccg

SEQ ID NO: 55699 - DNA, 547 bp, Homo sapiens
  misc_feature: GYAE6OF02F2G9E.25.51.E07.1.454.CMB.1.raw
  modified_base (204)..(204): a, c, t, g, unknown or other
  misc_feature (204)..(204): n is a, c, g, or t
  modified_base (422)..(422): a, c, t, g, unknown or other
  misc_feature (422)..(422): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttctggtggganacagaatcacatcacttgccaggcgagtcaggacattagtcactgtataaattggtatcaacagaaaccaaggggaaccccttaaactcctagatctacgatcgcctactaatttggaggtcacgggtcccatcaaacgttcacgtggaagtgatcgtgggactagtatttagtttgtctatcagcagtcctgactaactgtaagttattagctaacntatttctgtcaactatatgacttcgtcctccgtcactacgtttacgccgtaaggggtaccctaaggtcggtaactacgttaaccgtaaacgaccgttaggtccggtacgttaccgactaacccgg

SEQ ID NO: 55700 - DNA, 643 bp, Homo sapiens
  misc_feature: GYAE6OF02GJC7O.25.51.E07.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
tcagactgtacagtcacgaccggtgctcgatttagcatactctacaacacacaaaggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggcgagtcaggacattagtcactgtgtaaattggtatacaacagaaaccgacggggaacccctttaaacncctagacttccgtaacgatcgcccttacctaaagtttcgggaagccgaacggggtccccaagttaccgaaaagtttccacgttaggaagtgggatcgtgggaactaggtatttttaggtttcgtacctaatccaagtctaagccctagaccaaacccgtgaagttacttttcggactaactattacttttactacgttaccaacgtaaagtactcgtaacttccgtaccttccccttactaaccttaccgtttttacgggacccgtaacggggtaacccgtaagggttacggaacgtaacgttaccgaaaaccggttacgtacggtacgtaccttacggacctaacccg

SEQ ID NO: 55701 - DNA, 654 bp, Homo sapiens
  misc_feature: GYAE6OF02H61OI.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatcgacccagtcctccatccctccctggctgcttcgtgtgggagacagaatcaccatcacttgaccgaggcgagtcaaggacattagtcaactgtagttaaattggtatacaaacaacgaaaccgaacggggtaaaccccctttaaactcctagactcgtaacgatcgacctactaagttggacggacgacgggtacccatactaaagttcacgtaggaagtgatcgtagggaactgttaagtttttagtttcgtactatacgtagctagtcctacgcctaaaccgtagtaacgttattttacgactaaacttactttactttctacgttaactaaccgttaattacgttcgggttaccttcccgttacccctacttaaccgttacgtttttaccggaccggtacggggtaaacccgtaagggtacgggaaacgtaacttaaccggaaaccgtaacgttcggtacggtaccgttacgacccgtacttaccg

SEQ ID NO: 55702 - DNA, 505 bp, Homo sapiens
  misc_feature: GYAE6OF02FHBCW.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgaccccagtctccatcctccctggctgcttctgtgggagacagaatcaccatcacttgccaggcgagtcaggacattagtcactgtgtaaattggtatcaacagaaaccagggaaccccttaaactcctgatctacgatgcctccaatttggagcagggtcccatcaaagttcacgtggaagtggatcgtagggactagtattttagtttgtcatcagcagcctgcaactgaagtatttgacaactatatttctgtaccactaatatgattccgtctccctcactactttgccgtacgggacgtaggtggagtatacgaacgactagtgcgtcgctaccg

SEQ ID NO: 55703 - DNA, 553 bp, Homo sapiens
  misc_feature: GYAE6OF02GTAI2.25.51.E07.1.454.CMB.1.raw
  modified_base (202)..(202): a, c, t, g, unknown or other
  misc_feature (202)..(202): n is a, c, g, or t
  modified_base (362)..(362): a, c, t, g, unknown or other
  misc_feature (362)..(362): n is a, c, g, or t
tcagactgtacagtcacgaccggtgctcgatttagcatactctacaacacacaaaggggcaggagtcagtcccaacgaggacacagcatggacatgagggtccctgctcagctcctggggctcctgctgctctggctctcaggtggcagatgtgacatccagatgacccagtctccatcctccctggctgcttctgtggganacagaatcaccatcacttgccaggtcgagtcaggacattagtcactgtgtaaattggtatcaacagaaaccgagggtaaccccttaaactcctagatctacgatcgcctaccaatttggagcgacgggtcccatcaaagttcacgtaggaacgtgatcgngggactagtattttagttgtcctatcagtcagcctgacctaacctgaagtattttacgactaactattatttctagtacaacctatatacgtacttccgtcctccctactactaccttttcggaccgtacgggtaccaagggtacgaagtactacgaaacgtacgttacggtacggctacggactaacccg

SEQ ID NO: 55704 - DNA, 654 bp, Homo sapiens
  misc_feature: GYAE6OF02JY69V.25.51.E07.1.454.CMB.1.raw
  modified_base (300)..(300): a, c, t, g, unknown or other
  misc_feature (300)..(300): n is a, c, g, or t
tcagactgtacagtcacgaccggtgctcgatttagcatactctacaacacacaaaggggcaggagtcagtcccaacgaggacacagcatggacatgagggtccctgctcagctcctggggctcctgctgctctggctctcaggtggcagatgtgacatccagatgacccagtctccatcctcctggctgtcttctgtgggacacagaatccaccatcacttgccaggcgagtcaggactattagtcactgtagtaattggtatacaacacgaaaccgacgggtaaccccttaactcgtanactctacgatcgtcctactaagtttggaggacgtacgggtacccagtaacgtaacgttcgaacgtaggtaacgtaggtactacggtagggtaactagttacgttttacgttacgttcctaagttaccgacggtcgtaacgtccgtacaccgtaactaggtaacgttagtttaccgaagtaactatttacttacgttacgttaacaacctaattacgtagttacgttaccgttaccctccgtaacgttacttaccgttaccgggtaccgtaacggggaaccggttaacggtagggtaaccgttaactaaccgtaaccggtacgttacggaccggtacgttaccggtacctaaccg

SEQ ID NO: 55705 - DNA, 700 bp, Homo sapiens
  misc_feature: GYAE6OF02J1AIZ.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctcctggctgcttctggtgggagacagaatcaccatcacttgccaggcgagtcaggacattagtcactgtagtaaattggtatacaacaacgaaaccgacggggtaaaccccttaaactccgtagactacgtacgatcgtacctacctaagtttggacgtcgtacgggtacccctaagtacctaaagttccaacgttagggaacgttggaacttacgtggggaacctaaggtaacttccgaacttcaccgtaacctaacttccgaaggtccgggtacctcggtaacctaaacccgttaggtaaccgttaggttaacttttacggaaccgttaaacttttaacgttaaccgtcggtacccgtaagtaccgtaagttttaacttttaaacgttttttaccgtaccgttacggtttaccgttttaccccgtttttggaaccggttacggggtaaccgttagggtacggtaacgtacgtacgtaacggtaccggtaacgttggtacggttaccgtcgtaacccg

SEQ ID NO: 55706 - DNA, 577 bp, Homo sapiens
  misc_feature: GYAE6OF02J1NFG.25.51.E07.1.454.CMB.1.raw
  modified_base (471)..(471): a, c, t, g, unknown or other
  misc_feature (471)..(471): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttcgtgtgggagacagaatccaccatcacttcgcctaggcgagtcaggactattagtcactgtagtaaattggtatcaacagaaccgacgggaaccccttaaactcctagactcgtacgatcgcctaccaatttcggacggtcgacgggtcccagtacaaagttcacgtaggaacgtgatcgtaggacgagttattttagttcgtcctaatcagtacagtcctagtacctaaccgtgtaagttatttgactaactattagttactgtacctactaagtntagacttcgtccttacctacgtacttacgtttaccggacgtacgggaccgtaagggttacgacgtaactaacgaaccgtacggtagtcggtacgtcgtacctaccg

SEQ ID NO: 55707 - DNA, 639 bp, Homo sapiens
  misc_feature: GYAE6OF02JZUJU.25.51.E07.1.454.CMB.1.raw
  modified_base (181)..(181): a, c, t, g, unknown or other
  misc_feature (181)..(181): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (631)..(631): a, c, t, g, unknown or other
  misc_feature (631)..(631): n is a, c, g, or t
tcagactgtacagtcacgaccggtgctcgatttagcatactctacaacacacaaaggggcaggagtcagtcccaacgaggacacagcatggacatgagggtccctgctcagctcctggggctcctgctgctctggctctcaggtggcagatgtgacatccagtatgacccagtcctaccgnttccctccgtggctgtccttnacggtgggatacngtaactcaccntccacgttncaaggtcggnacncgganagtagcacttgtataagttcttagacanagaaaccgaggaacccttacnctagacttcacggtctacgctacctagttacgacgctacggcctatacggtaattaccgagtaaggaggtttccaagtttcgacgggtaactaggtttccgtttagtttaaggtcctacgtagtacggcctaagtccgtacgtacaacggttacaagttacgtttacgacaaacgttctttaaattcgtttaaccgactaaccggttaagtttacacgttaacgtttcctacccttacggtaccttacgggtaaccttttcgacggtacggtaacccgttaggtacggtaagacggtttaccaaggttaaccgttgccgtaggtacccnttaacccg

SEQ ID NO: 55708 - DNA, 711 bp, Homo sapiens
  misc_feature: GYAE6OF02IQSO5.25.51.E07.1.454.CMB.1.raw
  modified_base (541)..(541): a, c, t, g, unknown or other
  misc_feature (541)..(541): n is a, c, g, or t
tcagactgtacagtcacgaccggtgctcgatttagcatactctacaacacacaaaggggcaggagtcagtcccaacgaggacacagcatggacatgagggtccctgctcagctcctgggctcctgctgctctggctctcaggtggcagatgtgacatccagatcgacccagtcctccacttccctcccgtggcctgtctttcgtggtgggactacagtaactccacctatcctactcgccaggcgagtacaggactagttacgtcaccgttgtagttaaagttgtataccgaactaacgaaaccgtacggggtaaacccccttaaacgttcctacgtacttacctacgtactcgtacccttaccgtaagtttcgggacgtacggtacgggttaccccaagtttaccgtaaagttaccgtaacgttagggtaacggtacggtagttcgtagggtaacctagtttaacgttttacggttttacgtcctaatcgtagcctacgtcctacgacctaccgtagtacgttgtttacgacttaacgtntttaacctttctagttaccaacttaagttactacgttaccttccgttacctaccccttacgtaccgtttaccgtttcggaaccgttaccggggtaaacgtaacggggtacggtaaccgtaacggtaaccctaacggtaccgtttagggaccgtacgtacgaccctaaccg

SEQ ID NO: 55709 - DNA, 603 bp, Homo sapiens
  misc_feature: GYAE6OF02FRFE6.25.51.E07.1.454.CMB.1.raw
  modified_base (202)..(202): a, c, t, g, unknown or other
  misc_feature (202)..(202): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctcctggctgcttctgtggganacagaatcaccatcacttgccaggcgagtcaggacattagtcactgtgtaaattggtatcaacaagaaaccgagggaaccccttaaactcctagactctacgatcgcctaccaagtttggacggacgacgggtcccattacgtaaacgttcacgtaggaacgtggtattcgtagggactagttagttttagttcgtacattcagctacgcctgaccacctagagttatttcgactaactatttacttttctgttacctaaccttaattactacggttacttacccgttccttaccccttacttaccgttaccgttttacgggcccggtaacggggtaacctaacggggttcgtaagtaccgtaacgaacgtaccgttggtacggtcgtacgaccctaaccg

SEQ ID NO: 55710 - DNA, 882 bp, Homo sapiens
  misc_feature: GYAE6OF02IN6Q6.25.51.E07.1.454.CMB.1.raw
  modified_base (205)..(205): a, c, t, g, unknown or other
  misc_feature (205)..(205): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatcctccctggctgcttactgtaggganacagaatccaccagtccacgttcgccgtaggccgtagtcgaggtaactattacgtcacgttgtaagttaagttaggtaactaccgtaaaacacggtaaaacccggtacggggtaaaacccccttaaaccttcctaagggaccttaccgtacgtaatccgaacccttacgtaaacgtttagggaacgcccggtaacgggtacccctaagttacccgtaaaggttaccctaaggtacggaaagggttcggtaacgttacggtaacggggtaccgtaagttttaacgttttttacggtttaccgttaaccgtacgttaaccggtaggtaccgtaacccggttccgtaaccgggtaccctaaacccggttaggtaaacggtttaaccgtttttcggaaacccttaaaccttaacgtttttaacccgttttaccggtacgtttaaaccccgtaaaccgttaaacgtttaacgtacggtttaaccgtttaccccgttacccttttaccccgttaaccgttaacctttttaaccccggggtttttacggaacccccgggttaacgggggggtaaacccgttaaacccgggggttaggtaaaccggttaaacccggtaaacgttaacccgggttaaaccgttaccggggttacggtaacccggtaccggtaaccccgttaaccgg

SEQ ID NO: 55711 - DNA, 636 bp, Homo sapiens
  misc_feature: GYAE6OF02GFPGV.25.51.E07.1.454.CMB.1.raw
  modified_base (206)..(206): a, c, t, g, unknown or other
  misc_feature (206)..(206): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatccctccctggctgcttcgtggtggganacagaatccaccatcacttgccgaggcgagtcaggactattagtctacgtgtagtaattggtatacaaacaagaaacccgaacgggtaaccccttaactcctagactactacgatcgtcctactaagttggaggcgacggtaccatacgtaagtcacgtaggaagtgatcgtaggactagtagttttacgttcgtacctattacgagtccgacgtccgtagacctaaccgtaggtaacgttatttacgacctaaactactttacgtttcttacgtaaccaaccttaatacgttacgtacttccgtacccttcccgtaccttaccgttaccgttttacgggaccggtaacgggttaaccggaacgggtttacggaacgtaacgtaaccgtaaacggtacgttacggtacggtaccgttacgaccctaaccg

SEQ ID NO: 55712 - DNA, 727 bp, Homo sapiens
  misc_feature: GYAE6OF02JPCRY.25.51.E07.1.454.CMB.1.raw
tcagactgtacagtcacgaccggtgctcgatttagcatactctacaacacacaaaggggcaggagtcagtcccaacgaggacacagcatggacatgagggtccctgctcagctcctgggctcctgctgctctggctctcaggtggcagatgtgacatccagatgacccagtctccgatccctcctggctgcttctggtacgggagaccaaggaactccaaccgatccgaactttcgccctaagggccgaagtccgaacgggactagttacgtacacgttgtagtaaacttggtaactacctaaaacacggaaaacccgtacggggtaaaccccttaaacgtcccgtagtacttacgtaccgattccgaccgtacctaagttggacggtcgtacgggtacccatacgtaaacgtcacgtaggaaacgtggtactacggtagggtaccagggtttaacttttacggttcgtacccgtactacgttacgaccgtacgtacctacgtaccgaaccgttagtaaacggttaacgtttttcgaaccgtaaacgttaacgtttacgttttaccgttacgtaaccgtaaaccttaaattacgttacggtacttacccgttaccttaaccccgtacgttaaccttaccgggtttcgaacccggtaggtaacccgtaaggttacggaacgtactacggtaaacgtcgttacggtacgaccgtacgtaccctaaccgg

SEQ ID NO: 55713 - DNA, 834 bp, Homo sapiens
  misc_feature: GYAE6OF02JNYXO.25.51.E07.1.454.CMB.1.raw
tcagactgtacagtcacgaccggtgctcgatttagcatactctacaacacacaaaggggcaggagtcagtcccaacgaggacacagcatggacatgagggtccctgctcagctcctggggcctcctgctgctctggctctcaggtgcagatgtgaccatccagatcgacccagtcctccacttcccctcccgtggaccttcgtcctttctagggtcgggaacgaccagtaaactccaaccctatccgtaacttcgacccgaagggtccgacggtacgaacggactattacgtactaccttggttaacgttaaagttagggtattaaccgtaaaccgaaacggtaaaaccccgtaaccgggggttaaaaacccccctttaaaaccgttacccgtaacggtaaccttaaccgttaacggaacttaccggttacccctaaccgtttaaacgttcggtaaacggcggttaaccggggtacctaacgttaaccgtaacgtttacccgtagtacgggtaacggttagtaccgtacgtacgggtacgttaagtttaacggtttttacgtttcgtacctaacgttcgaaccggtacgtaccgggttacttacggaactaaaccccggtaggtaaagtttaccttttaacggaaccttaaaccgttaagttttacctaccgtttacgtaacctaaccttaagtttactaccgttacgttaccctttccgtaaacccctcgttaccgtttacgttaccgggaacgtacccggggtaacgtacggttaggtaacgtaccttaacgaaaccgtcggttacgaccggtacgttcgaaacccttccgg

SEQ ID NO: 55714 - DNA, 651 bp, Homo sapiens
  misc_feature: GYAE6OF02HHZOV.25.51.E07.1.454.CMB.1.raw
  modified_base (204)..(204): a, c, t, g, unknown or other
  misc_feature (204)..(204): n is a, c, g, or t
  modified_base (435)..(435): a, c, t, g, unknown or other
  misc_feature (435)..(435): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatcagatgacccagtctccatcctccctggctgtcttctggtggganacagaatccaaccatcctacgttcgccaggcgagtccaaggacattacgtcacgtgtagttaaacttggtaatacgaacaagaaaccgaacgggtaaaccccttaaacgtcctagactactacgatacgtacctacctaagtttcgggagtccgtaacgggtacccatacgtaaacgttcaagtaggaagtgagtcgaggactagtttacgttttagttcgtacaatgacnctaagtcctacgtactaaacgtggtaattacgtttacgactaacttatttacgtttacgacgttacctaactaacgttaagttcgtaattccgttacctaccttacgtaacctttacgttttaccgggaccgtaacggggtacccttaagggtacggtaaacgtacgttaaccgtaaaccgtacggttacggtacggtccttacggacctaaccgg

SEQ ID NO: 55715 - DNA, 714 bp, Homo sapiens
  misc_feature: GYAE6OF02JC3DY.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctctggctctcgaggtggcagatgtcgacatccagatcgaccctagtcctccactccctcctggcctcgtcttcgtggtggacacagaactccgacatctacgttgccgaggtcgagtcgaaggtactagttacgtacctacgttggtaacttaaaacgttgggtaaactaccaaaaccgtaacggaaaaccccggaccgggttaaacccccttaaatccgagtaacctactaaccgacgttctaccctacgtaagtttgggaaccgacgtaccgggtacctaattaacgtaacttacgaacgttacggaggttacgaactccggtaaggtacttacggtttttaattttcgtacgttaccgtacgtagtacgtacgacgtaccgtacgtaccgtacgtacgtaagtttaacgttacgtacgtaacttacgtttaacttacgttacgtaacctaacgttaactacgtacgttaccttccgttaccgtcctaacctcgttaaccgtttcgaccggtaccggtaacggtaacgtacggtaacgtacgtaaccgtaacgtcgtcggttaccgtacgtcgacgtaccg

SEQ ID NO: 55716 - DNA, 828 bp, Homo sapiens
  misc_feature: GYAE6OF02H04FX.25.51.E07.1.454.CMB.1.raw
  modified_base (138)..(138): a, c, t, g, unknown or other
  misc_feature (138)..(138): n is a, c, g, or t
  modified_base (167)..(167): a, c, t, g, unknown or other
  misc_feature (167)..(167): n is a, c, g, or t
  modified_base (245)..(245): a, c, t, g, unknown or other
  misc_feature (245)..(245): n is a, c, g, or t
tcagactgtacagtcacgaccggtgctcgatttagcatactctacaacacacaaagggggcaggagtcagtcccaacgaggacacagcatggacatgagggtccctgctcagctcctggggctctgctgctctggctntcaggtcggcagatgtagacactccaagntcgaccccagttcctaccgacttcccctccgtggctcgtcttcgtggtaggacgacagtactcacctatactcgtacnccgaggacgtagtacgacggtaacctagtttacgctattaggttaacgttaagttacggactaacgaaacgaccggtaaaaccggaacccggttaaacccctttaacgcttacgtacttacgtaacgtctaccgtaccgttaacgtaacggtttcgggaacggtaccggaaccggtaccgttaaagtaacgttaaacgtccggttaaagtacgggtaaacggtttcggaccgtttaacggtaggggttaactttaaacgggtttttaacgttttttcgggttaacccgttaacggtacccgttaaacggtacgggttaaccgtacgttaacccgtaccgtaaaacccttaggttaaaccgtaacgttttaacgttacgtaacgttaaacccgttttaagtttaaccgttccttaaacggtacccttaaacggttaacttaccggttagtacccgtttaaccggtttccctaacgttaccccgtttaagttttcccggtaacgggtcccggtaaaggtaccggtaggtacgtaaacgtaaccgtaacggtacgtaccggttcgaacgtcgtacgtccgtaaccg

SEQ ID NO: 55717 - DNA, 602 bp, Homo sapiens
  misc_feature: GYAE6OF02G5WRW.25.51.E07.1.454.CMB.1.raw
  modified_base (204)..(204): a, c, t, g, unknown or other
  misc_feature (204)..(204): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatccctccctggctgcttctgtggganacagaatcaccatcacttgccaggcgagtcaggacattagcactgtagtaattggtatacaacaagaaaccgacgggtaaccccttaactcctagactctacgtatcgtcctactaattggagcacgggtcccagtacaagttcacgtaggaagtggtatcgtgggactagtattttagttcgtacctatcgagctacgcgtcgacctaactgtaacttagttttacgactaactatttactttacgttacgtacctaactaattataggttacttaccgttcctacccttacgtactttaccgtttcggaccgtacggggtaacctaacgggttacggaacgttacgtaacgaaaccggttaacgtaggttacggtaccttacggtaccctaacccg

SEQ ID NO: 55718 - DNA, 700 bp, Homo sapiens
  misc_feature: GYAE6OF02GX9D6.25.51.E07.1.454.CMB.1.raw
  modified_base (203)..(203): a, c, t, g, unknown or other
  misc_feature (203)..(203): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccatccctcctggctgcttctgtggganacagaatcaccatcactgccaggcgagtcaggactattagtcacttgtagttaaattggtaacttacgaaactaacgaaaccgtaacgggggtaaaccccctttaaacctaccgtagtaacttactaacgtaattcgaccttacctaagtttacggaggccgtaacggggttccccaagtactaaaacgtttccgaacgttagggaaacgtaggtaacttacgtaagggtactacggtttaagtttttacgtttacgtaccctagttacaggtcctacgtacctagtacctaaccgtacgtaagttacgttttacgaactaaacctaagtttaactttcgtacgttacctaaccgaaatttacgttaagttacgttaccgttcccttacccgtaacccttacgttaaccgttttcgaccgggtaacgggtaacggtaacgggtacggtaataaccgtaagtaaaccggtacgttcggacggtcgtacgaccctaacg

SEQ ID NO: 55719 - DNA, 751 bp, Homo sapiens
  misc_feature: GYAE6OF02FT8TK.25.51.E07.1.454.CMB.1.raw
  modified_base (214)..(214): a, c, t, g, unknown or other
  misc_feature (214)..(214): n is a, c, g, or t
tcagactgtacagtcacgaccggtgctcgatttagcatactctacaacacacaaagggggcaggagtcagtcccaacgaggacacagcatggacatgagggtccctgctcagctccgtggggcctcctgctgctctggctctcaggtggcagatgtgacatccagatcgacccagtcctccactccctccctggctgtctttcgtggtaggganacagaactccaacctatcctacgtttcggacccgagggaccgtacggtaccgaacggaaccgtaattttacgtaccgtacgtttaggttaagttaaagtttggttaacgttaccaaaacaacggaaaaccccggaaccgggggttaaaaccccctttaaacctcccgttacggtaacttaccgtaacgactcgtaccccgttaccgttaaagtttcgggaaggtccgtaacgggttaccctataaccgtaaacgttccgacgttagggtaacgtcgtagtcgtagggtactagtttagttttaggtttctacctagtacgagtctacgtccgtacgaccttaaccgtagtaacgtttacgtttacgacttaaacgttattttactttcgtacgtactaccgttaaattcttaacggtacttccgtttacccttacccgtttcaacgtttcctttaccgggaccgtaacggggtaacgtacgggtagtaacgtacgtaaccgtaacgttacgttacgtacggtcgtacctacgtaccg

SEQ ID NO: 55720 - DNA, 705 bp, Homo sapiens
  misc_feature: GYAE6OF02FN92V.25.51.E07.1.454.CMB.1.raw
  modified_base (205)..(205): a, c, t, g, unknown or other
  misc_feature (205)..(205): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatgacccagtctccactcctccctggctgcttctggtggganacagaatcaccatcacttgccaggcgagtcgaggactagttacgtcactgtagttaattggtatacaacaacgaaaccgaacgggtaaaccccttaaccgtcctagactactacgatcgtacctactaagttaggacggacgacggggtacccagtaacgtaaacgttacgtaacgtacgggtaaggtaggagttcggtagggtacgtagttagttttaggttttcgtacctactacgaagtcgtacggtcccgttagaccctaaccgtagtaaacggttacttttacgacctaaacttaagtttacttttccgttacgttaccgtaaacctaaagttacgttaacgttacgttaccgttacccttacccgttccgtaaccgtttaccgttttaccgggacccgggttaacggggaaaccgggtaacggttacgggtaacgttacgtaaacccgtaaacggtacgttaccgggttaccggtacttaccggccctaaccgg

SEQ ID NO: 55721 - DNA, 718 bp, Homo sapiens
  misc_feature: GYAE6OF02GR8T1.25.51.E07.1.454.CMB.1.raw
  modified_base (207)..(207): a, c, t, g, unknown or other
  misc_feature (207)..(207): n is a, c, g, or t
tcagactgtacagtcacgaccggtgctcgatttagcatactctacaacacacaaagggggcaggagtcagtcccaacgaggacacagcatggacatgagggtccctgctcagctcctgggctcctgctgctctggctctcaggtggcagatgtgacatccagatgacccagtctccatccctcccgtggctgcctttcgtgtggganacagaactcacctatcacttcgccaggcgagtcaggacattagtcactgtcgttaaattggtaatctaacgaagaaaccgaggggaacccccttaaactcctggatctacatcgcctaccaatttcggagcgacgggtccagtactaaagtccaacgtaggaacgtaggatacggtcgggtaactaggttaagtttttagtttacggttcctaatcgtaagactaacgggtccttacgaccgtaaaccccgtaggtaaacggttacgttttaacgtactaaaccgtaagtttaacttttcgttacggtaccctaacccgtaaagtacttaagttaacgttccggttaacccttcccttaaccgtaacccgtttacgtttttaccgggtaccccggtaaacgggggttaacccgtaaacgggggtttaccgggtaaacgtaaccgttaaaccggtaaaacccgtaacggtttaccgggttacggtaccggtttaccggaccgttaaaccccg

SEQ ID NO: 55722 - DNA, 774 bp, Homo sapiens
  misc_feature: GYAE6OF02IY7EZ.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctgggctcctgctgctctggctctcgaggtggcagatgtgacatccagatcgacccagtcctccactccctccctggctgcttctggtgggagacagaactcaccatcctacttcgccgagggcgagtcgaaggactagttagtcacgtgtagttaaattggtatacaacaacgaaacccgaacggggtaaacccccttaaaatccctagtactacgtaaccgactacgaccctacctaagtttgggacggtaccggacgggtacccaacgtaccgtaaagttcctaacggtaggtaacgttaggtagtcgtacgggtaacgtaacgtttagttttttacgggtttacgttaccgtacgttacgacgggtacctacggtcccgtacgacctaaaccggttaggtaaactttacgtttttaacgaccttaaaccgttacttacgttttacgttacgttaacccaaactttaagttaacgtacgttaaccgttccgttttaacccttccccttaacgttaacccgttttaccggtttaccgggtacccgggtaaccggggttaaaccggttacgggtaacgggttaaccggtaacgttaaacccggtaaacggttaaccggttacggttaccggtaccggttaccggtacccgtaaccccg

SEQ ID NO: 55723 - DNA, 801 bp, Homo sapiens
  misc_feature: GYAE6OF02HEMMO.25.51.E07.1.454.CMB.1.raw
tcagactgtacagtcacgaccggtgctcgatttagcatactctacaacacacaaagggggcaggagtcagtcccaacggaggacacagcatggacatgagggtccctgctcagctcctggggctcctgctgctctggctcgtcgggtggcagatgtgacatccagatcgacccagtctccactcctccgtggctgcttcgtggtgggacgacaagactacacctactaccgtacgttcgaccgaggaccgaggtccagggaactattagtaccacgttgttacgtttaagtggttactaacgtaaacaaacgggtaaaacccggtaaccgggggtaaaacccccttaaaaccttcccgtaaggtactaaccgttacgtacttaccggtacccttaccgtaaggtttacggggaacgggaccggtacggggggtacccctaagttaaccggtaaacggttaccgtaacggtagggtaagggttacggtaacgtaccgggttaggggaacgttaaggttttaacgttttttaaggtttccggttacctacgtacgtaacggtaccgtaacccgtcgtacgtaccctaaaccggttacgtaaacgtttagtttaccgtactaaaccgttatttaacgtttctaccggtttaaccaacgttaattacgtacgttaccgttccgtttaccctacccggtacttaccgtttcgtttaccgggacggtaaccgggtaccgtaacggggttaccgtaacggtaacgtaaccgtaaggttacgtaccggcgtacgtaccgctaacgttcc

SEQ ID NO: 55724 - DNA, 611 bp, Homo sapiens
  misc_feature: GYAE6OF02FIO5N.25.51.E07.1.454.CMB.1.raw
tcagactgtacagtcacgaccggtgctcgatttagcatactctacaacacacaaaagggggcaggagtcagtcccaacgaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggcgagtcagggcattagacaatttatttagccttaggtatcaacgagaaaaccgagggagagtttacctaagtcctccgtagacttctatgcctcgccctaccacgttacacttcgacgggtcccattcgtcgttcaggcgactaggtagaactcggtaggacagtagtttccacgttctcaactcgtacagccgagcctgacagcctagaagtacttggtacgactaaactttagtacttagtaaccttaaaaagtacttaaacgttaccttaccgtaccccgttacttaacccgttacgggttttacgggaccgggttaacgggtaacccgttaaggggtcggtaaaccggttacaaccggttaaaccgggcttacgggg

SEQ ID NO: 55725 - DNA, 720 bp, Homo sapiens
  misc_feature: GYAE6OF02GR1IX.25.51.E07.1.454.CMB.1.raw
  modified_base (207)..(207): a, c, t, g, unknown or other
  misc_feature (207)..(207): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacatccagatcgacccagtctccatccctcctggctcgcttctggtaggganacagaactcaccatcacttcgccgaggcgagtcgaggactattacgtctacgtgtagtaaattggtactacaaacaacgaaaccgaacgggtaaaccccttaaactcctagtacttaccgtaacgtataccgtacctaccgtaatttcgggacggaccgtacgggtacctataacgaacgttacgacgtaggaagtaggtactacgtagggtactagtttagttttacgttgtacctagtacagtactacgtcctacgacctaaccgtagtaagttatttacgacgtaacttagttactttaccgtacgttaacctaaccttaagttacgttacgttaaccgttcccgtttaccctaccccttaaccgttaccgtttaacccgttttaccgggaacccgggttaaacggggtaacccggttaaaggggttccggtaaaccggtaaccttaaaccccgggaaacgttaaccggttccgggtaaccggttacccgttaccgtacccggttaaccc

SEQ ID NO: 55726 - DNA, 769 bp, Homo sapiens
  misc_feature: GYAE6OF02I28YQ.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctccgtgggctcctgctgctctggctctcgaggtggcagatgtgactataccagactcgaccctagttcctcctactcccctcccgtaggtcctcgtcctttcgtacggtgggaacgaactaacgtaactaccaaccgtataccctacttcggaccgaacggacggtacggttaacgaacgtaacgttaacgttacggtactaacgttaggttaagttaaacgttaggtaactaacccgaaaacggtaaacccggtaaacccggaaaacccggggtaaaccccctttaaaccgtccgtaagtaaccttaccgttaacgacgtacccgtacctaacgttaaggttaggtacggaccggtacgggttaccctaaagtaccttaaagtcgtaacgtacggtaaggtacgtagttacggtaagggtacttacggttttagtttacgttccgtaactcgtacgactacgtacgccgttaacgactaacgtgtaacttagttacgaacttacttagttaccttacgtacctaacgtaactacttaaggtaccttaacgtcttaccacccttaacgtaccttttacggccggtaacggtacgggtaacgtaccggtagtaacaacgtaactaaccggtagtacgtcggactaccggacttaacg

SEQ ID NO: 55727 - DNA, 735 bp, Homo sapiens
  misc_feature: GYAE6OF02JI122.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctggggctcctgctgctcgtggctctcgaggtggcagatgtgacatccagatcgacccagtctccactccctccgtggctgctttcgtggtagggagacaagtaactcaaccatctacttacggccaggtaccgagtcgaggaactacttacgtacacgttgtagttaagttggtactacaacgaacggtaaaaccgaccggggtaaaccccttaacgtccagtactacgtacgacgtactaccgtacctaagttcggacggtccggtacgggtaccctagttacgaaacgtttaccacggtacggtaacggttgacgttacggtaggtacggtagtttaacgttttaggttacgttaccgtatacgacgtacggtaccacgttacgacctaacgtaggtaactttacggtttacgaacgttaactaacgtttacgtttacctaccggtttaacctaaaccgttaaatacggttacgttaacgttccgtttaccctaccccgtttaagttacccgttacgggtttaccgggaccggtaacggggtaaaccgtacgggttaacggtacggtaaccgttacggaaaccgttgggtacgtcggttaacgtctaccggttaacc

SEQ ID NO: 55728 - DNA, 675 bp, Homo sapiens
  misc_feature: GYAE6OF02GMPCG.25.51.E07.1.454.CMB.1.raw
  modified_base (204)..(204): a, c, t, g, unknown or other
  misc_feature (204)..(204): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcgaggtggcagatgtgacatccagatgacccagtctccactcctcctggctgcttctgtggganacagaatcaccatcaacttcgaccaggcgactcgaaggactaagttagtcaacgtacgtagttaaacttaggtataccaaacaacggaaaccgaacggggtaaaccccttaaacgtacctagtactcgtaacgtactacgtaccctacgtaacgttaggacggaccgtacgggtaccctaagtaccgtaaagtttacgaacgtaggtaaacggttcggtaacgtacggttagggaccgtaaggtttaaagtttttaacgggtttagtacctaacgtaccgtacgaccgacggtactacggtaactaacccgtacgtaagttaacgtttacgactaacgtattacgtttactagtccaataactagtacgtacggttcctacccgttcctactaccgttcgttacggacgtacgggaaccggaaggttacggaagataacgaacgttaggtacgtacgcgtacgactaaccg

SEQ ID NO: 55729 - DNA, 782 bp, Homo sapiens
  misc_feature: GYAE6OF02ISFJM.25.51.E07.1.454.CMB.1.raw
  modified_base (571)..(571): a, c, t, g, unknown or other
  misc_feature (571)..(571): n is a, c, g, or t
  modified_base (614)..(614): a, c, t, g, unknown or other
  misc_feature (614)..(614): n is a, c, g, or t
  modified_base (631)..(631): a, c, t, g, unknown or other
  misc_feature (631)..(631): n is a, c, g, or t
tcagactgtacagtcacgaccggtgctcgatttagcatactctacaacacacaaagggggcaggatcagtcccaagaggacacagcatggacatgagggtccctgctcagctccgtgggctcctgctgctctggctctcgaggtggtcgagagtcgtgaccattccagaatcgacccacgtctccacttccctccgtggtctgtcctttactagtacggggacgaacagtaactacctaccacttactacgtcggaccgtacggcgagtcgaacggtactaacgttagtacctacgtacgtaagggttaacctttaggttacctaactaaaccggaaccgtaaacccggtaaaccggggttaaaaccccctttaaaccgttccgtaacgtaaccgttacggtaacctacggtaccgtacccttaacggttaacggttacgggtacggtccggtaacccggttaccgtaacgttaaccgtaacgttaacccgttacggtaacgggtaacgttaggtaccgtaagggtacggttaacgtacggtttgttttaacgttacggtaccttaaccgngtaacggacgtctacgagtaccacggttacgtagttacgtttnaccgtattatcttaccncgtacctagtactagtacgtacgttaccgtccttaccgtacgttacgttaccgttacggtacccggtaacgggtaaccggttacgtaacgggtaaccgttacgaaccgtaaccggtaacggttcggttaacgacggttccgtacgttaccg

SEQ ID NO: 55730 - DNA, 660 bp, Homo sapiens
  misc_feature: GYAE6OF02GAH7W.25.51.E07.1.454.CMB.1.raw
  modified_base (158)..(158): a, c, t, g, unknown or other
  misc_feature (158)..(158): n is a, c, g, or t
  modified_base (374)..(374): a, c, t, g, unknown or other
  misc_feature (374)..(374): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctctggctctcaggtggcagatgtgacntccagatgacccagtctccatcctccctggctgcttctgtggagacagactcaccatcacttcgccgaggcagtcaggactattagtctacttgtagtaagtttggtatacaaacaaggtaaacccgacggggtaaccccttaacgtcctagactactacgatcgcctactaattggacggacgacgggtccatactaacgttcagtaggagtagngtacgtagggactaggtattttaggtttacgtacctatactagacgctacgtacgaccgtacgtagtaaagttacttttgaaccgttaactagtttactttttacgacgttacaaccgttaatacgttacgtacttccgttacccgttaccctaccttaaccctttacgtttaccgggtacccggtacgggggtaaacccgttaaacggggtacggtaacggtaacgttaaaccgtaaaccggttaagttacccggggtacggtaccgttaccgaccgtaacccgg

SEQ ID NO: 55731 - DNA, 879 bp, Homo sapiens
  misc_feature: GYAE6OF02GQGY8.25.51.E07.1.454.CMB.1.raw
tcagactgtacagtcacgaccggtgctcgatttagcatactctacaacacacaaagggggcaggagtcagtcccaacgaggacacagcatggacatgagggtccctgctcagctcctgggctcctgctgctctggctctcgaggtggcagatgtgacatccagatcgacccagtctccatccctcccgtggctgtcctttcgtggtacgggatacaagtaactccaaccattccgacttcggcccgaagggtccgtagttcgaagggactaactttagtctaacgttggttagttaaagttggtaactacaaacgtaacgaaaccggaaccggggtaaacccctttaaacgtcctaacgtaactccgtaacgtacgtacgtaccccttacgtaaggtttacggacggtaccgtacgggtacccttaacgtaaccgtaaacggttagaacccggttagggtaacggttacggtacgttacggtaacggggtaacgttagtttaacggtttttaagtttaccgttaaccgtaacgttaccgtaaggtaccgttacggtaaccgttacgtaacccgtaaaacccgttacggtaaacgtttaaaggtttttacctaaaacgtaaaccgtttacttttaaccgtttttaccgtcgttaaaccgttaaccggtaaaactttacgtaacgttaccgttcccgttcccgtttaaccccttaaccgttaaccctttaaccgggttttaccgggaaccccgggttaaacggggttaaacccggttaaaccgggggttacggtaaacccggttaaccggtaaaccggttaaaacccggtaacggtttcgggaaacccgttaccggtaacccgggtacctttaaaccccgg

SEQ ID NO: 55732 - DNA, 790 bp, Homo sapiens
  misc_feature: GYAE6OF02JW59I.25.51.E07.1.454.CMB.1.raw
  modified_base (153)..(153): a, c, t, g, unknown or other
  misc_feature (153)..(153): n is a, c, g, or t
  modified_base (157)..(157): a, c, t, g, unknown or other
  misc_feature (157)..(157): n is a, c, g, or t
  modified_base (163)..(163): a, c, t, g, unknown or other
  misc_feature (163)..(163): n is a, c, g, or t
  modified_base (170)..(170): a, c, t, g, unknown or other
  misc_feature (170)..(170): n is a, c, g, or t
  modified_base (387)..(387): a, c, t, g, unknown or other
  misc_feature (387)..(387): n is a, c, g, or t
tcagactgtacagtcacgaccggtgctcgatttagcatactctacaacacacaagggggcaggagtcagtcccaacgaggacacagcatggacatcgagggtccctgctcagctcctgggctcctgctgctctggctctcaggtgcagactgngacntccagntcgaccngtctccatcctcctaggctgtcttcgtggtgggacacacggtaactccaactactccgtaacgttcggacctagggcggtaacgttaccggaaggtaccgttagtttaaccgtacgtaacggtttagtaaacggttaaagttcggtaaccgttaacgaaaccgtaaaccgggtaaaacccggtaaccggggtaaaaccccctttaaaccggttaccncggtaaacttccggtaaccgtacggttacctacccttacggttaacgtttaggggacggtacgttaaccggggtaccctaaagtccgttaaaagttaccgtaacggtcgggtaaacgttacggaacgtttccggtacgggaactttacgtttaacggttttacgtacgtaccgtacggtacgtacggtactaccgggtacgtacgtaaccgtaaacgtcggttaacttaccggtttacgtaaccgtaaacttacgtttacttacggtacttaaccgggtaatacgtacgtcgtaccgttactccgtaccgttacgtaacttccgttagaccgtaagggtccaaggtcgtaaacgtaccgaagtttaaccgacgttacggttcgacggttacccgtagtaaccg

SEQ ID NO: 55733 - DNA, 824 bp, Homo sapiens
  misc_feature: GYAE6OF02GZOMS.25.51.E07.1.454.CMB.1.raw
  modified_base (206)..(206): a, c, t, g, unknown or other
  misc_feature (206)..(206): n is a, c, g, or t
tcagactgtacagtcacgaccggtgctcgatttagcatactctacaacacacaaagggggcaggagtcagtcccaacgaggacacagcatggacatgagggtccctgctcagctcctgggctcctgctgctctggctctcaggtggcagatgtgacatccagatgacccagtctccatccctcccgtggctgcttcgtggtggganacagaactccgaaccatcctacttcgccgaggcgagtcaggactattagtacctactgtagttaaattggtaattacaaacgtaacgaaaacccgtacggggtaaaccccctttaaacgtaccgtacgtaactaccttaacgtaatccggtaccctaccgttaagtttacgggacggtaccggtaccggggttaccctaaacgttaccgtaaaacgtttaccgtaaaccgttaaggggtaaacgggttacggtaacgttccggttaacggggaaacccgttaaggttttaaacgttttttacgggttttacggttaacccgtaacggtttaccggtaaacggtaccgtaacggttaccgttaaccggtaacccgtaaacccggttaacgggttaaacggttaacgtttttacggaaacctaaaccgttaacttttaaacgttttcgttaaccgttaacctaaaccgttaagttaacgttcggtttacccgttaccttacccgttaccttaaaccgtttacgttttaccgggaccgtaacgggggtacccgtaaaggggtacggtaacggtaacgtaaccgtaaacgtacgtcggttaggaccgtacgactaccctacg

SEQ ID NO: 55734 - DNA, 776 bp, Homo sapiens
  misc_feature: GYAE6OF02J0ACX.25.51.E07.1.454.CMB.1.raw
  modified_base (180)..(180): a, c, t, g, unknown or other
  misc_feature (180)..(180): n is a, c, g, or t
  modified_base (220)..(220): a, c, t, g, unknown or other
  misc_feature (220)..(220): n is a, c, g, or t
tcagactgtacagtcacgaccggtgctcgatttagcatactctacaacacacaaaggggcaggagtcagtcccaacgaggacacagcatggacatgagggtccctgctcagctcctgggctcctgctgctctggctctcaggtgcagatgtcgacatccagatgacccagtctcattccncctggctagtcttacgtggtaggacacagaactcgaaccnttacacttcgccgtacggtacgtacgttcgaacggacctaaggtttacgtcgtaacgttaggtacgttaaagttggtactaacgaaccaaggaaaccgaaccgggtaaaccccgttaaacgtaccgttacggtaacttccgttaaccgtactacgtcccgttaaccttaaggtttacgggacggtaccgtaacggggtaccctaagttacgtaaacgttcgtaacgtacgggtaaagtcggtaacgttacgtacgggtaacgtaagtttaaccgtttttagtttacgtacctaaggtttacacggtacgttaccggtacgtacgtaaccggttaactacgtaaaggttcctttacgaaaccgtaatacttacgtttcggtactacgtaaccgtaattacgttacgtaacgttaccgttacctacttacccgttaactttaccggtttcgaaaccgggttaccggggtaaacgtacgggttaacgtaacgggttttaaccaaccgggttaaacgttaacccggttaggtacccgtacgttacccggaccgttaaccg

SEQ ID NO: 55735 - DNA, 1138 bp, Homo sapiens
  misc_feature: GYAE6OF02HYP5H.25.51.E07.1.454.CMB.1.raw
  modified_base (130)..(130): a, c, t, g, unknown or other
  misc_feature (130)..(130): n is a, c, g, or t
  modified_base (314)..(314): a, c, t, g, unknown or other
  misc_feature (314)..(314): n is a, c, g, or t
tcagactgtacagtcacgaccggtgctcgatttagcatactctacaacacacaaagggggcaggagtcagtcccaacgaggacacagcatggacagtgagggtccctgctcagcctccgtggggctcccngctgctcgtggctctcgaggtggcagatgtacgatctccgagtcgtcgtacccgagtccctaacctcgtcccctccgtggtactcgtccgtttcgtagggtagggaacgactacgtaactccaaccgtactacgtacgttcggccgacgggcgtggtaccgacggtaacttacgttaccggtanaccgttgtaaagttaagttcggtaactaaccgtaacgaaccggtaaacccggtaacccgggttaaacccctaacgtcgtacgtacgactacgtacgtcgaccttacgtagtggacgcggtcgtactacgtaacgtagtcacgtaggtacgtcgtacgtacggtaccgggtaattcgggtttacgtttaacggtttaccgtacgtacgttaccgtaacggtacgtaccggtaccgtaccgtaaccgttaaccggtaaaccggttaaacggtttaaccggtttttaaaccggtaaacccttaaacccgttttaaacccggtttaaaccgtttttaaacccgtttaaccggtttaaaacccggttaaaacccgtttttaaaaccgggtttaaacccggggtttttaaccccgggggtttttaaacccccgtttttacccccgttttttaccccccgggttttaaaaaaaaaaaaacccccgggttttttcccccgggttttaaacccggggtttttaaacccccgggggggtttaaacccccgggggggttaaaacccccgggggggggtttttaaaacccccggggggtttaaaaacccggggggttttaaccccggggggtttaaaaacccgggggttttaaaaacccccggggttttaaaaaacccccggggggtttaaaaaacccccgggtttaaacccccggggggttttttaaaccccgggggttttaaaacccccgggggttaaaaccccgggtttttaaaccccccggggggttttaaacccccgtttaaccccggggttttttaaaaccccccccggg

SEQ ID NO: 55736 - DNA, 832 bp, Homo sapiens
  misc_feature: GYAE6OF02F3N8E.25.51.E07.1.454.CMB.1.raw
  modified_base (820)..(820): a, c, t, g, unknown or other
  misc_feature (820)..(820): n is a, c, g, or t
tcagactgtacagtcacgaccggtgctcgatttagcatactctacaacacacaaaggggcaggagtcagtcccaacgaggacacagcatggacatgagggtccctgctcagctccgtgggctcctgctgctctggctctcgaggtggcagtatggtgactactccaagtactcgtacccagtctaccacttccctccttggcttcgtctttccgtgggtcggtaacgaccgtagaacttcaacctactccgtacttccggaccgaaggccgtacgttacgacggtacttaacgttacgttacgtacgttaggttaacgttaaaaggtttcgttaaccgtacgaaaacccgtaaggtaaaaaccccgggtaaccgggttaaacccccctttaaacggtaccgttacggaattttaaccgaaccgttacgttcgtaacccccgtttagttaacgtttacgggaccggtaccgggtaaccgggttacccctaagttaccccgtaaaggtttacccgttaacggtacggaagggttaggtaccgtttaggttaccggaacgtttaaggttttaacgtttttacgggtttacgttaccgtagtaccgtacgtacgtacgttaccgtaccgacttaacccggtagttaaaccggtttagttaccgtaacgttaaccttagtttaaactttccgttaacgttaaccaaccgttagttacttacggttacttaccttacccgtacttaccgtaccgttactttacgggaccgtaacgggtacgtaagttcgggaataccggttaactacggtacgtggtacggttccncgtaccctaacg

SEQ ID NO: 55737 - DNA, 716 bp, Homo sapiens
  misc_feature: GYAE6OF02HNUP9.25.51.E07.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (589)..(589): a, c, t, g, unknown or other
  misc_feature (589)..(589): n is a, c, g, or t
tcagactgtacagtcacgaccggtgctcgatttagcatactctacaacacacaaagggggcaggagtcagtcccaacgaggacacagcatggacatgagggtccctgctcagctcctggggctcctgctgctcgtggctctcagggtcgcagatgtagacatccagactcgaccctagtctccactccctccgnggtctcgcgttctggtgggacacgngtaactcacctaactcacgttacgccgtaacgcggacgttcgaacggactacgttacgtctaccgtagttaggttaaacgttcgtaatacgaaacgaaccggaaaccgtaaaccggggtaaaccccttaaacgtaccctacggtaactcgtaacgtacgtacgtacccgtactaacggtttacgggacggtcgtaccgggtcctaacgtacgaaacgttctaacgtaggtacgtacgtagtacgtacgggtatacggttttactttaacggtttacgtaccgtacgtcgtaaacggtacgtacggtcctaacgggtacctaaaccgttacggtaaatcgttttaacgactaacgtacgtttattaccgtnttaccgtaactaagtacgttcgtactcctacctacgtacttaccggttacgaccggtaaggtacgtaagggtatacgaagttaacccaagttaacggtaggtaaccggtcctacgtactactaaccg

SEQ ID NO: 55738 - DNA, 679 bp, Homo sapiens
  misc_feature: GYAE6OF02FNHI0.25.51.E07.1.454.CMB.1.raw
  modified_base (204)..(204): a, c, t, g, unknown or other
  misc_feature (204)..(204): n is a, c, g, or t
tcagactgtacagtcacgaccggtgctcgatttagcatactctacaacacacaaagggggcaggagtcagtccccaacgaggacacagcatggacatgagggtccctgctcagctcctggggctcctgctgctctggctctcaggtggcagatgtgacatccagatcgacccagtctccatcctcctggctgcttctgtggganacagaactccaccatctacttgcctaggcagtcaggacattagcatgtattaaagttggtactacaacaacgaaaccgaacgggtaaccccttaactcctagacttactacgtatcgtacctaccgtaagttggaggtcgacggtaccagtacaagttcacgtaggtaagtgtactcgtagggactagttattttacgttcgtacctacgtacgacgtcaacgtcctagacctaaccgttagtaacgttactttacgacttaaactactttacttccgttacgtacctaaaccgttaacgttaacgtacgttaccgttaccgttcccgttaacccgttacgtaacccgtttaaccggttttccggggaacccgttaaccgggggtaaccgttaaacggggtaccgtaaacgttaaccgttaaaccgtaaacgtaaccggttacgggtaccggtacgtacggttaccctaacccgg

SEQ ID NO: 55739 - DNA, 259 bp, Homo sapiens
  misc_feature: GYAE6OF01EY7HW.22.38.D05.1.454.CMB.1.raw
  modified_base (256)..(259): a, c, t, g, unknown or other
  misc_feature (256)..(259): n is a, c, g, or t
tcagacatacgcgtcacgaccggtgctcgatttagtatctgatagttgggtctgggacagacttcactctcaccatcagcgacctagagcctgaagattttgcagtttattactgtcagcagcgtagcatctggcctccgtacacctttggccaggggaccaagctggagatcaaacgaactgtggctgcaccatctgtcttcatcttcccgccatctgaacgcgtatgtctgagcgggctggcaaggcgcatagnnnn

SEQ ID NO: 55740 - DNA, 259 bp, Homo sapiens; identical to SEQ ID NO: 55739
  misc_feature: GYAE6OF01DZE25.22.38.D05.1.454.CMB.1.raw
  modified_base (256)..(259): a, c, t, g, unknown or other
  misc_feature (256)..(259): n is a, c, g, or t

SEQ ID NO: 55741 - DNA, 461 bp, Homo sapiens
  misc_feature: GYAE6OF01D4L56.22.38.D05.1.454.CMB.1.raw
  modified_base (442)..(442): a, c, t, g, unknown or other
  misc_feature (442)..(442): n is a, c, g, or t
  modified_base (449)..(461): a, c, t, g, unknown or other
  misc_feature (449)..(461): n is a, c, g, or t
tcagacatacgcgtcacgaccggtgctcgatttagtatctgatagttgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgcccaaactggttccgaccccgtgggggccccgggaaccctggtccaccgtctcctcacgcctccaccgaacgggcccatccggtccttcccccgtggccgcccctgcctcccgagggacgccacccgtccgagacgcacgacgccggccctcggggctcggcctggacgaaggtactacttccacgtcgtagtgtcgtgaggcgggctgggacaaggcncgatagnnnnnnnnnnnnn

SEQ ID NO: 55742 - DNA, 557 bp, Homo sapiens
  misc_feature: GYAE6OF01BQIBA.22.38.D05.1.454.CMB.1.raw
  modified_base (138)..(138): a, c, t, g, unknown or other
  misc_feature (138)..(138): n is a, c, g, or t
  modified_base (196)..(196): a, c, t, g, unknown or other
  misc_feature (196)..(196): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(557): a, c, t, g, unknown or other
  misc_feature (524)..(557): n is a, c, g, or t
tcagacatacgcgtcacgaccggtgctcgatttagtatctgatagttgggttgcacttatttattgggatgacggttaccgctacagtccatctctgaggaggagactcaccatcaccaaggaccaacccccaaaacnggtggtccttacaatgaccaccatcggaccctgtggacacagccacattatttctgtncacactctataggagcacctggtagtctgaccctaaattcggttacccgacccccggtcgggggccccggaaccctggtccaccgtctcctcgacgccctccaaccgaacgggccctagttccgtcccttcccccgtggcccgtacccctcgccgtaccgacggtacgcccacccgtaccaagcgaccaccgacggccggccccgtgggccgtcgtccgtaggtaccgaaacggtacccttacctacccgacggtcgttagttcggtcgtcgggaggcccggacggtcgggaccgaacgggcccgtagtaacgaggcanctgangncnnnnnnnnnnnnnnnnnnnnnnnnnnnnnnnnnn

SEQ ID NO: 55743 - DNA, 424 bp, Homo sapiens
  misc_feature: GYAE6OF02I50GB.22.38.D05.1.454.CMB.1.raw
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (403)..(424): a, c, t, g, unknown or other
  misc_feature (403)..(424): n is a, c, g, or t
tcagacatacgcgtcacgaccggtgctcgatttagtatctgatagttgggttgcacttatttattgggatgacggttaccgctacagtccatctctgaggaggagactcaccatcaccaaggacaccccaaaaccaggtggtccttacaatgaccaccatggaccctgtggacacagccacatatttctgtgcacactctataggaggcacctggtagtctgccaaactggttcgacccctggggcccggaaccctggtcaccgtctcctcagcctcaccaaggcccatcggtctccccctgcgccctgctccagagcacctccgagagcacagcggccctggggctgcctggtcaaggctacttccacgcgtangtcctgagcggctgcaaggtcncatagnnnnnnnnnnnnnnnnnnnnnn

SEQ ID NO: 55744 - DNA, 419 bp, Homo sapiens
  misc_feature: GYAE6OF02FV4SA.22.38.D05.1.454.CMB.1.raw
  modified_base (411)..(419): a, c, t, g, unknown or other
  misc_feature (411)..(419): n is a, c, g, or t
tcagacatacgcgtcacgaccggtgctcgatttagtatctgatagttgggttgcacttatttattgggatgacggttaccgctacagtccatctctgaggaggagactcaccatcaccaaggacacccccaaaaccaggtggtccttacaatgaccaccatggaccctgtggacacagccacatatttctgtgcacactctataggagcacctggtagtctgccaaactggttcgacccctggggcccggaaccctggtcaccgtctcctcagcctccaccaagggccccatcggtcttccccctggccgccctgcctccaggagcacctccgagagcacagcggcctgggctgcctggtcaaggactacttccacgcgtatgtctgagcgggctggcaaggcgcagtagnnnnnnnnn

SEQ ID NO: 55745 - DNA, 435 bp, Homo sapiens
  misc_feature: GYAE6OF02JD9ME.22.38.D05.1.454.CMB.1.raw
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (392)..(394): a, c, t, g, unknown or other
  misc_feature (392)..(394): n is a, c, g, or t
  modified_base (396)..(400): a, c, t, g, unknown or other
  misc_feature (396)..(400): n is a, c, g, or t
  modified_base (402)..(435): a, c, t, g, unknown or other
  misc_feature (402)..(435): n is a, c, g, or t
tcagacatacgcgtcacgaccggtgctcgatttagtatctgatagttgggtctgggacagacttcgactctcaccatcagcgacctagagcctgaagatttgcagttattactgtcagcagcgtagcatctggcctccgtacacctttggccaggggaccaagctggagatcaaacgactgtggctcgcaccgatctgccttacgatccgttcccgcccattccgtgaaaccgtccgttattaccggtcctgaaggcccggggtctcggaccgaacgggccgtaccgtaagttacggcgtcgacgtcgacgctacgcgtagacgnttcgctcgacgtcncagacgtnaaccgntttgcgttcngngngacgcncacgngagcgncncgcgcnnncnnnnngnnnnnnnnnnnnnnnnnnnnnnnnnnnnnnnnnn

SEQ ID NO: 55746 - DNA, 435 bp, Homo sapiens
  misc_feature: GYAE6OF02ICQZH.22.38.D05.1.454.CMB.1.raw
  modified_base (337)..(337): a, c, t, g, unknown or other
  misc_feature (337)..(337): n is a, c, g, or t
  modified_base (415)..(435): a, c, t, g, unknown or other
  misc_feature (415)..(435): n is a, c, g, or t
tcagacatacgcgtcacgaccggtgctcgattttagtatctgatagttgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaacctggtcaccgtctcctcacgcctccacaagggcccatcggtcttccccctggccgccctgcctccaggacgcacctcgagngcacagcgccctgggctgcctggtcaaggactacttccacgcgtatcgtctgaggcggctcggacaaggcgcatagannnnnnnnnnnnnnnnnnnnn

SEQ ID NO: 55747 - DNA, 196 bp, Homo sapiens
  misc_feature: GYAE6OF01AFFCC.38.50.E06.1.454.CMB.1.raw
  modified_base (194)..(196): a, c, t, g, unknown or other
  misc_feature (194)..(196): n is a, c, g, or t
tcagtcgatcacgtcacgaccggtgctcgatttagatctactgacaacacacaagggtcagcagtatggtacaagaccgtacactttggccaggggaccaagctggagaccaaacgaactgtggctgcaccatctgtcttcatcttcccgccatctgaacgtgatcgactgagcgggctggcaaggcgcatagnnn

SEQ ID NO: 55748 - DNA, 199 bp, Homo sapiens
  misc_feature: GYAE6OF01DWC9A.38.50.E06.1.454.CMB.1.raw
  modified_base (195)..(199): a, c, t, g, unknown or other
  misc_feature (195)..(199): n is a, c, g, or t
tcagtcgatcacgtcacgaccggtgctcgatttagatctactgacaacacacaaggggtcagcagtatggtacaagaccgtacactttggccaggggaccaagctggagaccaaacgaactgtggctgcaccatctgtcttcatcttcccgccatctgaacgtgatcgactgagcgggctggcaaggcgcatagnnnnn

SEQ ID NO: 55749 - DNA, 196 bp, Homo sapiens; identical to SEQ ID NO: 55747
  misc_feature: GYAE6OF02GVPNT.38.50.E06.1.454.CMB.1.raw
  modified_base (194)..(196): a, c, t, g, unknown or other
  misc_feature (194)..(196): n is a, c, g, or t

SEQ ID NO: 55750 - DNA, 195 bp, Homo sapiens
  misc_feature: GYAE6OF02GC050.38.50.E06.1.454.CMB.1.raw
  modified_base (194)..(195): a, c, t, g, unknown or other
  misc_feature (194)..(195): n is a, c, g, or t
tcagtcgatcacgtcacgaccggtgctcgatttagatctactgacaacacacaagggtcagcagtatggtacaagaccgtacactttggccaggggaccaagctggagaccaaacgaactgtggctgcaccatctgtcttcatcttcccgccatctgaacgtgatcgactgagcgggctggcaaggcgcatagnn

SEQ ID NO: 55751 - DNA, 196 bp, Homo sapiens
  misc_feature: GYAE6OF02FIZRD.38.50.E06.1.454.CMB.1.raw
  modified_base (194)..(196): a, c, t, g, unknown or other
  misc_feature (194)..(196): n is a, c, g, or t
tcagtcgatcacgtcacgaccggtgctcgatttagatctactgacaacacacaagggtcagcagtatggtacaagaccgtacacttttggccagggaccaagctggagaccaaacgaactgtggctgcaccatctgtcttcatcttcccgccatctgaacgtgatcgactgagcgggctggcaaggcgcatagnnn

SEQ ID NO: 55752 - DNA, 505 bp, Homo sapiens
  misc_feature: GYAE6OF01D7UNW.46.34.D01.1.454.CMB.1.raw
  modified_base (500)..(500): a, c, t, g, unknown or other
  misc_feature (500)..(500): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaaatcagcagggtggaggctgaggatgttgaatttatactgcatgcaagtgcacattggcctcggtcactttggccaggggaccaaggtcgaggagacgtacgaaacgaagtgtggngtacg

SEQ ID NO: 55753 - DNA, 788 bp, Homo sapiens
  misc_feature: GYAE6OF01B06Y3.46.34.D01.1.454.CMB.1.raw
tcagactagcagtacacgaccggtgctcgatttagatcgtctgtgttggggtttggggcctggatcgtacggacttacctcagttccacccttctcacaatagtaggctacctgcctcagtctaccttggggcgtgctaaactgggcctcgtgggtaccccagggaattccacgtagggggatagttgtcgtattcgaccttcctagtctccctacctctcccctcgcccggtccaccccttggacgtagcccggtctccatactcctgcaggtctagtcaaagtcccgtcgtagtacacgtgaatcggaaacacctgaccctggacttcggtactccaccgacgccggacctacgggcccgaaattccgtacctaacggttaccgacccttaaatttaacttaaagggttttaccttaaaccggggacttcggtggggtaccccaaggaccaacggtaccttcgaaggtcgggccttagggtacggggttcgagggtcgaacgtcgtaacgttttccaaccgtaacgttacgaaaagttcgtaagggtaccgttaaggggttgggaaaggttacgttgggaacgggtaagttggtttacgggtaagttttacgttaacgtaggtaccgtaagttcggacctaaagggttcgacctaacgtacgttaccgggacccgttaaccggtactaccgttttcgggtacccgtaaccgggggtacctaacggtcgtttagggaacgtaacgttaccgaaacggtaaccgttcggttaccgggtccgtaaccgg

SEQ ID NO: 55754 - DNA, 526 bp, Homo sapiens
  misc_feature: GYAE6OF01CO2TA.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaacggactctgggtccagacagattcagtggcagtgggtcaggcactgagttcacactagaaatcagcagggtggaggcgtgaggtatgttaggtaatttattactgcatgcaaggtgacacgattggccttccggtctacgttttggaccgacggggtaccaaggtcgtagggagacgtacgaaacggaactacggtggtctacgg

SEQ ID NO: 55755 - DNA, 535 bp, Homo sapiens
  misc_feature: GYAE6OF01BS4I7.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaatcagcagggtggaggctgaggtatgttggaatttattactgcatgacgaaggtgacacattgggcccttccgggtctacgttttgggcccgtaacgggggtaccaaggcgtagggtagaagttacgaaacgaacgttcggtgggctacgg

SEQ ID NO: 55756 - DNA, 574 bp, Homo sapiens
  misc_feature: GYAE6OF01CVGYK.46.34.D01.1.454.CMB.1.raw
  modified_base (254)..(254): a, c, t, g, unknown or other
  misc_feature (254)..(254): n is a, c, g, or t
tcagactagcagtacacgaccggtgctcgatttagatcgtctgtgttgggtttggctgatcaggactcctccagttcaccttctcacaatgaggctcctgctcagctcctggggctgcgtaatgctctgggtcccaggattcgagtggggatggttgtgatgactcagtctccactctccctgcccgtcaccttggacagccgctccagtctcctgcaggtctagtcaaagcctagtatacactgataggaacncctgcctgattgtatcgaccagcggccaggccaagtctccaaggcgactaagtttataaggtttctaaccggatcgtgggtcccagacagattcagtgcagtggtcaggcatgattcacactagaaatcagacgagggtggagcgtagaggagtaggttaggtaatttagttactgtctaagtgtacgaaggtgacgacgtacgttcggacccgttaccggttactacgttttcgggaccgtacggggtaaccgtaacggtacgttacgggtaacgtaacgttaaccgtaaaacgttaagttacggtcggtcgtaccggg

SEQ ID NO: 55757 - DNA, 507 bp, Homo sapiens
  misc_feature: GYAE6OF01AMZNS.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctgggtcccagacagattcagtggcagtgggtcaggcactgagttcacactgaaatcagcagggtgaggctgaggatgttggaatttattactgcatgcaaggtgcacattcggcctccggtctacttttggccgtaggggaccaaggctagggagactacaaacgaatgtggctcgg

SEQ ID NO: 55758 - DNA, 534 bp, Homo sapiens
  misc_feature: GYAE6OF01AV25D.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtgggtccagacagattcagtggcagtgggtcaggcactgagttcactacgtagaaatcgagcgagggtggaggctggaggtagtgttaggtaattttacgttacgtgacagtacgacgtaaggtcgctactagttcggccctccggtctacgtttcggccgtagggaccaggtctaggagatacgaacgactggtcgcgtacg

SEQ ID NO: 55759 - DNA, 512 bp, Homo sapiens
  misc_feature: GYAE6OF01A4DQW.46.34.D01.1.454.CMB.1.raw
  modified_base (445)..(445): a, c, t, g, unknown or other
  misc_feature (445)..(445): n is a, c, g, or t
  modified_base (492)..(492): a, c, t, g, unknown or other
  misc_feature (492)..(492): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtggggtcccagacagattcagtggcagtgggtcaggcactgagttcacactagaaatcagcgaggggtggaggcgtgaggatgttaggaatttatactgcatgcgaaggtgcanagttcggcctcggtctacgtttcggccgagggaccaaggcgtagganacgtcaaacgatgtgcgtcg

SEQ ID NO: 55760 - DNA, 526 bp, Homo sapiens
  misc_feature: GYAE6OF01A8ENY.46.34.D01.1.454.CMB.1.raw
  modified_base (401)..(401): a, c, t, g, unknown or other
  misc_feature (401)..(401): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaacgggactcgtgggtccagacagattcagtgcagtgggtcaggcactgagttcacactagaaatcagacagggtggaggcngaggagtgttaggaatttattactgcagtgacgaaggtgcactagttcggccgtccggtctacgttttcgggaccgtacggggacccaaggctaggacgatacgaaacgaacgtgtggcgtacgg

SEQ ID NO: 55761 - DNA, 518 bp, Homo sapiens
  misc_feature: GYAE6OF01D4EO0.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactcgtccctgcccgtcacccttggacagccggcctccatctcctgcaggtctagtcaaagcctgtatacactgatggaaacacctgcctggattggtatcaccagcggccaggccaatcctccaaggcgcctaatttataaggtttctaaccgggactcgtgggtcccagacagattcagtggcagtgggtcaggcactgagttcacactagaaatcagcgagggtggaggcgtgaggtatgttggtaatttattactgcatgcgaaggtgcacgattggcctccggtctacgtttggaccgtacggggaccaaggcgtgggagactacaaacgaactgtggctcg

SEQ ID NO: 55762 - DNA, 527 bp, Homo sapiens
  misc_feature: GYAE6OF01BTDO8.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcacagcggccaggccaatctccaaggcgcctaatttataaggtttctaaccgggactcgtggggtcccagacagattcagtggcagtgggtcaggcactgagttcacactgaaaatcagcagggtggaggctggaggtatggttaggtaattttagttactgctatgacgaaggtgcaacgtagttggccttccggtctacgtttggaccgtacgggaccaaggcgtaggagacgtacaaacgaatgtggctacgg

SEQ ID NO: 55763 - DNA, 569 bp, Homo sapiens
  misc_feature: GYAE6OF01CN69X.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttcaaccggactcgtgggtcccagacagattcagtgcagtgggtcaggcactgagttcacactgaaatcagcgagggtggaggcgtgaggagtgttaggtaattttaattacgtagctagtacgacgtaagggtgacgaacgtagttcggacccttccgggttcctaccgttttcgggacccgtacgggggaccctaaaggtccgtagggaagtaacgtaaccgaaaaccggtaagtcggttacggcgtaccgg

SEQ ID NO: 55764 - DNA, 575 bp, Homo sapiens
  misc_feature: GYAE6OF01BFFM4.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctgggctgctaatgctctgggtcccaggattcagtggggatgttgtgatgactcagtctccactctccctgcccgtcacccttggacagccggcctccatctcctgcaggtctagtcaaagcctcgtatacactgattggaaacacctgcctggattggtatcaccagcggccaggccaatctccaaggcgacctaatttataaggtttctaaccgggtctcgtcgggtccagacagattcgagtggcagtgggtcaggcactgagttcacactagaaatcagcgagggtggaggtcgtagaggtatggtttaggtaattttagttacgtgactagtagtacgtaagggtcgtactacgtagttcggtacccgttccgggttcgtaccgttttcgggacccgtacggggtacccaaggtccgtagggtaacgacgtaaccgaaacgtaacgtggtcggtcgtacgg

SEQ ID NO: 55765 - DNA, 522 bp, Homo sapiens
  misc_feature: GYAE6OF01ARIG1.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaattataaggtttctaaccgggactctggggtcccagacagattcagtggcagtgggtcaggcactgagttcacactgaaaatcagcagggtggaggctgaggatgttaggaatttattactgcatgacgtaaggtgacacagttcggcctccggtctacgttttggccgtaggggaccaaggcgtggaagacgtacaaaacggtagtggtggctacgg

SEQ ID NO: 55766 - DNA, 500 bp, Homo sapiens
  misc_feature: GYAE6OF01B1XPL.46.34.D01.1.454.CMB.1.raw
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (345)..(345): a, c, t, g, unknown or other
  misc_feature (345)..(345): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggatcacagcgcagcaatcncaagcnctaattataagttcaacggatcgngggtcccagacagattcagtgcagtggtnaggcactgagttcacactagaaatcagcgaggtggaggctgagatgttagtaatttattatgctatgcgaaggtgacacgtattcggccttcggtctacgtttcggccgtacgggaccaaggctaggagacgtacaaacgaacgtgtggcgtacg

SEQ ID NO: 55767 - DNA, 543 bp, Homo sapiens
  misc_feature: GYAE6OF01AT52D.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtgggtcccagacagatcagtgcagtgggtcaggcactgagttcacactagaaatcagcgagggtggaggcgtaggaggtatggttaggtaatttagttactgtctatagacgaaggtgacacagttcggccttccggtctaccgttttcgggaccgtacggggaccaaggcgtagggaagaacgtacgaaacggaactaggtggtcgtacgg

SEQ ID NO: 55768 - DNA, 521 bp, Homo sapiens
  misc_feature: GYAE6OF01CLDC1.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaagcgcctaatttataaggtttctaacggactcgtgggtcccagacagattcagtgcaggtggtcaggcactgagttcacactagaaatcagcagggtggaggctggaggagtgttaggtaatttattactgtctatagcgaagtgactagtagttcggtccgtccggtctacgtttcggaccgagggaccaaggcgtaggagacgtacaaacgatggtgcgtacg

SEQ ID NO: 55769 - DNA, 541 bp, Homo sapiens
  misc_feature: GYAE6OF01CTVQS.46.34.D01.1.454.CMB.1.raw
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctcgtatacactgataggaaacacctgcctggattggtatcacagcgccagcatcncagcnctaattatagttcacggactcgtgggtccagacagatcagtggcagtgggtcaggcacgtgagttcacactagaaatcagcgagggtggagctaggaggagtgtagtaattttatacgtgctatagacgtaaggtgactacgtagttcggcccgttccggttacctacgttttcgggacccggtaacggggtaacccaaggtcgtagggaacgtacgtaaccgaaaacgtaccgtaggtcggcctacgg

SEQ ID NO: 55770 - DNA, 547 bp, Homo sapiens
  misc_feature: GYAE6OF01CGUE0.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggccgctaatttataaggtttcaaccgggactctgggtcccagacagattcagtggcagtgggtcaggcacgtgagttcacactagaaatcagacgagggtggaggctggaggattgttggtaattttattatgactagtgacgaaggtgacactagttcggtcccttccggtactacgttttcgggccgtacggggaacccgaaggtcgtagggaagtaagtacgaaacggtaagttggtggtcgtacgg

SEQ ID NO: 55771 - DNA, 673 bp, Homo sapiens
  misc_feature: GYAE6OF01CPD52.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccttggacagccgcctccatctctgcaggtctagtcaaagcctcgtatacactgataggaaacactgcctggattggtatcacaggcggccaggaccaatcctaccaaggccgtaccttaaattttaacgtaacggtttacctaaaccgggcttccgtacggggtccccaagacctagtaacttcgagtggcaggtcgggtacaggactagtgacgttcaactactagaaatacgacggacgtaagggtaggaaggcgtagggaggtagttaggttaggttaaagttttagttaacgtagtacgtaagtacgtacgtaagggttacgaccgtaacgttaacgttccggtacccgttacccggttaccgttaccgggtttttacggacccgggtaaacggggtaacccgtaaacggtaccggttacgggtaaacgtaaccgttaaaccgtaaaaccggtaacggttacgggtcgggtaccgtaccg

SEQ ID NO: 55772 - DNA, 492 bp, Homo sapiens
  misc_feature: GYAE6OF01A3ROH.46.34.D01.1.454.CMB.1.raw
  modified_base (310)..(310): a, c, t, g, unknown or other
  misc_feature (310)..(310): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttanaaggtttctaaccgggactctgggtcccagacagattcagtgcagtgggtcaggcactgagttcacactgaaatcagcagggtggaggctgaggatgttgatttatactgcatgcaaggtgcacattggcctcggtcactttggccgagggaccagctggagactcaaacgaatgtggctcg

SEQ ID NO: 55773 - DNA, 568 bp, Homo sapiens
  misc_feature: GYAE6OF01BRLCU.46.34.D01.1.454.CMB.1.raw
  modified_base (414)..(414): a, c, t, g, unknown or other
  misc_feature (414)..(414): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccaatctccctgcccgtcacccttggacagccggcctccatctcctgcaggtctagtcaaagcctgtatacactgataggaaacacctgcctggattggtatcaccgagccggccaggccaatcctaccaaggcctaccttaaatttacgtaaggtttcctaaccggcttcgtgggtacccagacagattcgagtggcaggtggtcaggcagtgagttcacactagaaatcgagcgaggtgagcngaggtagtgttagtaatttatacgtagactagtgacgtaggtcgactactagttcggtcccgtaccggttcttaccgtttacggaccggtaacgggtaccaaggtccgtagggtaacgaacgtaaccgaaacgtaagtcggtcggtcgtaacgg

SEQ ID NO: 55774 - DNA, 552 bp, Homo sapiens
  misc_feature: GYAE6OF01BYL27.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacatctgcctggattggtatcacagcggccaggccaatctccaaggcgaccttaatttataaggtttactaaccgggactcgtggggtcccagacagattcagtggcaggtgggtcaggcacgtgagttcacactagaaatcagcgagggtggaggcgtaggaggtagtggttacggttaagttttattacgtagtacgtagtcgacgtaaggtcgactacgtagttcggcccgttccggtcttacgtttacgaccgagggaccaagcgtaggacgacgtacaaacgtaactggtgtaccg

SEQ ID NO: 55775 - DNA, 561 bp, Homo sapiens
  misc_feature: GYAE6OF01CPT9U.46.34.D01.1.454.CMB.1.raw
  modified_base (164)..(164): a, c, t, g, unknown or other
  misc_feature (164)..(164): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactnagtctccactctccctgcccgtcacccttggacagccgcctccatctcctgcaggtctagtcaaagcctcgtatacactgataggaacacctgcctggattgatcacagcgcagcatcncagcnctattatagttcacggntcgtggtccagacagattcagtgcaggtggtcaggcacgtgacgttcactactagaaatcgagacgagggtggaggcgtaggaggtatggttagtaatttattacgtagtacgtagtagacgtaaggtgactacgtacgttcggtaccgttccggttacgtaccggttttacgggacccggtaacggggtaaccgtaacggtcgtacgggaacgtaacgtaaccgaaaacggtaacgttacggtcggtcgtaccgg

SEQ ID NO: 55776 - DNA, 578 bp, Homo sapiens
  misc_feature: GYAE6OF01B5N2C.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgccccgtcacccttcggtacgacgccggcccgtcccactcttcctcgcaggtcgtacgtcaaacgacctccgtatacactgatggaaacgaaccctgcctcggattgtagtcaccacgcggccaggccaactctcccaaggacgcctaatttataaggtttctaaccggacgtctcggggtcccacgacagattcagtggcagtggggtcaggcgactgagttcacactagaaatacagcgagggtggagggctgagggtatggtttggaatttattactgcatggcaagggtgcaacagttggcccgttccggttcgtacttttacggggtcccgaagggggaacccgaaagtccgtgggaagataaccaaaccggaaattcggtgggcctaacggg

SEQ ID NO: 55777 - DNA, 562 bp, Homo sapiens
  misc_feature: GYAE6OF01C59J0.46.34.D01.1.454.CMB.1.raw
  modified_base (287)..(287): a, c, t, g, unknown or other
  misc_feature (287)..(287): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggcctccatctcctgcaggtctagtacaaagcctcgtatacactgataggaaacacctgcctgattgatcacagcgccagcatcnccaagcactaattatagttcaaccggactcgtgggtccagacagtattcgagtggcgaggtggtcaggcacgtgagttacacactagaaatcagcgagggtggaggtacgtggaggtagttagttaggtaattttagttactgactagtagacgtaaggtagacgactagttacggtcccgttccgttccgttacgtttcggaccggtaacggggaaccctaaggtcgtagggtacgaacgtaacgaaacgtaacgtacggtagtcgtaaacccg

SEQ ID NO: 55778 - DNA, 511 bp, Homo sapiens
  misc_feature: GYAE6OF01CHDIZ.46.34.D01.1.454.CMB.1.raw
  modified_base (419)..(419): a, c, t, g, unknown or other
  misc_feature (419)..(419): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtgggtcccagacagattcagtggcagtgggtcaggcacgtgagttcacactagaaatcagcagggtgaggctgaggatgttgaatttnttactgcatgcgaggtgcacattggcctcggtctacgtttggccgtaggggaccaggcgtaggagacgtacgaaacggtactggtggctacg

SEQ ID NO: 55779 - DNA, 542 bp, Homo sapiens
  misc_feature: GYAE6OF01B8UJQ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtggggtcccagacagattcagtggcaggtgggtcaggcactgagttcacactagaaatcagcgagggtggaggcgtggaggtagtggttaggtaattttagttactgctagtagacgtaagggtgacactagttcggccgttccggtctacgtttcggaccgtacggggaccaaggtcgtaggagacgtacaaacgtactggtggcgtacg

SEQ ID NO: 55780 - DNA, 513 bp, Homo sapiens
  misc_feature: GYAE6OF01AD9NY.46.34.D01.1.454.CMB.1.raw
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
  modified_base (501)..(501): a, c, t, g, unknown or other
  misc_feature (501)..(501): n is a, c, g, or t
tcagactagcagtacacgaccggtgctcgatttagatcgtctgtgttgggtttgggctgatcaggactcctcagttcaccttctcacaatgaggctccctgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgacaaagtcgggtccagtcgaggttcagtggcagtggatcgtgggacagtatttcactctcacctatcagtaatctgacaacgtataagtntttgactaacttatactntacaactaagtaattanattgtttacgacctaagggacaacgactaacaattaaacgaactgtgctagcactatcttgtacttncttctcccgtac

SEQ ID NO: 55781 - DNA, 585 bp, Homo sapiens
  misc_feature: GYAE6OF01CTO4M.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctgtatacactgatggaacactgcctggattgatcacagcgccagccaatctccaaggcactaattataacggtttcaaccggtatcgtgggtcccagacagtacttcgagtaggcaaggtgggtacagggctacgtgagttcactactagaaatcagcgtagggtggaggcgtaggaggtagtaggttacggtaattttacgttacgtagtactaagtagacgtaagggtcgactacgtaagttcggaccgttccggttaccgtacgttttcggacccgtaacggggtaacccaacggtcgttagggaacgtacgtaaccgtaaacggtaaccgttacggtggtccgtaacgg

SEQ ID NO: 55782 - DNA, 770 bp, Homo sapiens
  misc_feature: GYAE6OF01DOTMK.46.34.D01.1.454.CMB.1.raw
  modified_base (354)..(354): a, c, t, g, unknown or other
  misc_feature (354)..(354): n is a, c, g, or t
tcagactagcagtacacgaccggtgctcgatttagatcgtctgtgttgggtttgggctgatcaggactcctcagttcaccttctcacaatgaggctccctgctcagctcccggtgggctgactatgccttcggtccgggtccgaaggtacttacgtagggtaggggtattggtttgtagtagtacgtacctcgtacgttccctaccctaccttcccttcccgttccggtccccgttaccctaccccggttacggaaccgaccggccccggtccctacctacttcctccgtcgacgtacggttactacgtaacgaacgtccgtacgtaactaccacgtagagtaaacggaaaccnccgtcgtccgttaggtagtttggtacctaccgaaccgcgggccgacgaccggaacctacgtcctacggaaggtccctaactttaatttaaggttacggttaaccgaaccggtactcgggtccggaccagaacgagttatacgaggtcgacgtagggttcggacgacgactacgtggtacttccaactacgtaagtaaactcgacggacggtagggtacggtacggtcgtacgggaggtacgttggttaagttaagttttacgttacgtcgtactagtacgacggtaggtcgactacgttacggttccggtaccgttaccggttacgttaccggtttaccgggaccgggtaaccgggaaccggtacgttcggtacggtacgtaacgtaaccgaaacgtacggtcggtcggcgtaccg

SEQ ID NO: 55783 - DNA, 532 bp, Homo sapiens
  misc_feature: GYAE6OF01AO0XN.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaatcagcgagggtggaggcgtgaggatggttaggaattttattactgactagtgacgtaaggtgcactagttcggcccttccggtcttaccgttttgggcccgtagggggacccaaggctgggagagtacgaaacgaactggtggctcg

SEQ ID NO: 55784 - DNA, 557 bp, Homo sapiens
  misc_feature: GYAE6OF01A8MTT.46.34.D01.1.454.CMB.1.raw
  modified_base (198)..(198): a, c, t, g, unknown or other
  misc_feature (198)..(198): n is a, c, g, or t
  modified_base (393)..(393): a, c, t, g, unknown or other
  misc_feature (393)..(393): n is a, c, g, or t
tcagactagcagtacacgaccggtgctcgatttagatcgtctgtgttgggtttgggctgatcaggactcctcagttcaccttctcacaatgaggctccctgctcagctcctggggctcctgctactctggctccgaggtgccagatgtgacatcgagctgacccagtctccatccctccctgtctgcaaccgtggganacagtgtcaccatcacttgccgggcaagtcggaacatgacacctatttaatggtatcaacatagaccaggacgccctaagctcctaatctatgctgcatccagtttgacaaagtcgggtcccagtcgagttcaggtgcagtggatcgtggacagtattcactctcacatcagtaatctagactaacgtgtaagtntttagactaacttattactgtacaactagtaattactaattgtttacggactaagggacctaacggaacttaactaaaacgttaaacgaacgttcggtacggtactacgtacctaaccgtataccgttacggttacttaccgtacttcccgttccccggtaacc

SEQ ID NO: 55785 - DNA, 525 bp, Homo sapiens
  misc_feature: GYAE6OF01ARANL.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaggcgcctaatttataaggtttctaaccgggactctggggtcccagacagattcagtggcaggtgggtcaggcactgacgttcacactagaaatcagcagggtggaggcgtgaggagtgtttaggtaattttagttactgctagtgacgaaggtgactacagttggcccgtcggtctacgtttcggccgacggggccaaaggcgtaggagatacaaacgatggtgcgtacg

SEQ ID NO: 55786 - DNA, 518 bp, Homo sapiens
  misc_feature: GYAE6OF01A7JUJ.46.34.D01.1.454.CMB.1.raw
  modified_base (515)..(515): a, c, t, g, unknown or other
  misc_feature (515)..(515): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtccagacagattcagtggcagtgggtcaggcactgagttcacactagaaatcagcagggtggaggctgaggtatgttggaatttattactgacagtgacgaagggtgactacattcggcctccggtctacgttttgaccgtaggggtaccaaggcgtggagactcgaaacgacgtgtggntcg

SEQ ID NO: 55787 - DNA, 576 bp, Homo sapiens
  misc_feature: GYAE6OF01C5QWL.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacccttggacagcccggcctccatcctcctgcaggtctagtcaaagcctgtatacactgataggaaacacctgcctggattggatcaccagccggccaggccaatcctcaaggcctactaatttagtaaggtttctaaccgggctcgtgggacccagacagtattcagtggcaggtcgggtcaggcagtgattcacactagaaatcgagacgagggtaggacggcgtaggaggtagttaggttagttaattttacgttactgtactagtagacgtaaggtcgacgtacgtacgttcggtcccgttccggttccgtacggttttcggaccggtaacgggaaccgaaggtcgtaggaagacgtaacgaaacgtagtacggtggtcgtacg

SEQ ID NO: 55788 - DNA, 562 bp, Homo sapiens
  misc_feature: GYAE6OF01EKBXB.46.34.D01.1.454.CMB.1.raw
  modified_base (275)..(275): a, c, t, g, unknown or other
  misc_feature (275)..(275): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcacngcggcaggccaatctccgaaggcgcctaatttatagtttctaaccggactcgtcgggtccagacagtattcgagtggacagtgggtacaggcactgtacgttcactactagaaatcgagcgagggtggacggacgtggaaggtacttggttaggtaattttagttactgactagtacggacgtaaggtgacgtaacgtagtcggtccgtccggtacttacggtttcggaccggtacgggacctaaggtcgtaggtagacgtacgaaacgtacgtcggtggcgtacgg

SEQ ID NO: 55789 - DNA, 566 bp, Homo sapiens
  misc_feature: GYAE6OF01D15HM.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagcccggcctccatctcctgcaggtctagtcaaagcctacgtatacactgataggaaacacctgcctggattggtatcaccagcggccaggccaatcctaccgaaggcgtaccttaatttacgtaacggtttacgtaaccggtactcgtcgggtcccagacagtattcgagtgcgtaggtgggtacaggcacgtgtagttcactaactagaaactcagacgtagggtaggaggcgtggaggtatgttagtaatttagtactgcagtgactaaggtgacacgtagtcggctccggttctacgtttcggaccggtagggacctaaggcgtaggaagtaacgtaccgaaaacggtagtcggtcggcgtacgg

SEQ ID NO: 55790 - DNA, 576 bp, Homo sapiens
  misc_feature: GYAE6OF01DCR9J.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatcctcctgcaggtctagtcaaagcctcgtatacactgataggaaacacctgcctggattggtatcaccagcggccaggccaatctccaaggcgtacctaatttataaggtttactaaccgggactcgtgggtcccagacagattcgagtggcagtgggtcaggcagtgagttcacactagaaatcagcgagggtggaggcgtaggaggtagtgttaggtaatttattactgtcgtagtgacgtaaggtgacactagttcggtcccgttccggttacgtaccgttttcggacccggtacggggtaaccgaacggtccgtagggaacgaacgttaaccgaaaacgtaacgtacggtgggtccgtaccgg

SEQ ID NO: 55791 - DNA, 530 bp, Homo sapiens
  misc_feature: GYAE6OF01DVD7T.46.34.D01.1.454.CMB.1.raw
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (500)..(500): a, c, t, g, unknown or other
  misc_feature (500)..(500): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctctgggtcccaggattcagtggggatgttgtgatgactcagtctccactctccctgcccgtcacccttggacagccgcctccatctcctgcaggtctagtcaaagcctcgtatacactgataggaaacacctgcctgattggatcacngcgcaggcatcncaggcactaattataagttcaacggactcgtgggtccagacagattcgagtggcagtggggcagggcacgtgacttcacactagaaaatgaagcgagggtaggaggcgtaggaggtagtggttaggtaatttattactagcaatggacaagggtgcactagttcggccgttccggtactaccgtttggacccgggtagggaaccaggcgtaggganaagttaccaaacggtaacgtggtgagtacg

SEQ ID NO: 55792 - DNA, 537 bp, Homo sapiens
  misc_feature: GYAE6OF01CONKL.46.34.D01.1.454.CMB.1.raw
  modified_base (333)..(333): a, c, t, g, unknown or other
  misc_feature (333)..(333): n is a, c, g, or t
  modified_base (448)..(448): a, c, t, g, unknown or other
  misc_feature (448)..(448): n is a, c, g, or t
  modified_base (528)..(528): a, c, t, g, unknown or other
  misc_feature (528)..(528): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatcctcctgcaggtctagtcaaagcctacgtatacactgatggaaacacctgcctggattggtatcaccagcggccaggccaatctaccaaggcgtacctaatttagtaagtttctaaccgggntcgtgggtcccagacagattcgagtggcagtgggtcaggcacgtgagttcacactagaaatcgagacgagggtggaggcgtagaggtagtgttaggtaatttattatgctatganaggtgacacgtagttcggccgttccggtctacgtttcggaccgtagggaccaaggcgtggaagactacaaacgattcggnggtcgtacg

SEQ ID NO: 55793 - DNA, 569 bp, Homo sapiens
  misc_feature: GYAE6OF01D2IER.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaacgggactcgtggggtcccagacagattcgagtggcagtgggtcaggcatgagttcacactagaaatcagcgagggtgggaggcgtaggaggtagtgtttaggtaattttagttacgtgacgtagtgacgtaagggtgactacgtagttcggtccgttccggtactacgttttcgggaccggtacggggtacccaaggtccgtaggtaacgtaacgtaccgaaaacggtaacgttcggtggtcgtacgg

SEQ ID NO: 55794 - DNA, 646 bp, Homo sapiens
  misc_feature: GYAE6OF01BAAJL.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggtatgttgtgatgactcagtctccactctccctgcccgtcaccttggacagccgcctcatctcctgcaggtctagtcaaagcctcgtatacactgataggaaacacctgcctggattggtatcacagcgcaggccaatctcaggcacctaattatacgttcaacggctcgtcgggccagactagatcgagtgacaggtggtcaggctaacgtgtagttacacgtactagaaactcgaagcgagggtaggaggtacgtaggaggtagttcggttaagttaattttacgttaacgtgtacgtagtacgtacgtaagggttacgtacgaacgttacggttaccggtcccgttacccgggttacgttacccggtttttacggggaaccccggtaacgggggtacccgtaaacgggtaccgggttaacgggtaaacggtaaaccggttaaaccggaaaaacccgggtaaacggtttccgggtaagggttcccgttaaacccgg

SEQ ID NO: 55795 - DNA, 776 bp, Homo sapiens
  misc_feature: GYAE6OF01BSLT0.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacctggacagcccgcctccatctcctgcaggtctagtacaagcctagtatacactgataggaaacacctgcctggattgtatcacagcggccaggccaatcctaccgaaggccgtacttaaagtttagttaacggtttccgtaaccggtactcgtcggggtaccaagacgagtattacgaggttcggacgtaggttcggggtaccgacgggtacctacgttaggtacgttttaccgaaccgaacgtttaaacggtaaaaacgttaccgtaacgggtaccggtaaaggggggttaggggtaaacggggtaccggttaggggtaagggttaagttttagggttttaaggggttaaacgttttttaacgttttaacgttacggtacgttaacgttacggtaacggtaacgggttacggtaaccgtaacgttaacggtttcccggggtacccggttacccgggtttaccgttacccggtttttacggggacccggtaacgggggtaacccgtaaacgggtccggttaacggggtaacggtaacgttaaacccggaaaaccggttaacggttacgggtcgggtcggtaacccgg

SEQ ID NO: 55796 - DNA, 601 bp, Homo sapiens
  misc_feature: GYAE6OF01DLJU7.46.34.D01.1.454.CMB.1.raw
tcagactagcagtacacgaccggtgctcgatttagatcgtctgtgttgggtttgggctgatcaggactcctcagttcaccttctcacaatgagctccctgctcagctcctggggctgctaatgctctgggtcccaggattcagtggggatgttgtgatgactcagtctccactctccctgcccgtcacccttggacagccgcctcatctcctgcaggtctagtacaaagcctacgtataccatgataggaaacacctgcctggattggatcaccagcggccaggccaatcctaccgaaggcgtaccttaaatttagtaacggtttccaaccgggctcgtcgggtacccagacagtattcgaggtggcaggtgggtcagggcacgtgacgttcacactagaaatcgagcgagggtggaggcgtaggaggtagttggttaggtaatttagttactagcgtagtagacgaagggtgacgtacgtacgttcggtacccgttaccggttcgtaccgttttacgggacccggtaacggggaacccgtaacgggtccgtagggaacgtaacgtaaccgaaacgtaacgtacggtcgggtaccgtacgg

SEQ ID NO: 55797 - DNA, 790 bp, Homo sapiens
  misc_feature: GYAE6OF01DMDRL.46.34.D01.1.454.CMB.1.raw
  modified_base (174)..(174): a, c, t, g, unknown or other
  misc_feature (174)..(174): n is a, c, g, or t
  modified_base (254)..(254): a, c, t, g, unknown or other
  misc_feature (254)..(254): n is a, c, g, or t
  modified_base (279)..(279): a, c, t, g, unknown or other
  misc_feature (279)..(279): n is a, c, g, or t
tcagactagcagtacacgaccggtgctcgatttagatcgtctgtgttgggtttgggctgatcaggaccctctacgtctacctccttctacaactagaggcgtccctcgctcagctccgtcggggtcgtgactaatgctcctgggtcccaggagttcaggtggggtatgttggtnactgactcagtctccactcctccctcgtcccgtcctacccgtacggacgacgcccggtccctacctacttctccgtacgngtacggttactacgtaccggaaacnccgttacttaacaacctacggtagtcgtaaacgaacctacgtccgtcggtacgtaggttacgtactaccgaccgacggccggtacgcggaacctacgttacctaccggtaaaagttccgtaaacgtttaacgtttaaacgttacgttaccggtaaccggtactcgggtacggtacacgtaacgagttcgtacgtaggtcggacgtagggtccggtagtacgggactcgtaagtacgtaacaacgtgtaaaacgttaacgaacggcggtaacgggtagggtaagggaggttacggtaggtaacgggttagtaacgttttaggtaactttagtaccgtatacgggtactaacgggaagttccgggtacgtaaccgttcgggtaccgttaccgggtttacccgtaacgggtttacgggtaacccgttacggggaaccgtaacggggtacctaacgggtacgaacggtaacgtaacggtaacgtaacggtacgtaccgtggtaccgtcgtaaccg

SEQ ID NO: 55798 - DNA, 529 bp, Homo sapiens
  misc_feature: GYAE6OF01BVRS7.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctcaaggcgcctaatttataaggtttctaaccggactcgtggggtccagacagattcgagtggcaggtgggtcaggcatgagttcacactagaaatcagcagggtggaggctgaggtatgttaggtaatttattactgcatgacgaaggtgcactagttcggccgtccggtctacgtttggccgtacggggaccaaggtcgtaggacgaacgtacgaaacgaacgtggtcggcgtacgg

SEQ ID NO: 55799 - DNA, 646 bp, Homo sapiens
  misc_feature: GYAE6OF01DCCJA.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatcctcctgcaggtcagtcaaagcctagtatacatgatacggaaacacctagcctggattggactcaccagccggaccaggaccaatcgaccgaaggtccgtacctaatttataagggtttctaaccgggactcgtcgggtcccagacagtattcagtggacaggtggtcaggctactgtagttcactactagaaactcgagcgagggtacggaggtacgtaggtaggtagttaggttagttaattttattacgttagtacgtaagtggtacgtaagggtacgtaccgtaacgtacgttccggtcccgtttacccgggttaccgttaccggttttaccgggacccggtaaacgggggtaacccgaacggtccggtaacgggtaagtaacgttaacccggaaaaccggttaccgttacgggttccggtccgttaacccgg

SEQ ID NO: 55800 - DNA, 563 bp, Homo sapiens
  misc_feature: GYAE6OF01DK0SL.46.34.D01.1.454.CMB.1.raw
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactcctccctgcccgtcacccttggacagccgcctccatcctcctgcaggtctagtacaaacgtcctacgtatacactgataggaacncctgcctggattgatcacagcgccagcatcncgagcactaattataagttcaacggctcgtcggtccagacagtattcgagtggcaggtggacaggcagtgagttcacactagaaatcagacgagggtggaggtcgtaggaggtagttaggttaggttaattttacgttacgtgacgtaacgtagacgtaaggtgacgtacgtagttccggtccgttaccggttacgtacgtttacgggaccggtaacgggaaccaaggtcgtaggaacgtaacgtaccgaaaacgtacgtaggtggcgtacg

SEQ ID NO: 55801 - DNA, 793 bp, Homo sapiens
  misc_feature: GYAE6OF01EN511.46.34.D01.1.454.CMB.1.raw
tcagactagcagtacacgaccggtgctcgatttagatcgtctgtgttgggttggggctgatcgaggacgtcctccagttcaccttcgtacaccaacgtgtacggcttcccgtgctcagctcctggggactgctaagtgcctcctgggtcccgaggttagttcaggtggggattgggtttcgtgtatcgtacttacgaggttctccctacttccgtccctggcccgtcctaccccgttgggacgacgggtcccggggcctccgtacgtcctccgtcgtcggtacggttcctagtacgaacgtcctcgtatacactgactacggaacctacctcgtacccttggtaatttaggtactccgacctacggccggaccgagggtccgtaactccgtaccggaaccggtccgtaaccgttaaagtttaacggtaacggtttaccggtaaaccggggtacgttccgggtacggggtaccctaaggtaacctacggtacttacggagggtacggtacgtagggttcgggtacgtacggtaccaacgtaggtaccgttccaacgaaccggtaacgaaaacttccgaacggtacgtacggggtacgaacgggtaccgtaggtaacggttacgttaagggttaacgttaacgttttaacgttactgggtactacgtaccgacggtaacggtacgaccgtacgtacgttaccggtcccgtaccggttaccgttaccggtttcgacccggtaaccgggtacacggtcggtaggagaacgtacgtaaacggtagtcggtgtcctagg

SEQ ID NO: 55802 - DNA, 530 bp, Homo sapiens
  misc_feature: GYAE6OF01DHO6A.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggttctaaccggactctgggtccagacagattcagtggcagtgggtcaggcactgagttcacactgaaatcagcagggtggaggctgaggatgttaggaatttattactgcaatgacgaaggtgcacagttcggccttccggtctaccgttttgggccgtaacggggaccctaaaggcgtaggaagaactaccgaaaacgtactaggtgggcgtacgg

SEQ ID NO: 55803 - DNA, 560 bp, Homo sapiens
  misc_feature: GYAE6OF01BLEFP.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctcgaaggcgcctaatttataaggtttctaaccgggactcgtcgggtcccagacagatcagtggcaggtgggtcaggcacgtgagttccacactagaaatcgagacgagggtggaggcgtggaggagttggttaggtaattttattacttagcgtaagtgactaagggttgactaacgtagttcgggcccgttcccggttctaccgttttaggcccgtaacggggaccaaggcgtacgggaagaactacgaaacgaagtggtggctacgg

SEQ ID NO: 55804 - DNA, 551 bp, Homo sapiens
  misc_feature: GYAE6OF01BFS5E.46.34.D01.1.454.CMB.1.raw
  modified_base (258)..(258): a, c, t, g, unknown or other
  misc_feature (258)..(258): n is a, c, g, or t
  modified_base (465)..(465): a, c, t, g, unknown or other
  misc_feature (465)..(465): n is a, c, g, or t
  modified_base (546)..(546): a, c, t, g, unknown or other
  misc_feature (546)..(546): n is a, c, g, or t
tcagactagcagtacacgaccggtgctcgatttagatcgtctgtgttgggtttgggctgatcaggacctcctcagttcaccttctcacaatgaggcctccctgctcagctcctggggctgctaatgctctgggtcccaggattcgaggtgggggatgttgtgatgactcagtctccactctccctgcccgtcacccttggacagccgcctccatctcctgcaggtctagtcaaagcctcgtatacactgatggaaacncctgcctggattggtatcaccagcggccaggccaatctaccaaggcctaccttaaatttagtaacggtttactaaccgggtactacgtcgggtcccagacagattcgagtggcaggtggtcaggcatgattcacatagaaatcagcgagggtggaggtcgaggaggtatggtttaggtaattttatactgctagtgacgtaagggtnacgtactagttcggcccttccggtcttacgtttcggccgtacgggaccaaggtctaggagactacaaacgtatggtcggtntacgg

SEQ ID NO: 55805 - DNA, 577 bp, Homo sapiens
  misc_feature: GYAE6OF01BHX1U.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctcatctcctgcaggtctagtcaaagcctgtatacactgataggaaacacctgcctggattggtatcacagcggcaggccaatcctccaaggctacctaatttataaggtttctaaccggactcgtcgggtaccagacagattcgagtggcaggtggtcaggcaacgtggattcactactagaaatcgagtacgagggtaggaggcgtaggtaggtagttaggttaggtaatttaagttactagtactaagtagtacgtaaggtgacacgtagttcggaccgttccggttcgtacggtttacgggaccgtaacggggtaacccgaaggtcgtacggtagaacgtaacgaaacgtaaacgtcggtcgtcgtacg

SEQ ID NO: 55806 - DNA, 527 bp, Homo sapiens
  misc_feature: GYAE6OF01B0YEG.46.34.D01.1.454.CMB.1.raw
  modified_base (437)..(437): a, c, t, g, unknown or other
  misc_feature (437)..(437): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccggactcgtgggtcccagacagattcagtggcagtgggtcaggcactgagttcacactagaaatcagacagggtggaggcgtgaggatggttaggtaatttattactgcagtagngaagggtgacactagttggccgtccggtctacgttttcggaccgtagggaccaaggcgtaggagactacgaaacgaacgtgtggcgtacg

SEQ ID NO: 55807 - DNA, 558 bp, Homo sapiens
  misc_feature: GYAE6OF01DARJB.46.34.D01.1.454.CMB.1.raw
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccctggacagccggcctccatctcctgcaggtctagtcaaagcctcgtatacactgataggaaacacctgcctggattggtatcaccagcggccaggccaatcnccaaggcactatttatagttcaaccgggntcgtgggaccagacngattcagtgcaggtgggtcaggcatgattcacactagaaatcgagcgagggtaggaggcgtgaggtataggttaggtaattttatactgacagtgacgtaaggtgacactacgttcggcccgttaccggttcctaccgttttcgggacccggtaacggggtaacccgaacggtcggtagggtacgaacgtaaccgaaaacgtacgttacggtgggtctacgg

SEQ ID NO: 55808 - DNA, 558 bp, Homo sapiens
  misc_feature: GYAE6OF01CO9HN.46.34.D01.1.454.CMB.1.raw
  modified_base (287)..(287): a, c, t, g, unknown or other
  misc_feature (287)..(287): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccctggacagccgcctcatctcctgcaggtctagtcaaagcctcgtatacactgatggaaaccacctgcctggattggtatcaccagcgcaggccatcncagcactaattataaggtttcaacggctcgtcgggtccagacagnttcagtgcngtggcaggcactgntcacactagaaatcagcgagggtggaggcaggaggtagttaggttaggttaattttatacgtagtactagtacggacgaagggtcgactacgtagttacggtccgttcccggttcgttaccggttttcgggacccggtaacggggaccgtaacggtcgtagggacgtaacgtaacgaaacgtaacgttcggtcggtcgtacgg

SEQ ID NO: 55809 - DNA, 569 bp, Homo sapiens
  misc_feature: GYAE6OF01DRZGB.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagcccggcctccatctcctgcaggtctagtcaaagcctcgtatacactgatggaaacacctgcctggattggtatcaccagcgccaggccaatctccaagcgcctaatttataaggttctaaccggactcgtgggtcccagacagattcagtgcagtgggtcaggcactgagttcacactagaaatcagcgagggtggaggcgtagaggattggttaggtaattttagttacgtgactagtgacgtaaggtgacactacgttcggtcccgttccggttccgtaccgttttcggacccggtaaccggggtaacccgaacggtccgttagggaacgtaacgtacgaaaacgtaacgtacggtcggtcgtaccgg

SEQ ID NO: 55810 - DNA, 771 bp, Homo sapiens
  misc_feature: GYAE6OF01B8S25.46.34.D01.1.454.CMB.1.raw
  modified_base (258)..(258): a, c, t, g, unknown or other
  misc_feature (258)..(258): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacccttggacagcccgcctccatctcctgcaggtctagtcaaacgcctcgtatacactgataggaaaacncctgcctggtattggtaatccaccgaggccggaccaacgggaccaagttccaccgaaagggtcctaacctttaaagttttaacgttaaacgggttttaccgtaaacccggggacttccgttcgggggtaccccaaggaacctaaggtaacgtttccgaagggtttcggggacccgtaaggggtttcgggggtacccaaagggggccctaaccggttaggtaacggttttacccaaccgtaaaccgtttagggaaaaaacttccgaacgggtaccggtaaggggggttagggaaccggggtacgttagggaaggggttaaggttagggttttaagggttaaacttttttaacgtttaagtacgtacgtaagttacggtacgtaaacggggttcacgttaaacgtacgtttcgggccctttaaccgggtcttacggtttcgggacccggtacgggtaaccacggtcgtacgggaataacgttaaccgaaacgtaacgttcggtggtcgtaaccgg

SEQ ID NO: 55811 - DNA, 528 bp, Homo sapiens
  misc_feature: GYAE6OF01DYBEZ.46.34.D01.1.454.CMB.1.raw
  modified_base (292)..(292): a, c, t, g, unknown or other
  misc_feature (292)..(292): n is a, c, g, or t
  modified_base (523)..(523): a, c, t, g, unknown or other
  misc_feature (523)..(523): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgataggaaacacctgcctggattggtatcaccagcggcaggccaatcncgaggcgctaattataagtttcaaccggatcgtgggtccagacagattcagtgcagtggtcaggcactgagttcacactgaaaatcagcaggtgaggctagagtatgtagtatttattactgcatgacgtaaggtgtacactacgttcggcccgtccggttccttacgtttcgggtccgaacgggggtaaccaaggtcgtagggagaacgtacaaaacgaacttggtcggngtacg

SEQ ID NO: 55812 - DNA, 779 bp, Homo sapiens
  misc_feature: GYAE6OF01EIVCH.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactcctccctgcccgtcacccttggacacgcccgcctccatctcctgctaggtctagtacaaagcctacgtatacactgaataggaaacctccgtgccgtaggtattggtaactccaccgaggccggaccaggacccaaactccgtaccgaaaggccgtaccttaaattttacgtaaacgggtttccgaaaccgggtctccggtcggggtacccaaggaactagtacttcgaaggtcggacgtagggtcgggtaccgagggtacctaacgtaggtaaccgttaccaaccgtaacgtaacggtaaaacgttcggaaacgggtaccggtaaggggtacgggtaacgggtaccgtaaggggtaagggttaagtttagggtttaagggtttaaacgtttttaacgtttaccggttagtaaccgtaaggttacggtaaccggtaaaggggttccgtaaccgtaacgttaacggtttccgggtaccccggttccgggttacccgtttaccgggtttaccgggaacccggtacggggtaacccaagggtacccgtagggtaacgtaaaccgttaaaccggaaacgttaaccggtaggttccggacgttaaccgg

SEQ ID NO: 55813 - DNA, 562 bp, Homo sapiens
  misc_feature: GYAE6OF01ERBBG.46.34.D01.1.454.CMB.1.raw
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctcctgcccgtcacccttggacagccgcctccatctcctgcaggtctagtcaaagcctcgtatacactgataggaaacacctgcctgattggtatcacagcgccaggcaatcncaagcnctaattataagttcacggactcgtcgggtccagacagattcagtgcaggtagggtcaggcatgattcacactagaaatcagngagggnggagctaggaggtatggttaggtaatttattacgtgactagtacgacgtaaggtagactacgtaacgttcggtccgttccggtaccgttaccgttttacggacccggtacggggaacccgaagggtcgtacgggtaacgaacgttaaccgaaacggtaagttcggttacggtccgtacgg

SEQ ID NO: 55814 - DNA, 569 bp, Homo sapiens
  misc_feature: GYAE6OF01A4WI0.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgataggaaacacctgcctggattggtatcaccagcggccaggccaatctccaaggcgacctaatttataaggtttctaaccgggactcgtcggggtcccagacagtacttcagtggcaggtgggtcaggcactgagttcacactagaaatcagcgaggggtggaggcgtaggaggtagttaggttaggtaattttagtacgtgactagtgacgtaaggtgactactagttcggtcccgtccggtctacgtttcgggaccgtacggggaacccaaggtccgtagggaacgacgtaaccgaaacgtaacgtggtacggtcgtaccgg

SEQ ID NO: 55815 - DNA, 587 bp, Homo sapiens
  misc_feature: GYAE6OF01CM1G2.46.34.D01.1.454.CMB.1.raw
  modified_base (199)..(199): a, c, t, g, unknown or other
  misc_feature (199)..(199): n is a, c, g, or t
  modified_base (275)..(275): a, c, t, g, unknown or other
  misc_feature (275)..(275): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctctgggtcccaggattcgagtggggatgttgtgatgactcagtctccactctccctgcccgtcaccctggacncgccgcctccatcctcctgcaggtctagtacaaacgcctacgtatacactgagtagaaccacctgcctggattgancacgagcgccagccatcacaagctactaattataagttacacggactcgtcgggtaccagacagtatcgagtgcgaggtgggtacaggctacgtgtacgtcactacgtagaaactcgaaggcgagggtaggaggtacgtaggaaggtagttaggttagttaattttagttacgtagtactagtagtacgtaaggtgacgtaacgtacggtcggtcccgttaccggttacgttaccggtttcgggaccggtaacggggtaaccaggtcgtacggtaacgtacgtaaccgtaaacggtacggtggtggcgtacg

SEQ ID NO: 55816 - DNA, 573 bp, Homo sapiens
  misc_feature: GYAE6OF01D7JXQ.46.34.D01.1.454.CMB.1.raw
  modified_base (290)..(290): a, c, t, g, unknown or other
  misc_feature (290)..(290): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctgtatacactgatggaaacactgcctggattggtactcaccagccgccaggccaatcncaaggcaccttaattagtaaggttcaaccgggtactcgtcgggtccagactagtacttcgagtggcgtaggtggtcaggcagtgagttcacactagaaatcgagacgagggtaggaggtcgtaggaggtagtggttagtaatttagttagtagacgtagtagtacgtaaggtcgtacactagttacggtcccttcggttacgtaccgttttacgggaccggtaacggggtaaccaggtcgtaggtaacgaacgtacgaaacgtaacgtggtacggtcgtacgg

SEQ ID NO: 55817 - DNA, 549 bp, Homo sapiens
  misc_feature: GYAE6OF01EIQU1.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctacgtatacactgatggaaacacctgcctggattggtatcacagcggccaggccaatctccaaggcgcctaatttataaggtttctaaccgggactcgtggggtcccagacagattcagtggcaggtgggtcaggcatgagttcacactagaaatcagacgagggtaggaggcgtagaggtagtgttaggtaatttagttactgcgtatagacgaggtagacacagttcggtccgtccggtcgtaccgtttacgaccgtacggggtaccaacggcgtggagtaacgtacgaaaacgtaacgtaggtcggcgtacgg

SEQ ID NO: 55818 - DNA, 593 bp, Homo sapiens
  misc_feature: GYAE6OF01A6IMZ.46.34.D01.1.454.CMB.1.raw
  modified_base (253)..(253): a, c, t, g, unknown or other
  misc_feature (253)..(253): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctgtatacactgatggaaacncctgcctggattggtatcaccagccggccaggccaatcctaccaaggccgtacctaatttataaggtttctaaccgggtactcgtcggggtacccagacaagtattcgagtggacaggtgggtacagggtcaacgtgtacgttcactactagaaatcgagcgagggtggaggcgtaggaggtagtggttaggtaatttacgttacgtagtacgtaagtagacgtaagggtacgacgtaacgtagttcggcccgttaccggttctaccggttttcggaccggtacgggtaccaaggtcgtaggagaacgtaacgaaacggtaacgtcggtacggcgtacgg

SEQ ID NO: 55819 - DNA, 560 bp, Homo sapiens
  misc_feature: GYAE6OF01CKG5O.46.34.D01.1.454.CMB.1.raw
  modified_base (555)..(555): a, c, t, g, unknown or other
  misc_feature (555)..(555): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctacgtatacactgataggaaacacctgcctggattggtatccaccaggccggccaggccaatcctaccaacggcgtaccttaaatttagtaaacggtttcctaaaccgggactccgtgggtacccagacagtacttcgagtgacgagtgggtcaggcatgagttacacaactagaaatcgaagcgagggtgaggcaggaggtatggttagtaatttatagtgcgaatagacgtaaggtgacatagttcgccgttcggtactaccgtttggaccgtacgggacgaacggtcgtaggaagacgtacgaaacgtacgtgtcggtntaccg

SEQ ID NO: 55820 - DNA, 548 bp, Homo sapiens
  misc_feature: GYAE6OF01AJKRA.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtccccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctcaaggcgacctaatttataaggttctaaccgggactcgtcggggtcccagacagattcagtggcaggtgggtcaggcactgagttcacactagaaatcagcgagggtggaggcgtaggaggtatggttaggtaattttagttaactgactagtagcgtaagggtgacacgtagtcggtccgttccggtctacgtttcggaccgtacggggacctaaggcgtaggagacgtacgaaaccgtagtggtggtcgtacg

SEQ ID NO: 55821 - DNA, 573 bp, Homo sapiens
  misc_feature: GYAE6OF01EOG4A.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactagaaatcagcagggtgaggctaggaggtatggttaggtaattttattacgtgacgtagtaggaccgtaagggtcgacaacgtagtttcgggcccgttccgggttaccttaccgttttcgggacccgtaagggggtaacccaaggtccgtgggaacgtaacgtacgaaaacgtaacgttggtcggcgtaccgg

SEQ ID NO: 55822 - DNA, 623 bp, Homo sapiens
  misc_feature: GYAE6OF01BX7XK.46.34.D01.1.454.CMB.1.raw
  modified_base (454)..(454): a, c, t, g, unknown or other
  misc_feature (454)..(454): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttccccgtgatgactcagtctccactctccctgcccgtcacccttggacagccggcctccatctcctgcaggtctagtacaaagcctcgtatacactgaataggaaacacctgcctggtattggtatccaccgagccggccaggaccaactcctaccgaagggccgtaccttaaattttacttaacggtttacgtaaccgggacttcgtcggggtacccaagacagtattcgagtcggacgtaggtcgggtacaggcacgtgagttaccactaacgtagaaagtcgagcgagggtggacggngtaggaggtagttggttagtaattttagttactgtactagtcgacgaaggtgactacgtagttcggtaccgtccggttacttacgtttcgggaccggtaacggggtaaccaacggtcggtacgggaacgtaacgtaaccgtaaacggtaacgttcggtcggtccgtacg

SEQ ID NO: 55823 - DNA, 596 bp, Homo sapiens
  misc_feature: GYAE6OF01CQOBZ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacccttggacagcccggcctccatcctctgcaggtctagtacaaagcctacgtatacatgataggaaaccacctgcctggtattggtatcaccagcggccaggccaatccaccgaaggcgtaccttaatttagtaacggtttactaaccgggacttcgtcggggtacccagacagtattcgaggtggcgaggtcgggtcaggcacgtgacgttacactactagaaactcgaaggcgagggtaggaggctagggaagtagtaggttagttaatttagttacgtagactagtagacgtaaggtgactacgagttcggcccgttccggttacgtccggtttacggaccggtacggggtacaacgggtcgtaggaaggtaactaacgaaaccggtaagtcggtaggcgtacg

SEQ ID NO: 55824 - DNA, 592 bp, Homo sapiens
  misc_feature: GYAE6OF01C7FX4.46.34.D01.1.454.CMB.1.raw
  modified_base (290)..(290): a, c, t, g, unknown or other
  misc_feature (290)..(290): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctcactctccctgcccgtcacctggacagccggcctccatctcctgcaggtctagtcaaaagcctcgtatacactgataggaaacacctgcctggattggatcaccagcggccaggccaatcnccaaggcgtacctaaatttataaggtttcaaccgggacttcgtgggtcccagacagacttcagtggcaggtgggtcaggcactgagttcaacactagaaatcgagacgagggtggaaggcgtggaaggtagtggttaggtaattttaagttactgtctagtagacgtaaggtgacacgtaagttcggcccgttaccggttactaccggttttacgggaccggtaacggggtaacccgaagggtccgtagggtaaacgtaacgtaaccgaaaacggtaacgttacgggtcggtacgtaaccgg

SEQ ID NO: 55825 - DNA, 618 bp, Homo sapiens
  misc_feature: GYAE6OF01CM7UK.46.34.D01.1.454.CMB.1.raw
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (395)..(395): a, c, t, g, unknown or other
  misc_feature (395)..(395): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggcctccatctcctgcaggtctagtcaaagtcctcgtatacactgatggaaacncctgcctggatggatcacagcgccagccaatcncaaggcactaattataaggtttcaacggactcgtcgggtaccagactagattcacgtggcgaggttgggtcgaaggctacgtggacgttacaacacgtagaaactnaacgaggtagggtacgggaaggccgtaggaggtagttagggttagtaagttttaatacgtagacgttaagacggtacgtaagggtcgaactaacgtacggttccggtacccggttaccgttcgtaccggttttagggaccccggtaagggggtaacctaacggtccggaagggtaaaccgaacgtaacggtaaaaccgtaggttacgtcggggtcctaaccgg

SEQ ID NO: 55826 - DNA, 602 bp, Homo sapiens
  misc_feature: GYAE6OF01CLDEB.46.34.D01.1.454.CMB.1.raw
  modified_base (261)..(261): a, c, t, g, unknown or other
  misc_feature (261)..(261): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtgggtcccaggattcaggtgggggatgttgtgatgactcagtctccactctccctcgcccgtcacccttggacacgccgcctccatctcctgcaggtctagtacaaacgcctagtatacactgatagaaacnctgctaggattgtactcacaggcggccagccaatcacagctactaatttagtaacggttacacggactcgtcgggtacccagacagtacttcgagtggacaggtcgggtacaggtcacgtagtacgttacactaacgtagaaactcgacggacggagggtaggaggtcgtaggtaaggtagttaggttaggttaattttaagttacgtgtataagtagtacgtaaggtacgacgtaacgtacgttcggtaccgttccggttactacggtttacggaccggtaacgggaccgtaacggtcgtaggaagtaacgtaaccgaaacgtacgtcggtcggcgtacg

SEQ ID NO: 55827 - DNA, 676 bp, Homo sapiens
  misc_feature: GYAE6OF01B7UY9.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctcgcccgtctaccgtgacacgccgcctcactcctcctgcgtaggtctacgtacaaacgtccttacgtatacactagaatacggaaaaccaccgtcgccgttggtacgtttcggtaactccaaccgaggccggaccgacggacctaactcctaacccggaaggtccgtaacctttaaagttttaacgttaaacggtttaccgtaaacccgggcttaccggtcgggtaccccagactaacgtattcgaggtcggacgtagggttcggtcgaggcctagtaggtactactaacacgtaagaaactacgaggacggagggtagggacgtcggtaggaggtagttaggtaacgttaagtttagttacgtgtacgtagtacgacgtaggtgtactacgtacgttccggtcccgttccggttacgttaccggtttcgggacggtaacgggaacgaacggtcgacgggtaagtaacgtaacgtaaacgtagtacggtcgcgtacg

SEQ ID NO: 55828 - DNA, 687 bp, Homo sapiens
  misc_feature: GYAE6OF01C781T.46.34.D01.1.454.CMB.1.raw
  modified_base (274)..(274): a, c, t, g, unknown or other
  misc_feature (274)..(274): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggatgttgtgatgactcagtctccactctccctgcccgtcaccttggacagccgcctcatctctgcagtctagtacaaagcctacgtatacactgaatacggaaacacctgcctggtattggtanccacgaggccggccaggcctaatcctaccgaaggcgtaccttaaaattttacgtaaacgggtttccgtaaaaccgggcttcggtacggggtcccaaggaccagtacttcgaaggtgcgagtgggtacaggcacgtgtacgttacactaactaagaaaactcaaggtacgagggtaggaggtacgtaggaagggtagttaggttaaggttaattttacgttaacgtagacgtagtacggaccgtaagggtacgacgtaacgttacggttaccggtcccgttaccggttaccgttaccgggttttaccgggaacccggtaaacgggggtaaccgtaaacgggtccggttaacgggaaacgtaaacgtaaacccggaaaaacggtaacggttacgggttacggtaccgttaaccgg

SEQ ID NO: 55829 - DNA, 637 bp, Homo sapiens
  misc_feature: GYAE6OF01CLLSX.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccctggacagccgcctccatctcctgcaggtctagtcaaagcctacgtatacactgataggaaacacctgcctggattggtatcaccagccggccaggccaatcctaccaaggccgtaccttaaattttaacgttaaacggttttccgtaaccggggtacttccgtacggggtccccaaggactaagattcgaaggtggcgtaggtcgggtcaggcacgttgagttcacactagaaatcgagacgaggaggagcgtagaggtagttggttagtaagttttattacgtagacgtagttaggacgtaagggtagtaccgtaacgtaacgtttcggtacccgttcccgggttaccgttaccgtttttacgggacccggtaacggggaaccgtaaacggcggttagggaacgtaacgtaacgaaaacgtaacgttggtacgggtcgttaccgg

SEQ ID NO: 55830 - DNA, 559 bp, Homo sapiens
  misc_feature: GYAE6OF01DRL24.46.34.D01.1.454.CMB.1.raw
  modified_base (255)..(255): a, c, t, g, unknown or other
  misc_feature (255)..(255): n is a, c, g, or t
  modified_base (325)..(325): a, c, t, g, unknown or other
  misc_feature (325)..(325): n is a, c, g, or t
tcagactagcagtacacgaccggtgctcgatttagatcgtctgtgttgggtttgggctgatcaggactcctcagttcaccttctcacaatgagctccctgctcagctcctggggctgctaatgctctgggtcccaggattcagtggggatgttgtgatgactcagtctccactcctccctgccccgtcacccttggacagccggcctccatctcctgcaggtctagtcaaagcctcgtatacactgatggaaacncctgcctggattggatcaccagcgccaggccaatcctcaaggccacttaatttataaggtttcaaccggntcgtgggtccagacagattcagtgcaggtggcaaggcactgagttcacactagaaatcaaggcgagggtagggaggcgtaggaggtagttggttaggtaattttattacgtgtcgaatgacgtaaggtgactacgtagttcggccgttccggtctacgtttcggacccggtacggggaaccgtaaggccgtagggacgtaacgtaacgaaaacgtacgtaggtcggtcgtacgg

SEQ ID NO: 55831 - DNA, 535 bp, Homo sapiens
  misc_feature: GYAE6OF01ESW68.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatcctccaaggcgcctaatttataaggtttctaaccgggactctggggtcccagacagattcgagtggcagtggtcaggcactgagttcacactagaaatcagcgagggtgaggctgaggtagtgttaggtaatttattacgtgtcatgacgaaggtgacacgattggcccgttcggtcgtaccgttttcgggaccgtacggggtaccaaggtcgtaggagacgtacgaaacgacgtgtggcgtacg

SEQ ID NO: 55832 - DNA, 709 bp, Homo sapiens
  misc_feature: GYAE6OF01DCXBM.46.34.D01.1.454.CMB.1.raw
  modified_base (255)..(255): a, c, t, g, unknown or other
  misc_feature (255)..(255): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccgcctccatctcctgcaggtctagtcaaagcctcgtatacactgataggaaccnctgcctggattggtactcacgagcggaccaggccaatcctacgaaggcctaccttaaattttacgtaaacgggtttccgtaaacccggggacttccggtacggggtacccaaggtaacctaagggtactttccgaaggttgggaccgtaagggttcggggtacagggtcctaacggttggtaacgtttaccaacgtaacgtaagaaaacgtcgaaggacggtaaggggtacgggaacggtacgtagggtagggtagttagggtttaaggttaaagttttaacgttaacgtagtacgtaataggtacgtaaacgggttgaccgttaacgtacggttcgggacccgttccgggttacttaccggtttacgggacccggtaacgggggtaacccgtaaggtccggtaagggtaacgtaacgtaaccgaaacggtaacgtcgggttacggcgtaccgg

SEQ ID NO: 55833 - DNA, 740 bp, Homo sapiens
  misc_feature: GYAE6OF01D0BK8.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagcccggcctccatcctcctgcaggtctagtacaaagcctcgtatacactgataggaaaccacctgcctggtattggtactcaccagccggaccaggccaatcctaccgaaacggccgtaccttaaagttttaacgttaaacgggtttaccgtaaacccgggtacttccggtacggggtaccccaaggaacctaagtactttacgaaggtcggaccgtaggtcgggtacgagggtcctacgtaggtaacgtttccaacgtaaccgtaagtaaaactcgaagggtacggtaggggtacggaacggtcgtaggtacggtagttaggtttagggttaattttaacgttacgtacgtacgtaacgttacggtacggtaacgggttgtaccgtaacgttacggtttccgggtaccccgtttacccgggtttaccgttaaccgggttttacgggaccccgggtaaacgggggtaacccgtaacgggtaccggtagggtaacgtaacgttaaccgtaaaaccggtaacgttacgggtcggtccgtaccgg

SEQ ID NO: 55834 - DNA, 545 bp, Homo sapiens
  misc_feature: GYAE6OF01EIKBQ.46.34.D01.1.454.CMB.1.raw
  modified_base (301)..(301): a, c, t, g, unknown or other
  misc_feature (301)..(301): n is a, c, g, or t
tcagactagcagtacacgaccggtgctcgatttagatcgtctgtgttgggtttgggctgatcaggactcctcagttcaccttctcacaatgaggctccctgctcagctcctgggggctgctaatgctctgggtcccaggattcagtggggatgttgtgatgactcagtctccactctccctgcccgtcaccccttggacagccggcctccatctcctgcaggtctagtcaaagcctcgtatacactgatggaaacacctgcctggattggtatcaccagcggccaggccaatctccaggcncctaatttataacgtttctaaccgggactcgtcggggtccagacagattcagtggcgagtgggtcaggcacgtgagttcacactagaaatcagcgagggtggaggcgtaggaggtattggttaggtaatttattacgtgcagtgacgaaggtgacagtagttcggccgttccggtctacgttttgggaccgtaggggacccgaaggcgtggtaagaacgtacgaaacgaagttggtggctacgg

SEQ ID NO: 55835 - DNA, 723 bp, Homo sapiens
  misc_feature: GYAE6OF01BF3P9.46.34.D01.1.454.CMB.1.raw
  modified_base (260)..(260): a, c, t, g, unknown or other
  misc_feature (260)..(260): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccgcctccatctcctgcaggtctagtcaaacgcctagtactacactgactacggaaaccnccgtgccgtggtatttggtactccaccgacggccggccgaggacccaactccgtacccgaaggtccgtacctttaaagttttacgttaaacgggttttaccgtaaaccggggtacttccggtacggggtacccaggactagtacttacgaggtcggactagggtcgggtacgaggtcctaacggttggtacgttaccaacgtaacctaaggtaaactcgaaggtcggaaggggttaggagggtcggtaggagggtagttacgggtttaagttaagttttacgttacggtgacgtacgtaggtaccggtaagggtcgacgtaacgtacggttccggtccgttacccggttacgttaccggtttaccgggacccgggtacgggtaacccgtacgggtacggtacgggtaaacgtaacgttaaacccggaaaccggttaaggtcgggttagggtcccttaaccggg

SEQ ID NO: 55836 - DNA, 608 bp, Homo sapiens
  misc_feature: GYAE6OF01EJFQK.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagcccgcctccatctcctgcaggtctagtcaaagcctcgtatacactgataggaaaccacctgcctggattggtatcaccaggcgaccaggccaatcctaccgaaggccgtaccttaatttagttaaacggtttctaaaccgggtcttcgtcggggtccagacagtaacttcgaggtggacgtaggtgggtacgaggctacgtgtacgttaccaactacgtaagaaactcgaggtacgaggggtgaggcgtaggaggttagtggttagtaagttttattacgtgtactagtgacgtaagggtgacctacgtacgttcggtccccgttcggtacttaccggtttcggaccggtaacgggaccgtaaggtccgtagggaataacgtacgaaacggacgttgtcggctaaccgg

SEQ ID NO: 55837 - DNA, 696 bp, Homo sapiens
  misc_feature: GYAE6OF01CTPEQ.46.34.D01.1.454.CMB.1.raw
tcagactagcagtacacgaccggtgctcgatttagatcgtctgtgttgggtttgggctgatcaggactcctcagttcaccttctcacaatgaggcctccctgctcagctccgtggggctgctaatgctcgtcgggtcccaggtattcgaggtggggattggttgtgatgactcagtcctccacctcctccctcgcccgtcctaccccttggacacggcccgcctccatcctccgtgcacggtctacgtacaaacgtccttacgtactacactaggaacttacggaaaaccctccgtcggaccgttaggtactttcggtaactcccgaaccgacggcccggaccgaacggacccaacgttcccgaccgaaacgggtacccgtaaccttttaaagttttaacggtttaaacgggtttacccgtaaacccggggtcttaccgggtcgggtacccaaggtacctagtacttcgaggtgacgtaggtcggtcacggcgtatcgagtacacacgtaagaactgagtacggagggtaggacggtacgagggtaggtagttaggttaggttaactttagttacgtagtagtagtacggtagtaaacgtgtacgtacgtagttcggtccgtccggttacttacggtttcgggaccggtagggtaccaggcgtaggaagactaacgaaacgagtcggtcgcgtacg

SEQ ID NO: 55838 - DNA, 685 bp, Homo sapiens
  misc_feature: GYAE6OF01DHNI0.46.34.D01.1.454.CMB.1.raw
  modified_base (206)..(206): a, c, t, g, unknown or other
  misc_feature (206)..(206): n is a, c, g, or t
  modified_base (269)..(269): a, c, t, g, unknown or other
  misc_feature (269)..(269): n is a, c, g, or t
  modified_base (433)..(433): a, c, t, g, unknown or other
  misc_feature (433)..(433): n is a, c, g, or t
  modified_base (488)..(488): a, c, t, g, unknown or other
  misc_feature (488)..(488): n is a, c, g, or t
tcagactagcagtacacgaccggtgctcgatttagatcgtctgtgttgggtttgggctgatcaggactcctcagttcaccttctcacaatgaggctccctgctcagctcgtgggctgctaatgctcgtgggtcccaggtattcgaggtggggatgttgtgatgactcagtcctccactcctccctagcccgtccacccgttggacncgcccgcctccatccgtcctgctaggtctagtacaacgcctagtatacactgaagtacgaacncctgcctggacttgactccgacgacgccggaccacggacctaacgtccgtaccgaacggtccgtaacttaaattttacgtaaccggtttccgaaaccgggtcgttccggtagggtacccaagaccgtagtacgtcgtacggtagcgtaggtcggtacacggtanacggtagtacggtacaacgtaagtaagacgtacgacggtaggtaggtaggaacgngttaggtaggtagttacgttaagttacgttacgtagccgtagtacgtacgtaggtacggtcgtaaccgtaacgttcggttaccgtaccggttacgggttacttacgggtaaccggacccgggttaacggaacgtacggtcgttaacgggaacgttaaccttaaacggtaccggtaaggttcggtacgtcctaccggg

SEQ ID NO: 55839 - DNA, 653 bp, Homo sapiens
  misc_feature: GYAE6OF01CPM9K.46.34.D01.1.454.CMB.1.raw
  modified_base (205)..(205): a, c, t, g, unknown or other
  misc_feature (205)..(205): n is a, c, g, or t
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtcgggtcccaggtattcgaggtggggatgttgtgatgactcagtctccactcctccctcgcccgtcacccgtggacncgccgctccatctctgcaggtctagtacaacgcctgtatacactgatacggaaaccncgtgctggtatganccgacgngccgccacgcaatctaccgaagcgtaccttaagtttaacgtaacggttaccaaccggtctccggtcgggtaccagacagtattacgaggtcgcgtaggtcggtacaggtctaacgtggacgttacaacgtaacgtaacgaaaactcgaaggtacggtaggggtagggtacgggtgtaagggtaagggtagttaggtttaaggttaaattttaacgttacgtagtactaggtaggtacgaaacgggtcgtaactacgtggttaccggttccgttacggttacgttacggtttaccgggaccgggtaacgggtaaccgaggtaccggttacggaacgtaactaacggaaacggtacgtcggtcggccgtacg

SEQ ID NO: 55840 - DNA, 803 bp, Homo sapiens
  misc_feature: GYAE6OF01BZ3IZ.46.34.D01.1.454.CMB.1.raw
  modified_base (205)..(205): a, c, t, g, unknown or other
  misc_feature (205)..(205): n is a, c, g, or t
  modified_base (272)..(272): a, c, t, g, unknown or other
  misc_feature (272)..(272): n is a, c, g, or t
tcagactagcagtacacgaccggtgctcgatttagatcgtctgtgttgggtttgggctgatcaggactcctcagttcaccttctcacaatgaggcctccctgctcagctccgtggggctgactaatgctcgtcgggtcccaggattcgaggtggggatgttgtgatgactcagtctccactctccctcgcccgtcaccgtggacncgccgcctccatctccgtgcgtaggtctagtacaaacgtcctacgtatacactgaagtacggaaacnccgtgcctggtattggactccaccgaggccggaccgacggacctaacgtcctaccgaagggtcctacctttaaaagttttaacgttaacgggttaccgtaaaccgggtcttccggtcggggtacccaagtaacgtagtaacgttcgagggtcggacgtaggggtcgggtacgacgggtacctaagttacggaacgtttacccgaaaccgtaacgttaaacgaaaaccgttacggaaacgggacgggttaaagggggacgggaaaccgggttcggtaaggggtaagggttaagtttagggtttaaacggttaaatttttaacgtacggttaccggtaagttaaggtacgggttaaccggtaaagggttcgaacgtaacggttaacggttcccgggttacccggttaccggtttaccggtttaccggtttaccgggggaccggtaaccgggggtaacctaaccgggtaggtaacgggtaacgttaaccgtaaaccgggaaacggttacgttcgggtacggtacctaacccggg

SEQ ID NO: 55841 - DNA, 596 bp, Homo sapiens
  misc_feature: GYAE6OF01AEALH.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggccacctaatttataaggtttctaaccgggactcgtggggtcccagacagattcgagtggctaggtgggtcaggcactggagttcacactagaaatcgagcgagggtggaggcgtggaggtagtggttaggtaatttattactgtactagtgtacgaagggtagtacgtacgtacgttcggtcccgttcccgggttaccgttaccggttttacgggacccggtaacgggggtaacccgtaacgggtcgttacgggaagtaacgtaaccgtaaacggaaccgtggtacgggtcgtaccgg

SEQ ID NO: 55842 - DNA, 876 bp, Homo sapiens
  misc_feature: GYAE6OF01CX9ED.46.34.D01.1.454.CMB.1.raw
  modified_base (269)..(269): a, c, t, g, unknown or other
  misc_feature (269)..(269): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcagtggggatgttgtgatgactcagtcctccactcctccctcgcccgtcctacccttggacacgcccggcctccatcctcctgctaggtctagtacaaacgcctacgtatacactgatacggaaacnccgtgctggtattgatccgacgaggccgaccgagcctaatccgtaccgaacggtccgtacctttaaagtttaacgttaacggtttaccgtaaaccgggtacgttccggtacggggtaccccaaggtaacgtacgtaacgtttcgaacggtacggaccgtaggggttacggggtaccgaacgggtacccgttaacggttacggttaaccggttaacccgtaaccgtaaaccgttaaacggtaaaaaacgttccgaaacggggtaccgggtaacggggggttaagggtaacgggtaccggtaaggggtaaacgggtttaaggtttagggttttaaacgggtttaaacgttttttaacggttaaccgtttacggtaaccgttaaggttaacgggtaacggttaaggggttaccgtaaccgtttaaaccggttaccgggttacccgggttaccccggtttacccggtttaccccggttaaccggggtttttaccgggaaccccgggggtaaacgggtaaccccggtaacgggttacggttaacggggtaaacgtaaaccggtaaacccggaaaacgttaccggttacgggtaccgggtacccggtaacccg

SEQ ID NO: 55843 - DNA, 655 bp, Homo sapiens
  misc_feature: GYAE6OF01DH19V.46.34.D01.1.454.CMB.1.raw
tcagactagcagtacacgaccggtgctcgatttagatcgtctgtgttgggtttgggctgatcaggactcctcagttcaccttctcacaatgaggctcctgctcagctcctggggctgctaatgctctgggtccaggattcagtggggatgttgtgatgactcagtctccactcctccctcgcccgtcacccttggacacggcccggcctccatcctcctgcaggtctagtcaaacgcctacgtatacactagataggaaaccacctcgcctggattggtactcaccgacgccggaccgacggaccaacttccgtaccgaacggccgtacttaaattttaacgttaaacggtttaccgtaaccggacttcgtcgggtaccagacagtacttcgagtgcgaggtgggtacgaggctacgtgacgttacaactactagaaaactcgaaggacggaagggtgggaacggcgtaggaggtagttaggttaaggttaattttagttacgtaggtctagtaggtacgtaagggtagacgtacgttacggttcggtacccgttccggttacgttacgttttcgggaccggtaacggggaacctaacggtacgtagggtaacgtaacgtaacctaaaacggtaacgttacggtggtcgtacccg

SEQ ID NO: 55844 - DNA, 826 bp, Homo sapiens
  misc_feature: GYAE6OF01DEDB1.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttgacagccgcctccatctctgcaggtcagtcaaagcctcgtatacactgataggaaaccacctgccttggattggtactcaccgagccggccacggaccaatcctaccgaaacggcgtaccttaagttttacgttaaacgggtttaccgtaaaccggggaccttccgttcggggtaccccaaggaaccgtaacgtaattccgtaaggtcggaccgtaaggttcggggtcctaagggccctaacgttggtaacgtttactaaccgtaaccgtaacgtaaaacgttaccgaacggtacggtaacgggggtaacgggtaacgggtaccggttacgggtaacggggtaaggtttaacgggtttaagggtttaaaacgtttttaacgtttaaccgtttacgtacgttaaacgttacgggtaaccggttaaacggggttacgacccgttaaaccggttaaccggtttccgggtaccccgtttcccgggtttaacccggttacccgttttttaccggggaaccccgggtaaaccgggggtaaccccgtaaaccgggtaccggttaacgggtaaaccggtaaacggtttaacccggtaaaaaccggtaaaccggttacggttaccgggtccggttaacccgg

SEQ ID NO: 55845 - DNA, 532 bp, Homo sapiens
  misc_feature: GYAE6OF01BDFKP.46.34.D01.1.454.CMB.1.raw
  modified_base (454)..(454): a, c, t, g, unknown or other
  misc_feature (454)..(454): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtggggtcccagacagattcagtggcaggtgggtcagggcactgagttcacactagaaatcagcgagggtggaggctgaggagttgttaggtaatttattactgactatgacgtaaggtgcacngttacggccctccggtcctagtttcggccgacggggaccaaggctagggagacgtacaaacggaatggtggcgtacgg

SEQ ID NO: 55846 - DNA, 811 bp, Homo sapiens
  misc_feature: GYAE6OF01C1OGJ.46.34.D01.1.454.CMB.1.raw
  modified_base (199)..(199): a, c, t, g, unknown or other
  misc_feature (199)..(199): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactcctccctgcccgtcaccctggacncgccgcctccatctcctgcaggtctagtacaagcctacgtatacactgataggaacactgcctggattggtatccacgagccggaccaggaccaatcctaccgaaggccgtaccttaaatttacgtaaacggtttccgtaaaccgggacttccggtacggggtaccccaaggtaaccaaggtacttaccgaaggttcggaccgtagggttcgggtacaacgggtccaacgttacggtacgtttaccaaccgtaacgtaacggtaaaaacgtccggtaaacggtacccgggtaaggggggttaacggggaacgggtaccgggttaacggggtaaaggggtttaacggttttacgggttttaaagggtttaaacgttttttaaacggtttaacggttaccgggtaaccgttaagggttacgggtaaccgggttaaacggggttacggaacccgttaaacggttaacggtttcccggggttacccgtttaccggggttaccgttaccggttttaccggggacccggtaaacgggggtaaccctaaaggtccggttaagggtaaccggtaacgtaaccggtaaaacggtaccggttagggtcggtaccgttaccgg

SEQ ID NO: 55847 - DNA, 684 bp, Homo sapiens
  misc_feature: GYAE6OF01DC2CQ.46.34.D01.1.454.CMB.1.raw
  modified_base (266)..(266): a, c, t, g, unknown or other
  misc_feature (266)..(266): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcgaggtggggatgttgtgatgactcagtctccactctccctgcccgtcacccttggaccacgcccgcctccatcctcctgcaggtctagtacaaacgcctacgtatacactgatacggaaaccncctgcctggtattggtactcaccgaggccggaccgacggacctaactcctacccgaaacggtccgtaacctttaagttttaacgttaacggtttaccgtaaacccgggtacgttcggtcgggtacccagaactagtacttcgaggtggcgaggtcgggtcaggccacgtgtacgttcaactaacgtagtaaaactcgacggacggtaggggtaggacggtcggtaggtaggtagttacggtttagtttaattttacgttacgttgtacgtagtacgacgtaagggtcgtaccgtaacgtacggtttccggtaccgttcccggttacgttaccggtttacgggacccggtaacgggaaccgaacggtcggtaacggtaacgaacgtaaaccgaaacggtagttcggtcggtccgtaccg

SEQ ID NO: 55848 - DNA, 751 bp, Homo sapiens
  misc_feature: GYAE6OF01DJSIX.46.34.D01.1.454.CMB.1.raw
  modified_base (199)..(199): a, c, t, g, unknown or other
  misc_feature (199)..(199): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggatgttgtgatgactcagtctccactcctccctgcccgtcacctggacngccgcctcatctctgcaggtctagtacaacgtcctacgtataccacgtagatacggaaaccacctcggcctggtatttacggtaactccaccgaggccggaccgtaaggtaccaaatccgtaccgaacgggtccgtaacctttaaattttaagtaaacggttttaccgaaacccgggtactccggtacggggtcccaaggtaaccaagtacgttacgagggtcggaccgtagggtcggggtacagggtacctacgtagtacgtttaccaacgtaacgtaacgaaaacttacgaaggtacggtagggtacgggacgggcgttagggaggtacgttaggttaggttaaattttacgttacgttaggtacgtaacgttacggaaccgtaagggttacgtaccgtaacgttacggtttccggtacccggttcccggttaccggttaccggttttaccggggacccgggtaaccggggtaacccgaaggtccggttaacgggtaacgtaaacgtaaccggtaaaaccgtaacggttacggtaccggtcgtaacccgg

SEQ ID NO: 55849 - DNA, 642 bp, Homo sapiens
  misc_feature: GYAE6OF01D4YFK.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactcctccctcgcccgtcacccttggacagccggcctccatctcctgcagtctagtcaaagcctacgtatacactgatacggaaacacctgcctggattggtactcaccacggccggccaggcccaagtccgtaccgaaagggccgtaccttaaatttttaacgttaaacgggttttaccgtaaaccgggtactccggtacggggtacccagaaccagtattcgagtcggacgtaggtgggtacaggcacgtgtacgttacactactagaaatacgagacgaggggtggacggcgtaggaaggtagttaggttaggttaattttaacgtttacgtgactagtagacgaaggttacgaccgtacgtagttcggtaccgttcccggttcgttaccgttttacgggaccggtaacggggaacccgaaggtcgtaggaacgaacgtaacgaaacggtaagtcggtaggcgtacgg

SEQ ID NO: 55850 - DNA, 855 bp, Homo sapiens
  misc_feature: GYAE6OF01DRKNU.46.34.D01.1.454.CMB.1.raw
tcagactagcagtacacgaccggtgctcgatttagatcgtctgtgttgggtttgggctgatcaggactcctcagttcaccttctcacaatgaggcctccctgctcagctccgtgggctgctaatgctcgtcgggtccaggtattcgaggtggggtatgttgtgatgactcacgtcctccactcctccctcgacccgtcctacccgttggaccacggcccggtcctccacttccctccgtgccgtaggttactaacggttaccaaacggtcccttacgtaataaccgacgtagaagtaaccggaaaacctccgtcgtaccgttagggtactttacggtactaccgaacccggaggacccgggaccgaacggtaccctaaacgttcccgtaaccggaaccgggtaccttaaccgttttaaagttttaacggtttaaaccggggtttacccgtaaacccggggttcgtttcccgggtaccggggtaccaaacggtaccgtaagttaacgttccggaagggtcggacggtagggtacgggtacacggtctacggtacgtacttaccgaacgtaacgtaacgtaaacgtacggacggtacggtagggtacgggacggtacggtaggtacggttaggttaaggtttaagttaaacttttacggttaacgtacggtacgtaacgtacggtaacgtacgggtacgtaccggttaacgttaccggttaccggtacccggtttacggttacccggttaccgggtttaccgggaacccgggtaaccgggtaccgtaacgggtcggttaacgggtataaacccggttaacgtaaacgggtaacggttcgggtacggtcggtacccgg

SEQ ID NO: 55851 - DNA, 697 bp, Homo sapiens
  misc_feature: GYAE6OF01CIPJV.46.34.D01.1.454.CMB.1.raw
  modified_base (271)..(271): a, c, t, g, unknown or other
  misc_feature (271)..(271): n is a, c, g, or t
  modified_base (529)..(529): a, c, t, g, unknown or other
  misc_feature (529)..(529): n is a, c, g, or t
  modified_base (684)..(684): a, c, t, g, unknown or other
  misc_feature (684)..(684): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctctgggtcccaggattcgaggtggggatgttgtgatgactcagtctccactctccctcgcccgtccacccttggacacgcccgcctccatcctccgtgcaggtctagtacaaacgcctacgtaatacactgaagtacggaaaacnccgtgaccgtaggtacttggtaactccgaacccgaaggccggacccaacggtaccctaaactccgttaacccgaacgggtccgtaacctttaaaacgttttaacgttaaacggtttacccgtaaaccgggtaccgttccggtacggggttccccaaagtaccgaacgtacttacgacggttggaccgtaaggtgggtaaccaggtactacggtagtacgttacaacgtactaagaactcgacggcgagggtaggacgngtagagggtattggtagttaagttactactgatagtacacggtaagtcgactagtaacgttcggtaccgtccgttacgtaccggtttacggaccggtacgggtaacccagtcgttaacgggagttaaaccgtaaccgaaacggttacgttcgggnggtcccgttacgg

SEQ ID NO: 55852 - DNA, 598 bp, Homo sapiens
  misc_feature: GYAE6OF01ECSOA.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccttggacagccgcctccatctcctgcaggtctagtcaaagcctcgtatacactgataggaaacacctgcctggattggtatcaccgagcggccaggccaatctccaaggccacttaatttagtaaggtttcaaccggactcgtcgggtacccagacagattcgagtggcaggtggtcaggcacgtgaagttcaacactagaaaatcgagcgaggggtaggaggcgtaggaaggtagttaggttaggtaattttagttacgtgtactaagtagacgtaagggtgtactaacgtacgttcgggtcccttccgggttacgttaccgtttacgggacccggtacgggggtaaccctaaggtacgtacgggtaagaaccgttaacgtaaaaccggagttcggtcgcggtaccgg

SEQ ID NO: 55853 - DNA, 526 bp, Homo sapiens
  misc_feature: GYAE6OF01AG4JF.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctgtatacactgatggaaacacctgcctggattggtatcaccagcggccaggccaatctcaaggcgcctaatttataaggttttctaaccgggactctggggtcccagacagattcagtggcagtgggtcagggcactgagttcacactgaaatcagcgagggtggagggctaggaggatgttggaattttattactgctatgacgaaggtgacacgtaagttcggccttccggtctaccgttttggacccgacggggtaccaaggctaggagatacaacgaatgtggctacgg

SEQ ID NO: 55854 - DNA, 594 bp, Homo sapiens
  misc_feature: GYAE6OF01D8V8L.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctacgtatacactgataggaaacacctgcctggattggtatcaccagcggccaggccaatcctcaaggcgacctaatttataaggtttcctaaccgggactcgtcggggtcccagacagtattcaggtggcaggtgggtacaggcacgtgagttcactactagaaatcagacgagggtggaggcgtaggaggtagttggtttaggtaattttagtttacgtgtactagtacgacgtaaggtgactacgtacgttcggtcccgttccggttacttaccgttttcgggacccggtacggggtaacccaaggtcgtagggaacgtaacgtaaccgtaaaacggtaacgttcggtggtccgtaccgg

SEQ ID NO: 55855 - DNA, 626 bp, Homo sapiens
  misc_feature: GYAE6OF01ATMVK.46.34.D01.1.454.CMB.1.raw
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcgagtggggatgttgtgatgactcagtctccactctccctgcccgtccacccttggacacggcccggcctccactcctcctgcaggtctagtacaaagcctcgtatacactgagtaggaaaaccncctgcctggtattggactcaccgagccggcaggccaatcnccgaagcgactaattagtaacgttcgaacggtctcgtacgggtccagactagatcgagtggctaggtcggtacaggcaagttgagttacactacgtaagaaactcgagaggacgggtaggacggtcgtaggaggtagttaggtttaagtaatttagttacgtgtagtagtagacgtaagggtcgtaacgtagttaccggtaccgttccggttacgttacggtttaccgggaccggtaacggggaccgtaagggtcggtagggtaacggaacgtaaaccgtaaaacggtaaccggttaggtacggtccgtacggtaacccg

SEQ ID NO: 55856 - DNA, 792 bp, Homo sapiens
  misc_feature: GYAE6OF01DMHQI.46.34.D01.1.454.CMB.1.raw
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcgagtggggatgttgtgatgactcagtcctccactctccctgcccgtcaccctggacnggcccgcctccatctcctgcgagtctagtacaaacgtcctacgtatacactgaatacggaaaccnctcgcctaggattggactccaccgaggcccggacgacggaccctaaacgtcccgtaaccgaacggtacccgtacctttaaaagttttacgtaaaccggttttaccggaaacccgggtctaccggttacggggtacccaaggtaaccgtaagtacgttccgaacgggtcggtacggtacgggttacggggtaccacgggtaccgtacgttcgggtaaccgtttaccgaaccgtaacgtaaacggtaaacgtaccggtaaggggaccgggtaaggggggtacgggtacgggtaccggtaggggtaaacggtttaggtttaacgggtttaaagttttaacgtttttaagttaccggtagtacgtacggttacgggaacccggttaaggttacgacgttaaccgttaacgggttcccgggtacccgtttcccgggttacgtttaccggttaccgggaacccgggtaacggggaccctaagggtcggtacggtaactaacgtaacgtaacggtaacgtcggtcgacgtaccg

SEQ ID NO: 55857 - DNA, 612 bp, Homo sapiens
  misc_feature: GYAE6OF01DUD83.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtcacccttggacagccggcctccatcctcctgcaggtctagtcaaagcctcgtatacactgatggaaacacctgcctgatggtatcacagcgccaggccaatctccaacgcgacctaatttataagtttctaaccggactctgggtcccagacagtactcagtggctagtgggtcaggtcacgtgacgttcacactagaaatcgagacaggggtacggaggtacctggtaaggtagttagtttaggtaaagttttacgttaacgttgactaagttacggtacgaagggttcgacctacgtaagttccggacccgttcccggttacgttaccgttttacgggaacccggtacggggtaaccccaaaggtcccgttaggaaacggtacgtaaccgtaaaacggaaaccgttcggtacgggtcttaccggg

SEQ ID NO: 55858 - DNA, 656 bp, Homo sapiens
  misc_feature: GYAE6OF01CE8WP.46.34.D01.1.454.CMB.1.raw
  modified_base (259)..(259): a, c, t, g, unknown or other
  misc_feature (259)..(259): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccgtggacacgcccggcctccatcctctgcaggtctagtacaaagtcctcgtatacatgatacggaaacncctgcctggattggtatcacaggccgccaggccaatccgtacgacgtccgtacttaatttagtaacggtttaccgaaccggtctcgtcgggtaccagacagtattcgaggtcggactaggtcgggcaaggtccagttgtacgttacgaacgtacgtaagaaaccgtcgaacggacggtaaggggtggacggtacggttagggaagggtagttaggtttaaggtaactttttaagttaccttaggactaagtcggacgtaaagggtctaactacgtagtttcccggaaccgttcccggttacgttacggtttacgggaccggtaacggggtactaacggtggtaacggaacgttaacgtaaacgtaaacggtaccggtttcgggtcgttccgtaaccg

SEQ ID NO: 55859 - DNA, 858 bp, Homo sapiens
  misc_feature: GYAE6OF01DBJGR.46.34.D01.1.454.CMB.1.raw
tcagactagcagtacacgaccggtgctcgatttagatcgtctgtgttgggtttgggctgatacaggactcctcagttcaccttctccacgaatgagctccctgctcagctccgtggggctgctaagtgctcgtgggtcccaggattcagtgggatgttgtgatcgactcagtctccactctcccgtgccctcaccgttgacacgccggcctccactctccgtgctaggtctagtacaacgtcctagtactacacgtagagtacggaaacctccgttcgaccgttaggtacgttacgggtactaccgaaccgacggcccgggaccgtacggtacccaacgttcccgtaccggaaacgggtcccgttaaccttttaaacgttttaacgtttaaacgggtttacccgtaaacccgggtaccgttacccggtaccgggtaaccccaggtaaacccgtaaggtaaccgtttaccggacggtacgggtaccgaacggggtttacggggtaccgtaacggtaccgtaacccggttacgggtaaacgtttacccgaaacccgttaaacgttaaaccgtaaaacgttccgtaacgggtaaccgggtaggggtaacgggaacgggtaccggtagggtaacggttagtttagggttaagtttaacgttttaagtaacgttcggtaacgttacgtacggtaacggtaacgggtcgtaacgaacggtttcgttaccggttacccgtttaccgggttaccgttaaccggttttcgggaacccgggttaaaccgggtacccgttaacggacggtttacggtaaacgtacgtaaaccgtaacgggttaaggtacggtccgggacgttaacccgg

SEQ ID NO: 55860 - DNA, 707 bp, Homo sapiens
  misc_feature: GYAE6OF01A6I2Q.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctcctgctactctggctccgaggtgccagatgtgacatcgagctgacccagtctccatcctccctgtctgcaaccggtgggagacagtgtcaccatcacttggcccgggacaaggtcggaaacattcgaacaccgttaatttaaacttggtatacaacataacgacctagggaccgacccctaagctacctaatctatcgctgactactccgtagtttgacgtaaaggttcgggtaccctacgtcggtaacggtttacgaaggttcgggtaccgtagggtaggtacgttacggttacgggggaactaaggttacttttaccacttccgtacctaacctacttaccgtaagttaacgtcgtacgtaccgaaacgttaggtaaacgttacgtttttaacgaaccttaaacttttaacgttacttacggtaactaaaaccgtaagttaaactttaacgtaacggttttcggtttaccggaaccgtaaggtaaccgacctaagtaaaaccttaaaagttaaaccgtacgttacggtacggtacctggaacccaccttacgtcgtacgttaccttatccctttaccgtccccgtaac

SEQ ID NO: 55861 - DNA, 843 bp, Homo sapiens
  misc_feature: GYAE6OF01CV5X2.46.34.D01.1.454.CMB.1.raw
tcagactagcagtacacgaccggtgctcgatttagatcgtctgtgttgggtttgggctgatcaggactcctcagttcaccttctcacaatgaggcctccctgctcagctccgtggggctgctaatgctcgtcgggtcccaggtattcgaggtggggtatggttgtgatgactcagtctccacctcctcccgtcgtcccgtcctacccgttggaccacggcccgccttccatcctcctgacacggttactaagtacaaacgtccctagtactacctacgtagtacgtaacggaaacctccgtcgtaccgttaggtaacgttcggtaactccgaacccggaggcccgggaccgaacgtaccgtaaacgtccgtaaccggaacggtaccgttacctttaaaagttttaacgttaaacgggtttaccgtaacccgggtaccgttaccgggttacgggtacccaaggtaacccgtaaggttaacttaccggtaggttacggacggttacggtacggggtaccgtagggtaccgtaacgtacggtaacgttccgaaacgttaaaccgtaaggtaaactacgaacggtacggtaagggggtacggtaacggtacgtaagggtagggttaacgtttaggttaaaggtttaactttaacgttacgtagaccgttaagtacgggtaacgtagggtacgaaaccgttcgtaacggttcggtacccggttaccgggttaacccgttacggtttaaccgggcccgggtaaaacgggtaccggtaaacggtcggttaacgtaaacggtacgtaaacccggtaaacgtacgggttcggtaacggtcccgtaaacccgg

SEQ ID NO: 55862 - DNA, 555 bp, Homo sapiens
  misc_feature: GYAE6OF01DT9AL.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaaccacctgccctggattggtatcaccagcggccaggccaatctccaaggcgcctaatttataaggtttctaaccgggactcgtgggtcccagacagattcagtggcagtgggtcaggcactgagttcacactagaaaatcagcgaagggtggaggcgtaggaggagttaggtttggtaattttagttactgctatggacgaagggtgactacgattgggacccgttccggtcgttacgttttcgggcccgtaacggggaccgaaggtcgtagggagacgtacaaacggtaactggtcgcgtacg

SEQ ID NO: 55863 - DNA, 1114 bp, Homo sapiens
  misc_feature: GYAE6OF01ARV7Q.46.34.D01.1.454.CMB.1.raw
tcagactagcagtacacgaccggtgctcgatttagatcgtctgtggttgggtttgggctgatcaggactacctcagttcaccttctcacaatgaggctccctgctcagctcctggggctgctaatgctctgggtcccaggattcagtgggggatgttgtgatgactcagtctccactctccctgcccgtcaccttggacacgccggcctccatcctcctgcaggtctagtacaagcctcgtatacactgactcggaaaaccaccgttgacccgttagggtacgtttacgggttaacgttacccgtaaccccgtaacgggaccccggggtaccccggaaaccgggggtaaccccctaaaacggtttacccccgttaaacccccggtaaaaacgggggttacccccggttaaaccccgtttttaaaaaaccggttttttaaaacgggttttaaaaaacccgggggggtttttttaacccccggtttaaaaaacccccccggggggggttaaacccttttaccccgggggtttaacccgggggggggttttacccccccgaaaaacgggttaaaccgggtaaaacccgggttaaacgttttaacccgggtaaacgggtttacggggtaacccggtaacggggtttaccgggggggtacccgtaagggggtaccccgtaacgttacgggttaaccggtttaccgtaacccgttaaccggtaaacggtaaaaacgtaccgtaaacgggtaccgggttaacggggggtacggggtaaccgggtaacggtttacggggtaaagggggtttacggttaaggggttttaacgggtttaaacctttttaagggtttaacccgtttaggtaaccggttaagtttaccgggtaacggttaaacggggtccgtaacccgttaaccgttaacgggttcccggggttaaccccggtttacccggggtttacccgtttaaacccgggtttttacccggggaaccccgggttaaacggggggtaaaccccgtaacggggttcccggttaaacggggtacggtaaacccggtaaacccggttaaaaccgggttaaaccggttcggggttaacccgggtcggttaaccccggg

SEQ ID NO: 55864 - DNA, 635 bp, Homo sapiens
  misc_feature: GYAE6OF01ER1R0.46.34.D01.1.454.CMB.1.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacngccggcctccatctcctgcaggtctagtcaaagcctgtatacactgatggaaacacctgcctggattggtatcacagcggcaggccaatctccaggcncctaatttataaggtttctaacggctcgtcgggtccagacagattcagtggcaggtgggtcgaggcacgtgtagttccaacgactagaaaattcaaggaccgaggggtagggaggtcgtagggaagggtagttagggtttaggttaaatttttacgtttacgtgtacgtagttacgacgtaagggtcgtactacgtacgttcgggtacccgttcccggttactttaccggtttcgggaacccgggtaccgggggtaacccgtaacgggtcggttacggggaagttaaacccgtaacggtaaaaccgggtaaccgttagggtcggggtccgttaacccgg

SEQ ID NO: 55865 - DNA, 658 bp, Homo sapiens
  misc_feature: GYAE6OF01D9LL9.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccgcctccatctcctgcaggtctagtcaaagcctgtatacactgataggaaacctacctgcctggattggtatccaccagccggccaggccaaatcctaccgaacggtccgtaccctttaaattttacgttaaacgggttttaccgtaaacccggggtacttccggtcggggtacccaggaactagtattcgagtcggcgtaggtgggtacagggtcacgtggtacgttacactaacgtaagaaactcgaaggtacgtaggggtcggaggtcgtagggaacggtagttaggtttaggtaattttagttactagtactagtacgacgtaagggtagtacctagtacgttacggtcccgttccggttaccgttaccggttttcgggacccggtaacggggtaaccctaacggtccgtagggaactaacgtaaccgaaacgtagttcggtcgggctaccgg

SEQ ID NO: 55866 - DNA, 769 bp, Homo sapiens
  misc_feature: GYAE6OF01D1H3Q.46.34.D01.1.454.CMB.1.raw
  modified_base (467)..(467): a, c, t, g, unknown or other
  misc_feature (467)..(467): n is a, c, g, or t
tcagactagcagtacacgaccggtgctcgatttagatcgtctgtgttgggtttgggctgatcaggactcctcagttcaccttctcacaatgaggcctccctgctcagcctcgtgggctgctaatgctcgtcgggtaccaggtattcgaggtgggattgttgtgatgactcagtctccactcctccctcgtccctctaccgttggaccacggcccgtcctctacgtcctccgtgacgtaggtctaaggtaacaaccgtctacgtactacacgtagaacgtacggaaacctccgtgtaccgtggtaactttcggtaactaccgaaccggtcggaccggtaccgaacggttactaaacgtcccgtaaccgaacgggttacctttaaccgtttaaaagttttacggttaaacgggtttacccggaaaccggttaccgtcgggttaccgggaaccagtactaagtctacggngtcggtacgtaggttcgggtacacgtacgtaacggttcggtaactttacccgaaattaacggtaaaagtaaaccgtcgggaggtacgggtaagggcggggtaataacgtagggtaggttacttagggtttaaagtacttttacgtactgtaactaggtaacgaggtacgttcaacgttacggtccgttcccggttacccgggtacgtttacggttaaccggttacgggacccggtaaagggtacgttacggacgtaaaggggtacttaaaacgacgttaaacgtgtacggtgaccgtaaccg

SEQ ID NO: 55867 - DNA, 753 bp, Homo sapiens
  misc_feature: GYAE6OF01DE6SK.46.34.D01.1.454.CMB.1.raw
  modified_base (270)..(270): a, c, t, g, unknown or other
  misc_feature (270)..(270): n is a, c, g, or t
  modified_base (478)..(478): a, c, t, g, unknown or other
  misc_feature (478)..(478): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctcgtcggtcccaggattcgagtggggatgtgtgatgactcgagtctccactcctccctcgtcccgtctaccctggacacgccggcctcatcctcctgctaggtctagtacaaacgtcctacgtataacacgtgaatacggaaaccnccgtgaccgtggatttcgatccacgacgccggacacggacaactccgtacaacggtctaacctaagttttaacgtaacggttaccgtaacccgggtacttacggtacggggtacccaaggaaccgtaagtacgttacgagggtacggcgtaacgggtgggaccacgggactaccgtagttacggactaacacgtaaagaacgtcgagnggtaagggtgaggacggtagaagggtagttacggttaagttaacgtttacgttaagcggtactaaggtacggtacggtaaacgggtcgtacgtaaacggtttccggttaccggtcccgttaacccgggttttacttaaccgggggtttccgggaaaccccggggtaaacggggtaacccgtaacgggtccggtttaaagggaaacccggttaaaaccggtttaaacccggaaaaacgggttccggttacgggcccggtttaaccggtaacccggg

SEQ ID NO: 55868 - DNA, 571 bp, Homo sapiens
  misc_feature: GYAE6OF01EJQJT.46.34.D01.1.454.CMB.1.raw
  modified_base (217)..(217): a, c, t, g, unknown or other
  misc_feature (217)..(217): n is a, c, g, or t
  modified_base (297)..(297): a, c, t, g, unknown or other
  misc_feature (297)..(297): n is a, c, g, or t
  modified_base (471)..(471): a, c, t, g, unknown or other
  misc_feature (471)..(471): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcnggtcagtcaaagcctgtatacactgataggaaacacctgcctggattggtatcgaccagcggcaggccaatcaccaggcncctaaatttagtaaggtttctaaccggcctcgtcgggtccaagacagattcgagtggcagtgggtacaggcaacgtgagttaccaactactaagaaaactcgaacggcgaaggggtggaggcgtagggaggtataggttaggtaatttacgttaactgcagtgtacgaagggtnacactagttcggccgttccggttcgtacggtttcggacccggtaagggacctaaggtccgtgggaagtactaacggtaaaacgaacctggtcggcgtacg

SEQ ID NO: 55869 - DNA, 789 bp, Homo sapiens
  misc_feature: GYAE6OF01ACMZH.46.34.D01.1.454.CMB.1.raw
  modified_base (654)..(654): a, c, t, g, unknown or other
  misc_feature (654)..(654): n is a, c, g, or t
  modified_base (759)..(759): a, c, t, g, unknown or other
  misc_feature (759)..(759): n is a, c, g, or t
tcagactagcagtacacgaccggtgctcgatttagatcgtctgtgttgggtttgggctgatcaggactcctcagttcaccttctcacaatgaggcctccctgctcagcctccgtggggctgctaatgcctcgtcgggtcccaggtattcgaggtgggatgttagtgatgacctcacgtcctccactcctcccgtcgcccgtctacccgttggaccgacggcccgtcctacctactcctcgtgcgtacggtactacggtacaaacgtcctagtactaccacgtaggaacgtacggaaaacctccgttcgtaccgttaggtacgtttacggtaactacccgaacccggaggacccgggaacccgtacggaccctaacgttcccgtaaccggaacggttaccgtaacttttaaacgttttaacggttaaccgggttacccgtaaaacccggggtcttaccgggtaccgggttacccaaaggtaccgtaaggttacgttaccggaggtacgggtcgtagggttacgggtaccaaacgggtctaacgtacgtacgttaaccaccgtaaccgtaagtaaaccgtcggaacggtacggtaacgggtcggaacggtcgtaagggtaacggttaggttagttaagttaacgtttacgttacgngtaacgtagtaacgtacggtaacgtcgtaacgtacgttacgtccggtacccgttcggtacgttacggttacgggacccggtaacggaccgtaggaccgtagtaanacgtaaccgtaaagtcgaggtcgtcgaccg

SEQ ID NO: 55870 - DNA, 639 bp, Homo sapiens
  misc_feature: GYAE6OF01CDDKC.46.34.D01.1.454.CMB.1.raw
  modified_base (482)..(482): a, c, t, g, unknown or other
  misc_feature (482)..(482): n is a, c, g, or t
tcagactagcagtacacgaccggtgctcgatttagatcgtctgtgttgggtttgggctgatcaggactcctcagttcaccttctcacaatgaggctcctgctcagctcctggggctgctaatgctctgggtcccaggattcagtggggatgttgtgatgactcagtctccactctccctgcccgtcaccttgacagccgctcatctcctgcaggtctagtcaaagtcctacgtataccactgatcggaaacacctgcctggatttggtaatcaccaggccgccaggtcaatctaccgaaggcctacctaattttagtaacggtttcctaaaccgggcttccgtggggtaccccagacgagtacttcgaggtgccaaggttgggtaccgaggtcaaccgttgaacgttcaacgtactaagaaactcgagacgtaggggtggaggccgtaggacggtagttggtttaaggtaattttatacgtntacgtagtagacggtaaggtcgacgtactaacgttcggaccgttccggttacgtaccgttttacgggacccggtaacggggtaaccgaacggtccggtacgggtaacggtaacgtaacccgtaaaacggtacgttacgggtacggtccggttaacgg

SEQ ID NO: 55871 - DNA, 637 bp, Homo sapiens
  misc_feature: GYAE6OF01CO6B9.46.34.D01.1.454.CMB.1.raw
tcagactagcagtacacgaccggtgctcgatttagatcgtctgtgttgggtttgggctgatcaggactcctcagttcactttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctcgtatacactgatggaaacacctgcctggattggtatcaccagcggccaggccaatcctccgaaaggccgtaccttaattttaataacgggtttacctaaacccggggacttccggtcggggtaccccaaggacaagtattacgaggtcggctaggtggggtacaggcacgtgagttcacactagaaatcgagcgaggggtggaggcgtgaggtagtggtttagggtaattttaacgtttacgtgtacgtagtcgtacgtaagggtgtacgaactaggttccgggtcccgttcccgggttacttaccggttttcgggacccggtaacgggggaacccgtaacggtccggttagggaacggtaacgttaaccggaaaacggtacgttacggtcgggccgtaccgg

SEQ ID NO: 55872 - DNA, 778 bp, Homo sapiens
  misc_feature: GYAE6OF01DQ2WY.46.34.D01.1.454.CMB.1.raw
  modified_base (266)..(266): a, c, t, g, unknown or other
  misc_feature (266)..(266): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcagtggggatgttgtgatgactcagtctccactcctccctgcccgtcacccgttggacacggccgcctccatcctcctgacaggtctagtaccaaagcctacgtatacactgatacggaaaccnctcgcctggattggtactcaccaggccggccacggccaacgtcctaccgaaggcccgtaacctttaaagttttacgtaacggttttccgtaaaccgggacttccggtacgggtaccccaagaccgaagtacttaccgaggttggaccgtaaggttcgggtaccgaagggtccgtaacgttggtaaaccggtttcctaaacgtaaccgttaaagtaaaaaccgtacgaaacgggtaccggaagggggttacgggaacgggtacgttaggggtaaggttacggttaaggttttaagggtttaaactttttaacgttaacgttacgggtaaccgtaaagttcggtaacggttaacgggtacggtaaccttaaccgttacggtttccggtaccccggtttaccggttaccgttaccgggttttacgggacccgggtaaaccgggacccggtaaaggtccggtaagggtaacgtaacggttaaacgaaaaccggtaggttacggtcggtcgtaacgg

SEQ ID NO: 55873 - DNA, 776 bp, Homo sapiens
  misc_feature: GYAE6OF01E19XE.46.34.D01.1.454.CMB.1.raw
  modified_base (256)..(256): a, c, t, g, unknown or other
  misc_feature (256)..(256): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctctgggtcccaggattcagtgggatgttgtgatgactcagtctccactctccctgcccgtcacccgttggacacgcccgcctccatctcctgcaggtctagtcaaagtcctacgtatacactgataggaacncctgcctggattggtactccaccgacgccggaccacggacctaagtcctaccgaagggtccgtaaccttaagtttttaacgttaaacgggttttccgtaaacccggggtaccttccggtacggggtccccaaaggaccgtaaggtactttcgaagggttcggaccgtacgggttagggacctaggggtacctaacggttacggtaacgttacccaacgtaaccttaaaggtaaacgtccggtaagggtaccggtaagggggtacgggtacgggtaccggtaggggtaagggttaacgtttaggggtttaacgggttaaacttttttaacggttaaccggttagtaccgttaggttaccggtaacggtaacgggttagaccgttaccggttacggtttccggggtacccccttaccggggtttaccttaacccggttttaaccgggaaccgggttacggggtaaccgaacggtacgtacgggaataaccgtacggtaaacggtactgggtacgtccgtacg

SEQ ID NO: 55874 - DNA, 893 bp, Homo sapiens
  misc_feature: GYAE6OF01BLJXE.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggattcgaggtggggattggttgtgatgactcagtcctccactcctccctcgcccgtcctacccgtggaccacggcccgcctcctactcctccgtgccgtacggtctaacgtacaacgtcctacgtaactacactggaacgtacggaaaacctccgtcgaccgttagggtatttacggtacctaccgaacccgacggccccgggaccgaaccgggtaccctaaacgtccccgtaacccggaacgggtacccgttaaccgttttaaaagtttttaacggttaaaacccggggttttaccccgtaaacccggggtccttaccgggttaccggggtaaccccaaggtaaccgtaagttacgttaccgaaggggtcggtaccggtagggttcgggtaccgaacggtccctaacggttaggtaaccgtttaaccgaaccgtaacgttaaacggtaaaacgtccgaacgggtacgggtaagggggtagggtaacgggtacggttaagggtaagggttaggtttagggttttaaggttaattttaacgtttacgtacgtacgtaacgtagggtaaccggtaagggttccgaaccgttacggttaccggtttacccggttcccggttacccggttaccggtttaaccgggtttccggggaacccgggttaacggggtaacccgtaacgggttccggtaagggtaaaccgtaacgttaaacccgggtaaacgtaccggttacgggtacggtcccgtaacccgg

SEQ ID NO: 55875 - DNA, 612 bp, Homo sapiens
  misc_feature: GYAE6OF01D59KH.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatctcctgcaggtctagtcaaagcctcgtatacactgataggaaacacctgcctggtattggtatcaccagcggccaggccaatctaccgaggctacctaaatttagtaacggtttctaaccgggtacttcgtcggggtcccagacagattcgagtgacgagtgggtcaggcacgtgacgttacactactagaaatcagcgagggtaggaggcgtaggaggtagttaggtttaggtaagttttaattaaccgtgtacgtagtaggacgtaagggtacgtacgtacgtacgttcgggtcccgttccgggttacgttaccgttttcgggaccggtaacggggaacccgtagggcgtagggaaggtaacgtaaccgtaaaccggtaagttcgggtcggcgtaccgg

SEQ ID NO: 55876 - DNA, 588 bp, Homo sapiens
  misc_feature: GYAE6OF01DCYN5.46.34.D01.1.454.CMB.1.raw
  modified_base (282)..(282): a, c, t, g, unknown or other
  misc_feature (282)..(282): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagcccggcctccatcctcctgcaggtctagtcaaagcctacgtatacactgagtaggaaaccacctgcctggattggactcaccngcggccagccaatctccaaggcgtcctaatttaattaaggttacctaaccgggactcgtggggtccagacagtattcgagtggcgaggtcgggtcaggcatggacgttcacgactagaaatcagacgagggtaggaggcgtggtaggtagttaggttaggtaattttagttaccgtgctagtagtacgtaagggtgacacgtagttcgtcccgttccggttcttacggtttcggacccggtaacgggggaacccaaggtccgtaggacgtaacgtaaccgaaacgtacgtaggtcggtccgtacgg

SEQ ID NO: 55877 - DNA, 689 bp, Homo sapiens
  misc_feature: GYAE6OF01DUIYF.46.34.D01.1.454.CMB.1.raw
tcagactagcagtacacgaccggtgctcgatttagatcgtctgtgttgggtttgggctgatcaggactcctcagttcaccttctcacaatgaggctcctgctcagctcctggggctgctaatgctctgggtcccaggattcgaggtgggggatggttgtgatgactcagtcctccactcctccctcgcccgtcaccttggacacgccgcctcatctcctgctaggtctagtacaaacggtcctacgtatacactgaataggaaaccactgaccttggattggtatccacagcggacaggccatccgcaaggctaccttaatttacgtaaggttcctaaccgggactcggtacgggtaccagactagtattacgagtcggcgtaggtcgggcacggtcacgtggaactttccaactaacgtaagaaacgttacgaggtacggaagggtaggacgggcgtagggaagtacggttggttaaggttaagttttacgttacgtagtacgtaagtcggtaacgaagggttacgacgaacgttacggttaccggttcccgttacccgggttacgtaccgggttttacgggacccgggtaaccgggggtaacccgtaagggttacccggtaagggtaaccgtaaacgttaacccgtaaaaaccgggtaccggtttacgggtccggtcgtaaacccgg

SEQ ID NO: 55878 - DNA, 543 bp, Homo sapiens
  misc_feature: GYAE6OF01BT6Y9.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccggactcgtcgggtccagacagattcgagtggcaggtgggtcaggcacgtgagttcacacgtagaaatcgagcgagggtggaggtcgtaggaggtagtaggttaggtaatttagttacgtgtcagtagacgtaaggtgctactagttcggccgttccggtctacgtttcggaccgtacgggaccaaggcgtaggagactacgaaacgtaatggtgcgtacg

SEQ ID NO: 55879 - DNA, 755 bp, Homo sapiens
  misc_feature: GYAE6OF01ALA9Q.46.34.D01.1.454.CMB.1.raw
  modified_base (258)..(258): a, c, t, g, unknown or other
  misc_feature (258)..(258): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctcctgcccgtcacccttggacagccggcctccatctcctgcaggtctagtcaaacgcctacgtatacactgactaggaaaccncctgcctggattggtatcgacagcggccacggcctaatccgtaccgaaggtccgtacctttaaagttttacgtaaacgggttttaccaaacccggggttacttaccggtcgggggtaccccaaggtaaccgtaagtacttccggaaggtcgggtaccgtaaggggttcggggtaccaagggtccctaaacggttcggaacgttttccgaacgtaaccgtaaggtaaaaaccgttcgaacggtaccggtaagggggtacggtaacgggtacgtacgggaagggttaggttaggtttacggttaaacttttaacgttaaccgtggtaaccgtagtacggtacggtaacggttacgaccttaaacgttcggttacggtacccgttaccggtaccgtttaccggttttccgggaacccggtacggggtaaacccctaggtaccgtacggggtaataaaccgtaacggtaaaacggtaccgtaacggtcggtcctaaccggg

SEQ ID NO: 55880 - DNA, 737 bp, Homo sapiens
  misc_feature: GYAE6OF01A6IFI.46.34.D01.1.454.CMB.1.raw
  modified_base (168)..(168): a, c, t, g, unknown or other
  misc_feature (168)..(168): n is a, c, g, or t
tcagactagcagtacacgaccggtgctcgatttagatcgtctgtgttgggtttgggctgatcaggactcctcagttcaccttctcacaatgaggcctccctgctcagctcctggggctgctaatgctcgtgggtcccaggattcgaggtggggatgttgtgatgactnagtcctccacttcctccctgccccgtctacccgttggaccacggcccgcccttccattcctcctgactaggttctaagtacaaacgtcctacgtataccgactggactaacggaaaacctccgtggaccttagggtaattggtaactccgaaccgaggcccggtaccgacggaccctaaacgtcccgtaaccgaacggtacccgtaacctttaaaagtttacgtaacggtttacccgtaaaccgggtctaccggtcgggtacccaagacgtaggtaacttcgaaggtcggagtaacggttcggtacaaggtcctaaggtacgtaacgtttaccaacgtaacgtaaacgtaaagtacgaagggtacggtaacgggggttaaggacgggtaccgtaaggggtaaggttaaggttacggtttaagggttaaacttttaggttactacgtacgtaagtacgtaacgtaacgggtactacgtacgtacgttcggaccgttcggttactacggttacggacggacggtacaggtagacggtaatacgtaaacgaagtacggttgacggtcgtacg

SEQ ID NO: 55881 - DNA, 569 bp, Homo sapiens
  misc_feature: GYAE6OF01DJPGF.46.34.D01.1.454.CMB.1.raw
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (325)..(325): a, c, t, g, unknown or other
  misc_feature (325)..(325): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgccccgtcacccttggacagccgcctccatcctcctgcaggtctagtcaaagtcctacgtatacactgataggaaaccncctgcctggattgactcacngcgcagccaatcncaaggcactaatttagtaagttcaacggctcgnggtccagacagtatcgagtggcaggtggcaggcacgtgacgttacgactactagaaatacgagacgtagggtaggaggcgtaggaggtagttaggttaggttaattttagttacgtgtacgtaagtcgtagtaaggtgacgtactacgttacggtccgttccgtcgttaccgtttacggacggtaacggggacctaaggtcgtacgggagtaacgtaacgaaacgtacgtaggcggtctaacgg

SEQ ID NO: 55882 - DNA, 688 bp, Homo sapiens
  misc_feature: GYAE6OF01A2UL8.46.34.D01.1.454.CMB.1.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (491)..(491): a, c, t, g, unknown or other
  misc_feature (491)..(491): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcgaggtgggggattggttgtgatgactcagtcctccactcctccctcgcccgtcacccttggacacggccgcctccatctcctgcaggtctagtcaacgcctagtatacnctgataggaaacncctgcctggtattggtaactcaccgaggccggacacggccaatccgtaccgaaggtccgtaacctttaagtttaacgtaacgggttttacccgtaaacccgggtacgttcggtaccggggttacccagaactaggttactttacggaggttcgggactagggttcggggtccaaggcctaacgttggacgtttacaactaacgtaagaaatccgaagtcggagggnggacggtgtaggaggtcgttaggtttaaggttaatttagttactgtagtagtaggacgtaggtacgtcgtaacgtcggttccggtacccggttccggttaccgtttacgggtttccgggaccggtaacgggtacaacgggttcgttaacgggaataaccggtaacgtaaaccggtaggttcggtacggtcgtaccgg

SEQ ID NO: 55883 - DNA, 697 bp, Homo sapiens
  misc_feature: GYAE6OF01DZURA.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtgggatgttgtgatgactcagtctccactctccctcgcccgtcaccttggacacgcccgctccatctcctgcaggtctagtacaaagtcctacgtatacactgaatacggaaacacctgcctggtattgtactcaccgagccggccaggccaactccgtaccgaaggtcgtaccttaaagttttaacgttaacggtttaccgtaaccgggtacttccggtcggggtacccaagaccaagtactcgaagtggcgtaggtgggtcagggctacgtgtacgttacaacgtacgtaagaaactcgaggacggagggtggacggtacgtaggaggttacgttaggtttaaggttaatttttagttaacgtagtccgtaagttggtaaccgtaagggtacgtaccgtaaaccgtcgttaccggggtcccgttaccgggtttaaccttacccggttttccgggaaccgggtaacggggtaacccgtaagggtccgtaagggaaaccgtaaccgttaaacccgaaaacgggttaaccgtcgggtacggtcccgtaaccgg

SEQ ID NO: 55884 - DNA, 818 bp, Homo sapiens
  misc_feature: GYAE6OF01EIMBL.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtgggctgctaatgctcgtgggtccaggtattcgaggtggggattgttgtgatgactcagtctccactcctccctcgcccgtcaccgttggacacgcccgcctccatcctcctgctaggtactagtacaaacgtcctagtacacactgatacggaaacctccgtgtccgtaggtagttcggtactaccgaccgtacggccggacccgaacggtaccctaaacgttcccggaacccgtaaacgggtccgttaaccttttaaaagtttttaaacggtttaaaccgggtttacccgtaaacccggggtaccttaccgggttaccggggaaccctaacggtaacctaaggttacgtttaccggaggggttacggtaacgttaggggttacgggtaccgaacgggtaccttaaccggttaggtaaccgttaccgaaaccgtaacgttaaacggtaaaacgttcggaaacgggtaccgggtaagggggtaccgggtaacgggttacggtaaggggttaacggttaggtttagggtttaaaggtttaactttttaagtacgtagtacgtaaggttacgaacggtaacggtacacgttacgtacgttccggtaccccgttacggttaccttaccgggttaccggacggtaaccgggtaactaaggtcgtaacggagtaaaccgtaccgtaaacggtaggttcggtagtccgtaccg

SEQ ID NO: 55885 - DNA, 740 bp, Homo sapiens
  misc_feature: GYAE6OF01B9TCH.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggcctccatctcctgcaggtctagtcaaagcctcgtatacatgataggaaacacctgcctggattggtatcaccagccggccaggcctaatcctaccgaagggtccgtaccttaaagttttacgttaaacgggttttacctaaaccgggtacttaccggtacggggtaccccaaggaccaggtacttacgaggtggacgtaggttcggggtcacgggtctacgttggacgttacaacgtacgtaagtaaaacgtcgaaggacggtaaggggttgggacgggtacgtagggaacgggtagttacggtttaaggttaatttttaacgttacgtacggtacgtagttacgtaaccggtaagggttacgacgttaacggttacgttaccgggtacccggttacccgggttaccgtttacccgggtttttaccggggaaccccggtaacggggggtaaacccgtaacgggttccggttaacggggaacgttaaacgttaaaccgaaaaccgggttaacgtttcgggtacggtccgttaaccgg

SEQ ID NO: 55886 - DNA, 649 bp, Homo sapiens
  misc_feature: GYAE6OF01DXUW7.46.34.D01.1.454.CMB.1.raw
  modified_base (266)..(266): a, c, t, g, unknown or other
  misc_feature (266)..(266): n is a, c, g, or t
  modified_base (537)..(537): a, c, t, g, unknown or other
  misc_feature (537)..(537): n is a, c, g, or t
tcagactagcagtacacgaccggtgctcgatttagatcgtctgtgttgggtttgggctgatcaggactcctcagttcaccttctcacaatgaggctcctgctcagctcctgggctgctaatgctctgggtccaggattcgagtgggatgttgtgatgactcagtcctccactctcctcgcccgtcaccgttgaccacgcccgcctccactcctcctgcgtacggtctagtacaaagcctacgtaactacacgtgataggaaaaccnccgtgccttggatttcggaactacgaccacggtccggaccacggacctaagtccgaccgaacggtccgtacttaaagttttagtaaacggtttcgaaccggtactcggtacggtaccagtacgagtattcgagttggacgtaggtcggtacaggtctacgtggtaacttccgaactaacgtaagtaaacgtcaaggtcggtagggtacggtacgcgtaggagttacgtaggttagtaatttatacgtagtcgtaagtcgacgtaacgggtnaccgtacgttagtccggtacccgttccggttagttacgtttaccgggaccgtaacgggaactacggtacggtaggtacaacgtactaaaccggtattcggtaggtctaccgg

SEQ ID NO: 55887 - DNA, 725 bp, Homo sapiens
  misc_feature: GYAE6OF01C71O3.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccttggacacgccggcctccatctcctgcaggtctagtcaaagcctcgtatacactagataggaaacacctgcctggattggtactcaccgacgccggaccacggaccaactcctaccgaaacgggccgtaccttaaattttaacgtttaaacgggttttacctaaacccggggtacttaccggtcggggtaccccaggtacaagtaattcaaggttcggacgtaggtgggtcgaggctacgttaggtacgttacactaacgtagaaactcgaggacgtagggtaggaggcgtaggaggtagttgttaggttaattttagtactgtactagtacgacgtaacggtgaccgtaacgttacgttaccgggtacccgtttacccgggtttaccgttaccgggtttttaccggggaacccgggttaaaccggggggtaaacccgtaagggttaaccggttaacggggtaaaccggttaaaccgttaaacccggaaaaccgggttaaaccggttacgggttacgggtcccgttaaacccggg

SEQ ID NO: 55888 - DNA, 585 bp, Homo sapiens
  misc_feature: GYAE6OF01BIPAQ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagcccggcctccatctcctgcaggtctagtcaaacgcctcgtatacactgatggaaacacctgcctggatttggatcaccagccggccaggccaatcctaccgaaacggcgaccttaattttacgtaaggtttctaaccggggactcgtgggtcccagacagattcgagtggcaggtgggtcaggtcacgtgacgttacacactagaaatcagcgagggtggaggtcgtaggaggtagttaggttaggtaatttaagttacgtgtcgtatcggacgtaagggttacgacacgtaagtcggtcccgttccggtcctacggtttcggccggtacggggacccgaaggcgtaggagtacgtaaccgaaacggtaagtcggtggtcgtacg

SEQ ID NO: 55889 - DNA, 810 bp, Homo sapiens
  misc_feature: GYAE6OF01EE1JH.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtgggctgctaatgctctgggtcccaggattcaggtggggattgttgtgatgactcagtcctccactctccctcgccctcacctgacacggccgcctcatcctcctgcaggtctacgtacaaacgtcctacgtactaccactagacgtaacgggaaacctacccgtcgtaccgtggttaactttacggtaacctaccgaacccgacgggacccgggaccccgaacgggacccctaaacgtacccgtaacccggaacgggtacccgttaacccttttaaaagtttttaaacgtttaaaccggggttttaacccgtaaacccgggtaccgttaccgggttaccggggaacccctaaggaacctaaggttacttacggacggtacggtacggtacgggttcggggtaacacgggtacgtacgttacgggttacttaccgaactaacgtaaacgaaaacgttcgaacggggtcggtaagggggtcggtaacgggtcgtaagggtagggttacgtttaggtttacgggtttaaatttttaacgttacgtacggtactaaggtcgtaacggaggttccgacgttaacttcgggttaccgtcccggtacggtttaccgttcggtttaacggaccggtagggtaaccctaaggtcggtagggtaaccgaacttaaccggtaaactacggttggtaccggtcgtaaccg

SEQ ID NO: 55890 - DNA, 593 bp, Homo sapiens
  misc_feature: GYAE6OF01B4YJU.46.34.D01.1.454.CMB.1.raw
  modified_base (318)..(318): a, c, t, g, unknown or other
  misc_feature (318)..(318): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcatccttggacagccggcctccatctcctgcaggtctagtcaaagcctcgtatacactgatggaaaccacctgcctggattggtatcaccagcgcaggccaatcacaaggcactaattataggttcaacggntcgtggtccagacagattcagtgcagtcgggtcaggcactggattcacacgtagaaatcgagcgtagggtggaggcgtaggaggtagttaggttaggtaaacttttagttaaccgtagactaagttcggacgtaagggtcaaccgtacgtagtttccggacccgttccgggtaccttaaccggttttcgggacccggtaacggggaacccgtaacggtaccggtacgggaacgtaacggtaacctaaaccggtaacgttcgggtcggtaacccgg

SEQ ID NO: 55891 - DNA, 670 bp, Homo sapiens
  misc_feature: GYAE6OF01BO2HO.46.34.D01.1.454.CMB.1.raw
  modified_base (260)..(260): a, c, t, g, unknown or other
  misc_feature (260)..(260): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactcctccctgcccgtcacccttggacagccggcctccatctcctgcaggtctagtcaaagcctacgtatacactgatacggaaaccncctgcctggattggactcaccagccggccaggacccaatcctaccgaaggcctacttaaatttagtaacgggtttcctaaccgggacttcggtcggggtacccaagacagtacttcgagtcggcaggtgggtaccagggtcacgtggacgttaccaactaacgtaagaaaacgtcgaaggcggaaggggtagggacggtacgtagggaaggtacgttagggtttaacggttaactttttaagttaccgtagtaccgtaagtcggacggtaaggtcgactacgtagttaccgggacccgttccgggttaccttaccggtttaccggggtaccggtaaccggggaacctaacgggtcgtacgggtaacgtaacgtaaccggaaaaccggttacgtacgggttgcccgtacgg

SEQ ID NO: 55892 - DNA, 594 bp, Homo sapiens
  misc_feature: GYAE6OF01E2RME.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctcgcccgtcacccttggacagcccggcctccatctcctgcaggtctagtacaaacgcctacgtactacactgatggaaacacctgcctggattggtatccaccagccggccagggacccaaatctccaagggccgtccttaatttataaacggtttactaaccgggtactcgtacggggtcccagacagattcagtggcaggtgggtcaggcactgagttcacactagaaatcagacgagggtggagcgtaggaggtatggttaggtaattttagttactgtactagtacgacgtaagggtcgaccagttaagttcgggacccttccggtacttaccggttttacgggaccggtacggggtaacccaagggtctagggagtaacgtacgaaacggtaacctggtaggccgtacgg

SEQ ID NO: 55893 - DNA, 834 bp, Homo sapiens
  misc_feature: GYAE6OF01DGJPD.46.34.D01.1.454.CMB.1.raw
  modified_base (162)..(162): a, c, t, g, unknown or other
  misc_feature (162)..(162): n is a, c, g, or t
tcagactagcagtacacgaccggtgctcgatttagatcgtctgtgttgggtttgggctgatcaggactcctcagttcaccttctcacaatgagctccctgctcagctcctggggctgctaatgctctgggtcccaggattcagtgggatgttgtgatgactnagtctccactctccctgcccgtcacccttggacagccgcctcatctctgcagtctagtacaacgcctagtataccactagagtaacggaaacctaccgtcgtccgttagggtaactttagggtaactaccgaacccgaacgggtcccgggtaaccccgtaagggttacctaaacgttcccgtaccccggaaaacgggtcccgtaaccttttaaaagtttttaacgtttaaaacggggtttacccgtaaacccgggacgtttccggtacggggtaccccaaggtaaccagtaacgttcgtagggtacgacggtaggtcggggctaacgggcctaacgttaggtacgtttacaactaacgtaagtaaaacgtacgaaggacgggtaaggggtagggtaagggtacggttaggtaaggggtaaggtttacggttttagggtttaaactttttaacgtttaacgtacgttacgtaaggtacggtaacggtaaagggttcgtaacgtaaccgttaagtttcccgggttaccggtttacccgggtttaacgttaccgggtttttaaccgggacccgggtaaacggggtaaacccggtaaacggtacccgggtaagggtaaagaacgttaaaacccggaaaacggttaaccggttacgggtcgggttccgtaaacccgg

SEQ ID NO: 55894 - DNA, 767 bp, Homo sapiens
  misc_feature: GYAE6OF01DWOGP.46.34.D01.1.454.CMB.1.raw
  modified_base (232)..(232): a, c, t, g, unknown or other
  misc_feature (232)..(232): n is a, c, g, or t
tcagactagcagtacacgaccggtgctcgatttagatcgtctgtgttgggtttgggctgatcaggactcctcagttcaccttctcacaatgaggcctccctgctcagctccgtggggctgctaatgctcgtcgggtccaggattcgaggtggggattgttgtgatgactctagtctcctacttcctccctcgcccgtctacccgttggacacggcccgcctcactcctccgngctacggtctacgtacaacgtcctagtactacacttagaacgtacggaaacctccgttcggaccgttaggtaatttcggtaactccgaccgacggccggaccacggacctaacgccgtaccgaacggtaccttaacttaagttttaacggttaacggtttaccgtaaacccgggtctttacgtcggtaccggtacccaagtaaccgtaggtacttcggaggttcgggacgtacgggttcggacacggtactacgggttcgtaacgttacgaacctaaacgtaaaggtaaaacgtcggtaaacggagggtaacgggagggtaccgggtaaggtacgggttaaggttaacggttaggttttaacggttaaatttttacgttaacgtcggtaacgtagtacggtaacggtacggttacgaacgttacgtaccggtccggttaccgttccggttaccgttacggtttaccggaaccggtagggacccgaggtaccgttagggaaccttaacgaccggtaaaagtcgttaggcggttacg

SEQ ID NO: 55895 - DNA, 868 bp, Homo sapiens
  misc_feature: GYAE6OF01D6OYF.46.34.D01.1.454.CMB.1.raw
tcagactagcagtacacgaccggtgctcgatttagatcgtctgtgttgggtttgggctgatcaggactcctcagttcaccttctcacaatgaggcctccctgctcagcctccgtggggctgctaatgctcgtgggtcccaggattcgaggtggggattggttgtgatgactcacgtcctcctaccttcctcccgtcgccccgtcctacccgttggacacggcccgccctctactcctccgtgcgtacggtactacgtaccaaacgtcctacgtaactacacgtagaacgtaacggaaaacctccgtcggtccgtaggtacgtttacggacctaccgaccgaacggtcccggaccgaccggacctaacgtcccgtaaccgacggtaccttaccgtttaagttttaacgttaacggtttacccgaaaccgggtcgtaccggtaccgggaccaaggtaactacgtacgttcgtagggtcggacggtagggtacgggtacgagggttcctaacgttaggtacgttacccgaactaacggtaaacgtaaacgtccggaagggtacgggtaggggtcgggtaaacggtcgggtaagggtaagggtttagttttaacggggtttaagtttaaacgtttttaacggtaacgtttcgggaaccgttagtacgggtaaccggtaagggttaaccgaccgtttaaacggtttccggttaccccgggttacccggttttaccggtttacccgggttttacgggttaccccgggggtaacgggtaaaccggggacccgttaacgggttaccggtaagggtaaaccggaaaccgttaaaccggaaaacggttaccgggtttaggacccgggtagtaacccgg

SEQ ID NO: 55896 - DNA, 776 bp, Homo sapiens
  misc_feature: GYAE6OF01ASCVF.46.34.D01.1.454.CMB.1.raw
  modified_base (261)..(261): a, c, t, g, unknown or other
  misc_feature (261)..(261): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctctgggtcccaggattcaggtggggatgttgtgatgactcagtctccactcctccctgcccgtcacccttggacagccggcctccactctcctgcaggtctagtacaagcctacgtataccatgatacggaaacncctcgcctggattggtatccaccgaggccgccgaggccaactccgtaccaagggtccgtacctttaaatttaagtttaacgggttaccgtaacccgggtacgttaccggttccggggtacccaaggtacctaaggtacttcggaggtacgggaccgtagggttcggggtaccaagggtcctacgttagggtacgtttaccgacgtaacgttaaggaaaacgttcgaaggtacgggaacgggggttcggggtaagggtaccggttaggtaaggggtaacgtttagggtttaaacggtttaaagttttacggtttaaccgtagtacgtaacgttacggtacgtaaagggtactacgtaaccgttacggttaccgggtcccgttacccgggtttccgttaaccgttttccggggtaccccggaacggggtaaccccgtaaacggggttccggttaacgggaaacggttaaaccggttacgtaaaacccgggttagtaccgggttggtaccgttaccgg

SEQ ID NO: 55897 - DNA, 775 bp, Homo sapiens
  misc_feature: GYAE6OF01DZ2JU.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatggttgtgatgactcagtctccactctccctcgcccgtccaccgttggacacgcccggcctacctactcctcctgctaggtctagtacaaagcctacgtactacactgagtagaaaccacctgcctaggtattggactcaccgcggccggaccacggacctaacgtcgtaccgaacggtcctacttaaagtttacgttaacggtttaccgaaccgggtacttcggtaccgggtccagtacgtagtacgttcgagtggcgtaggtgggcgaaggctagtggtacgttacaactaacgtaagaaaacgtcgacggacggtaggggtacggaacggtcggtagggtacgggttagtttagggtttaaggttaagtttttaagtttaccgtaaggtacggttaacgttacgggtaacggtaacgggttcggtaacccgttaacgtttacgggttacccggttccccggttacccgggtttaaccgttacccggggttttaaccgggaaccccggggtaaacgggggaaccccgtaacgggttaaccgggtaacggggttaacgtaaaacccggttaaaccgggtaaaaacggttaaccgggtttagggtccgggtcccggtaaaccgg

SEQ ID NO: 55898 - DNA, 689 bp, Homo sapiens
  misc_feature: GYAE6OF01AVVEU.46.34.D01.1.454.CMB.1.raw
  modified_base (199)..(199): a, c, t, g, unknown or other
  misc_feature (199)..(199): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacccttggacngccggcctcatctcctgctaggtctagtacaaacgcctacgtataccactggaatggaaacctaccctgcccttagggtatttgggtactccaccgagccgggccagggccaatcctaccgaaggtccaccttaatttaagtaacggtttcctaaaaccgggctcgtcggggtcccaagtacgtaggtacttacgtagtcgggtctaacggttggggcctagggacctacgtaggtacgttaccgaaccgtactaaaggtaaactacgtaacggaggtaacggggttgggacgggtacgtagggtaaggtacgttaggtttacggtaagttttaacgttaacgtagtacgtaagtaggtacggaaggttcgactacgtagttccggtccgttccggttaccttacgttttcggaccggtaccggggtaaccctaagggcggtacggtaacgtacgtaaaccgtaaacggtagttacggtggtcggtaccg

SEQ ID NO: 55899 - DNA, 731 bp, Homo sapiens
  misc_feature: GYAE6OF01EFDX8.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctctgggtcccaggattcagtggggatgttgtgatgactcagtctccactctcctgcccgtcacctggacacgccgcctcatctcctgcaggtctagtacaaagtcctagtatacactgatacggaaactaccgtgtccgtggtattggtactccaccgagccggaccaaggcccaatccgtaccgaacggtcctaacctttaaagttttagttaaaccgggtttacctaaacccggggtacttccggtacggggtacccaaggtaccgagtacgtttacgaaggtcggacgtaggtcgggtacgacggtcctacggtagtacgttaccaacgtaacgtaacgaaactcgaaggtacggagggtacggacggtcgtaaggtagggtacttagggtttacgttaagttttacgttaacgtcgtactaggttacggacggtaacgggtcgtaccgtaagtcggttaccggtacccgttcccgggttaccttaccgggttttacgggaccccgggtaaccggggtaaccgtaaccgggtcgtaaacggggtaacgtaaaccggttaaacggaaaaccggttaggttacgggttccggtcgttaacccgg

SEQ ID NO: 55900 - DNA, 799 bp, Homo sapiens
  misc_feature: GYAE6OF01EBZBI.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctcgtcgggtcccaggattcagtggggattgttgtgatgactcagtcctccactcctccctcgcccgtcacccgttggacacgcccgcctccatcctcctgcaggtcctagtccgaaacgccttacgtactacctacgtgtaagttacggaaaccctacccgtggacccgttgggtaagttttacggtactaccgacccgacgggcccggaccccgaacgggtacccaaacgttcccgtacccggaaacgggtcccgttaaccttttaaacgttttttaaacggttaaacgggttttaccgtaaaccccggggtacgtttcccgggtaccgggggtaccccaaggaaccgtaaggtacgtttacgaagggttcggacgtaggtcgggtacacggtcacgttggacgttacaacgtaactaacgaaacgtcgaacggtacgtaaggggtagggacggtacggtaggaggttagtttaggtttaggttaacttttacgttaccgtgtacgtagtacgtacggaggttacgacgtaaccgttcgttacccggtccccggttaccggttaccgttaaccggtttccgggaacccgggtacggggaacccgtacgggtcggtaacgggtaaccgtaaacgtaaccgaaacggttaaccgtcggtaccggtccgtaaccgg

SEQ ID NO: 55901 - DNA, 793 bp, Homo sapiens
  misc_feature: GYAE6OF01AOW4P.46.34.D01.1.454.CMB.1.raw
  modified_base (165)..(165): a, c, t, g, unknown or other
  misc_feature (165)..(165): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactnagtcctccactcctccctgcccgtccacccttggacacggcccggtccctccactcctcctgctaggtctagtacaaacgtccctagtaactacactgagtaacggaaactcctgaccgtggtacttggtactccgaccgacggccggaccaacggacctaactccgtaccggaacgggtaccttaaccttttaaaagttttaaacgttaacgggttttaaccggtaaaccccgggttaccgttaccggttaccgggggttaccccaaggtactaacgtacgttacgaaggtcgggactagggttcgggacgacggtaccgtaacgttaggtaacgtttaccgaaacttaacgtaaacgtaaaacgtcggtaacgggtaccgggtaagggggtagggtacgggacggttaagggaagggtttaggtttagggtttaaggtttaaacttttaacgttacgtaggtaacgtagtagggtaccgttaaagggtccgaacttaacgttacggttccgtacccggtttaccggttaccgtttacgggtttacccgggaccggtaaaccggggtaacaacgggttgtaacggtacgaacgttaaaccgaacgtacgtcgggtcgtacgtaaccg

SEQ ID NO: 55902 - DNA, 721 bp, Homo sapiens
  misc_feature: GYAE6OF01BWRSS.46.34.D01.1.454.CMB.1.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (431)..(431): a, c, t, g, unknown or other
  misc_feature (431)..(431): n is a, c, g, or t
tcagactagcagtacacgaccggtgctcgatttagatcgtctgtgttgggtttgggctgatcaggactcctcagttcaccttctcacaatgaggcctccctgctcagctccgtgggctgctaatgcttcgtcgggtcccaggtacttcgaggtggggattggttgtgatcgactcacgtcctccactcctccctccgcccgtcctacccgtggaccncggcccgtcctctactcctccgngtccgtaggtctaacgtaccaacgtcccgtagtactaacncgttagaacgtaacggaaacctccgttggccgttaggtacgtttcgtaccacgaccgaggccgacgacgtaccaactccgaccgaacggctaactttaagttagtaccggttaccgtaaccggtctcggtcgggtaccatacgcgtatcgnggtgacgtggtcggtcgacgtcacgttgtactacaataacgtaagtaaactcggtaggacgggttagggcgggtacgtggtaggtaaggtttagttacggtttaaagttacgttttaacgacgtttacgacgttagtacgtaacggtaccgtgacgttaacgtcggttccgtacccgttaccgggtaccttttcgggtaaccggtacccggtaaacgggtacccgttaaggcggtaacggtaacgtaaacgtaacggttaaaccggtggttcggacggtcccgttaaccg

SEQ ID NO: 55903 - DNA, 684 bp, Homo sapiens
  misc_feature: GYAE6OF01BKUVZ.46.34.D01.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcaccttggacacgccggcctccatctccngcaggtctagtacaagcctacgtatacactgatacggaaacncctgcctggtacttggtactaccacgaggccggccacggcccaatccgtaccggaacggtccgtaacctttaaattttacgttaaacgggtttccgtaaacccgggtctaccggttcggggtacccaagacctagtacttcgaggtcggacgtaggtcgggtacgaggcctacgtgtacgttacacgtactaagtaaacgtcgaagacggaggggtagggaggtcgtagggaggtagttaggttaggttaattttacgttacgttacgtacgtagtaggtacgtaaggtcgacgtacgttacggttccggtacccgttccggttaccgttacggttttaccgggacccgggtaacggggacccgtaacggtccggtaaggtaacgtaacgtaaccgtaaacggtaacgttcggtcggtcgtaccgg

SEQ ID NO: 55904 - DNA, 673 bp, Homo sapiens
  misc_feature: GYAE6OF01B89NC.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtgggatgttgtgatgactcagtctcactctccctgcccgtcacctgacacgccgctcatctctgcagtctagacaaagcctacgtatacactgaagtaggaaaccacctgccgtggtatttggtatccgaaccgacggccggaccaacggaccctaacgttccgtaccgaaaggtaccgtaacctttaaagttttaacgttaaagggtttacctaaacccgggtcgtacgtacgggtacccaagtaacgacgtagttacgagtcgacgtaggtcggtacacggcacgtcgtacgttacaacgtaacgtaagaaactacgagacggtagggtaggtaggcgtagggtaaggtagttaggttacggttaagttttaacttacgtagtacgtagtaggtacgtaaggtacgtacgtaacgtacgttcggacgttaccggttacgttacgtttacggaccggtacgggtaacctaaggtacgaggtaacggaacgttaaccggaaacgtaagttcggtaggtacgtaaccg

SEQ ID NO: 55905 - DNA, 572 bp, Homo sapiens
  misc_feature: GYAE6OF01DHA1K.46.34.D01.1.454.CMB.1.raw
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggatcacagcgcagccaanctcaagcnctaattataaggttctaaaccgggntctggggtcccagacagattcagtggcagtgggtcaggcaactgacttcacactagaaatcagcagggtaggaggctagaggatgttaggtaatttaattactgtacattagacaaggtgacgtaactagtttacggcccgttccggtcgtaccgtttttacgggacccgtaacgggggtaacccgaaaggtccgttaagggaagtaaacgtaaccgtaaaaacggaaaccgttacggtcgggtccgttaccgg

SEQ ID NO: 55906 - DNA, 750 bp, Homo sapiens
  misc_feature: GYAE6OF01C320X.46.34.D01.1.454.CMB.1.raw
  modified_base (435)..(435): a, c, t, g, unknown or other
  misc_feature (435)..(435): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtccaggattcagtggggatgttgtgatgactcagtctccactctccctgcccgtcacctgacagccgcctccatctcctgcaggtctagtacaaacgtcctagtactaccagtgatacggaaacctcctgcctggacttggactcgaccgagccggaccaggacctagtccgtacccgaaagggtcctaacgttaaagtttacgttaaacgggttttaccgaaacccgggtcttcggttccggggtaccccaaggtactaacggttacgttcgaacggtcgggacgtaaggggttccgggggtnaaacgggtcctaacggttgtaaccgtttcaaacgtaccgtaaacgggtaaaactacggaacggtaccgggtaagggggtaagggtaacgggtacggtaggtaacgggtagtttagggttaacggtttaaatttttaacgtacgttagacgttagtacggtacggtaaggtcgactaacgttcgttaccggtcccgttaccggtaccgttacggtttacgggacccggtaacggggtaaccccgaaggttaccggttacggaaacgtaagttaaacccgtaaacggttaccgttacgggtacgtccggtaacccgg

SEQ ID NO: 55907 - DNA, 762 bp, Homo sapiens
  misc_feature: GYAE6OF01AKFHE.46.34.D01.1.454.CMB.1.raw
tcagactagcagtacacgaccggtgctcgatttagatcgtctgtgttgggtttgggctgatcaggactcctcagttcaccttctcacaatgaggcctccctgctcagctccgtggggctgctaatgctcgtgggtcccaggtattcaggtgggatgttgtgatgactcagtcctccactcctcccgtcgcccgtcctacccgttggaccacggcccggtcctccactcctccgtgcgtaggtctagtaccaacgtccgtacgtaactaccacgtgaagtaccggaaaacctccgtcggtccgttaggtagtttcggtaactcccgaaccgacggtccggaccgaacggaccctaacgtcccgtaccgaagggtccctaaccgttttaaattttaacggttaaccgggttttaccgtaaacccggggtcttccgggtacggggtacccaagtaacgtagtacttacggaacggtcggacgtagggtcgggtacgacggtcgtacgttaggaacgttacacgaacgtagaaatcgaacggtacggtaaggggtcggacggtcgtagggacggttagttggtttaaaggttacgttttactacgtcgtacgtaagtacggtacgtaaggggtactacgtacgttagttcccggtacccgttcggtaccgttttacggttacgggaacccggtaacggggtaactacggacgtacgggtaacctaacggtaacgaaacccggtagttcgggtacgtaccggtaccg

SEQ ID NO: 55908 - DNA, 656 bp, Homo sapiens
  misc_feature: GYAE6OF01EX66G.46.34.D01.1.454.CMB.1.raw
  modified_base (276)..(276): a, c, t, g, unknown or other
  misc_feature (276)..(276): n is a, c, g, or t
  modified_base (549)..(549): a, c, t, g, unknown or other
  misc_feature (549)..(549): n is a, c, g, or t
tcagactagcagtacacgaccggtgctcgatttagatcgtctgtgttgggtttgggctgatcaggactcctcagttcaccttctcacaatgaggctccctgctcagctccgtgggctgctaatgctctgggtcccaggattcagtggggatgttgtgatgactcagtctccactcctcccgtcgcccgtccacccgttggaccacgcccggcctccactcctcctgccaggttctagtacaaacgccttacgtataccactgaactacggaaaacncccgtgccgttaggatttggactccgacgcggcggccaggcccaatccgacgaaggcctacttaaacgttttaagtaacgggtttacgaaacccgggtacttccggtacgggtaccaagactaggtacttcgaggtcggcgtaggttacggtcaagggcctacgtagtacgttaaccaagtactaagaaactcgagaggtaacggggtggacggtctggagggtaattggttagtaattttagtaactggtaactacgtaggacgtaagggtncctacgtagttccggtacccgtcgttcgtttaacgtttcggaccgggtaacggactaacggtcgtaagggtacaacgttaacgaacggtaacgtggtggacctacgg

SEQ ID NO: 55909 - DNA, 815 bp, Homo sapiens
  misc_feature: GYAE6OF01C5709.46.34.D01.1.454.CMB.1.raw
  modified_base (215)..(215): a, c, t, g, unknown or other
  misc_feature (215)..(215): n is a, c, g, or t
  modified_base (295)..(295): a, c, t, g, unknown or other
  misc_feature (295)..(295): n is a, c, g, or t
tcagactagcagtacacgaccggtgctcgatttagatcgtctgtgttgggtttgggctgatcaggactcctcagttcaccttctcacaatgagctccctgctcagctccgtggggctgctaatgctcgtcgggtcccaggtacttcgaggtgggggtatggttgtgatgactcagtcctcctactcctccctcgccccgtcctaccgttggaccncgcccggtcctccattcctccgtgacgtacggtctacgtacaaacgtcctacgtactacacgtagacgtaacggaaaccnccgtgccgttagtacgtttcggtaactccgaccgacggccggaccgacggaacctaacgtccgaaccggaacggtccgttaaccgttttaaattttaaacgggtttaaccggtttacccggtaaacccgggtcgttcgggttaccggggtaaccaaggtaacctaggttacgttacgtacgggtcggtacggtacggttcgggcgaacggtcctacgtggtaaccttcgaactaacgtagtaaacgtcgagtacggtagggtaggaggtctaggtaagttaagttggtttaaagttacgttttaacgtacgttccgtaagtagtacggtacggtaacggttcgtaaccgtaccgttaacgtttcccgggtacccgtttacccggtttacgttacccggtttaccgggaacccgggtacggggtaaacccggtacgggttaacggtaacggggtaaaccgtaaccgttaaaacccgggtaaacggttaacggttcgggtaaccggttcggttaaaccccgg

SEQ ID NO: 55910 - DNA, 729 bp, Homo sapiens
  misc_feature: GYAE6OF01EHVGH.46.34.D01.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcagtggggatgttgtgatgactcagtctccactcctcctgcccgtcacccttggacncgccgcctccatctcctgcaggtctagtacaacgcctcgtatacactgataggaaaccncctgcctaggtattggatccacgacggccggaccacggaccctaaatccgtaccgaacgggtacctacctttaaattttaagttaacgggtttaccgtaaacccgggtactccggtacggggtcccaagtacgtaagtacttcgaggtggacgtaggtgggtacgaggtctacgtagggtacttaccaacgtacgtaaacgtaaaacgtcgaaggaccgggtaagggggtacgggaacgggtaccggtaaggggtaagggttacggttttagggtttaaagggtttaaatttttaaccgttacgttacgaacgttaacggtacgtacggtaagggttacgaccgtaaccttagggttacccggtacccgttcggttaccggttttacggttacccggaccgggtaaacgggtaccctaaggtccgtagggtaactaacgtaacgtaaacggtagttcgggtacgcgtaccg

SEQ ID NO: 55911 - DNA, 664 bp, Homo sapiens
  misc_feature: GYAE6OF01C00GH.46.34.D01.1.454.CMB.1.raw
  modified_base (263)..(263): a, c, t, g, unknown or other
  misc_feature (263)..(263): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccctggacacgcccggcctccagtcctccgtgcaggtctagtacaaagcctacgtataccactgactaggaaacncctgcctggtattggtactcaccaggccggaccgaggaccaatctaccgaaggtccaccttaatttaacgtaaggttacctaaccgggacttcgtggggtaccccagtaccagtattcgaggtggcgaggtcggtcagacctatcgagttccaactaactagaaatcaaggacgtagggtaggaaggtcgtaggaggtataggttagtaagttttaactacgttacgtactaacgtacgtacgtagggtcgacgtacgttacgttcggtacccgttaccggttaccgttaccgggttttacgggaacccggtaacggggtaccctaacggtccgttacgggtaacgtaccgttaaaccggaaaaccggtacggtttacgggtaccggtaccgtaacccggg

SEQ ID NO: 55912 - DNA, 746 bp, Homo sapiens
  misc_feature: GYAE6OF01BILB3.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtcctccactcctccctcgcccgtcacccttggacacgcccggcctccatcctcctgacaggtctagtacaaacgcctacgtactacactgataggaaaccacctgctggtattcggtatcaccgagccggccacggacctaactccgtaccgaaggtccgtacctttaaagtttaacgttaaacgggttttaccgtaaacccgggtcgtcggtccggggtacccaaggtacaggtattccgaaggtcggacgtaggtcggggtacagggtactacgttaggtacttaccaacgtaacgtaacgtaaaactcggaacggtacgggaagggggttacggggaacggtacggtacgggtaagggtaggtttacgggtttaagggttaaatttttaacgttacgttacgtacgtagtacggtacggtaacggggttacaaccgttaaccgttcggtttaccgggcccgtttccgggttaccgtttaccgtttaccggggacccgggtaacggggtaaccgaggtacgtagggtaacgaaccgtaaacctaaacgggtaacgttcgggttcggaccttacccgg

SEQ ID NO: 55913 - DNA, 736 bp, Homo sapiens
  misc_feature: GYAE6OF01C909K.46.34.D01.1.454.CMB.1.raw
  modified_base (212)..(212): a, c, t, g, unknown or other
  misc_feature (212)..(212): n is a, c, g, or t
  modified_base (277)..(277): a, c, t, g, unknown or other
  misc_feature (277)..(277): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtcgggtcccaggtattcgaggtggggatggttgtgatgactcagtcctccactcctccctcgccccgtcctacccgttggaccncgcccggcctccatcctcctgcgaggtctagtacaacgcctagtatacactagagtacggaaccnccgtcgccgtggtattcggtaactccgaaccgcggcccggtaccgacggtaccctaaacttcccgtaccgaacggtccgttaacctttaaagttttacgtaacggtttaccgaccggtactcgtacgggtaccagacagtactcgagtcgcgtaggtcggtcaggctacggtagtacgttcgaactaacgtaagtaaacgtacgaggacggtaggggtacggtaagggacgtaagggtaggttacggtttaaggtttaacggtttaattttaacgttacgttacggtacgtacggtaggtacggtaagggttacgaccgtacggttacgttccgggttacccgttcccggtttacgttaccgggtttaccgggaccgggtaaaccgggtacgtaacggttcggtaacggtaaccgtaacgtaaaccggtaaacgtacggtacggtacggtccgtaaccg

SEQ ID NO: 55914 - DNA, 873 bp, Homo sapiens
  misc_feature: GYAE6OF01EBIRY.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtgggctgctaatgctcgtcggtccaggtattcgaggtgggattgttgtgatgactcagtcctccactcctccctcgcccgtccaccgttcggacaccggcccgtcctcctagtcctccgtcggacgtaggttacctagtacgaacgtccgtagtactacacgtagacgaacgaacaccgtcggccgttggtattacggtactaccgacccgacggcccgaccgacggtaccctaacgttcccgtaaccggaacgggtaccctttaacgtttaaaacgtttttacggttaaaccgggtttaacccgtaaacccgggggttaccttaccgggttaccggggaccccaaacggtaacgttaacggtaatttccggaaggttcggaccgttaggtcgggtaccacggtctacgttgtaacgttacgaacgtaacgttaacgtaacgacggaagggtacgggtaacgggggtacgggtacgggtacgtttaggggaaagggtttagttttaacgggttttaaggtttaaaccctttttaggtttaaccggtaggtaaccgtttaggtaccggtaaacgggttacggggtaactcggttaaaccggttccggtttaccgggtcccgtttaccggggtttacctttacccggggtaaccgggaccggggttaacccggggaacttaaacgggcccgggttaaagggtaacgtaaacccgtttaaaaccgggaaacggttaacgggttcggtaaccgttacggtaacccg

SEQ ID NO: 55915 - DNA, 670 bp, Homo sapiens
  misc_feature: GYAE6OF01CZ74I.46.34.D01.1.454.CMB.1.raw
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (253)..(253): a, c, t, g, unknown or other
  misc_feature (253)..(253): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctcctgcccgtcacctgacacgccgcctcatctccngcnggtctagtacaacgcctacgtatacactgataggaaaccnctgcctaggtattggtactacaccaggcggaccgaggaccaactccgaccgaacggtccgtacttaatttaagttaacggtttaccgaaccggtacgttcgtcgggtacccagacagtatcgtagtggctaggtcggtcgacggactacgtgacgttcaactaacgtaacgtaaaactacgacgacggtacggggtaggtaaggcgtaggtacggtagttagtagttaacgtttagttacgtgtacgtagtacgtacgtaaggtcgtactaacgtacggttccggtacccgtttacccggttaccggttaccggtttaccgggacccgggtaaacggggtaaccctaacgggtcggttacgggtaacggtaacgttaaacccggaaaacggttaggttacggtggtaccgtaaccgg

SEQ ID NO: 55916 - DNA, 790 bp, Homo sapiens
  misc_feature: GYAE6OF01CUJ94.46.34.D01.1.454.CMB.1.raw
tcagactagcagtacacgaccggtgctcgatttagatcgtctgtgttgggtttgggctgatcaggactcctcagttcaccttctcacaatgaggcctccctgctcagctccgtggggctgactaatgctcgtcgggtcccaggacttcgaggtggggtattgttggtgatgactctacgtcctcccaccttcctcccgtcggtccccgttaccgtacccgtacggaaccgccggtccccggtacccttccaccgttcctttcccgacggtaccgtaggttaccgtaacggtaacctaaaccggtcccttaacggttaactaccgacgttagaacgtaaccggaaacctccgtacggtccgtaggggttattacggactcccgacggacggcccggaccgacgaccctaactcccgaaccgacggtcttaactttaaacgtttaggttaaccggttacccggaccggttcgtaccgggtacgggtacccaagtacgacgtacttcgagggtacgacggttagggtccgggtacacgggtacctaacgttacggtaacttacgaacgtacgtaacgtaacgcgtacgggacgtaggggaggtacgggtagtagggagttaggttaggttaattaagttacgttacgtgtaacgtgtaacggtacggtacggtacgtacgttacggtaccgttcgggtacccgtttccggtacgttaccggttacgggacccgggtaggtaaccggaggtacggaacgtacgacgtaaacgacgttaggtcgtggactaccgg

SEQ ID NO: 55917 - DNA, 792 bp, Homo sapiens
  misc_feature: GYAE6OF01BVTS0.46.34.D01.1.454.CMB.1.raw
  modified_base (164)..(164): a, c, t, g, unknown or other
  misc_feature (164)..(164): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (416)..(416): a, c, t, g, unknown or other
  misc_feature (416)..(416): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtcgggtccaggtattcgaggtggggtattggttgtnatgactcacgtctccactcctcccgtcgcccgtacaccgttcgacacggcccgacctccacttcctccgtgccgtaggtcctaacgtacaaacgtcctagtanaccncgtagactacggaaacctcctcgccgtggtattcgactccacgacggccgccagtccaacgtcaccgaacggtctacctttaatttaacgtaggtttaccgtaaccggtacgttccggacggtacccaagtactagtacgttagnggtcgacgtgggtacggtaccgaggtctacgtacgtaacgttaccaacgtacttaaagaaaccgtcgaaacgggtcgggtaacgggtagggtacgggtacggtagttaagggttagtttaacgggttttaaaggttactttttaacgttacggttcgaacggtttaacggtacggaacggttaaggggtacctaacggttacgtttacgggttaccccggttcccgggtttaaccgggtttccggtttaaacccgggtttcgggtaaacccgggtaaccggggaacccgttaaagggttccgggtaaaggaaacccgtttaaccgaaaaccgggttaaacggtaacggtttacggtccgggtaccttaaccccggg

SEQ ID NO: 55918 - DNA, 751 bp, Homo sapiens
  misc_feature: GYAE6OF01BTGN0.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcgaggtgggggatgttgtgatgactcagtctccactctccctgcccgtcacccttggacacggccgcctccatcctcctgcaggtctagtacaaagcctacgtataccactgacgtacggaaacctacctcgccgtggtatttggtaactccgaccgaggccggaccacggaccctaatccgtaacccgaacgggccgttaacctttaaaagttttaacgttaaccgggttttaccgtaaacccggggtacttcggttacggggtacccaaggtaacgagtacgttacgaggttcggcgtaggttcgggtacgagggtccacgttggtacgtttccaaccgtaacgttaacggaaaacgtccgtaaggtacgggtaaagggggttacgggaacggggtcgtagggtaagggtagtttagggttttaaggtaaacgtttttaagttaacgttacgtacgtagtaccggtacggtaaggtacgtacgtaacttacggttcgggtccccgttccggttacgttacccggtttacggaccgggtaaacgggtaccaaggtcggtaagtacgtaaacgtaaccggtaaacgtaacggttggtacggtcgtaccgg

SEQ ID NO: 55919 - DNA, 773 bp, Homo sapiens
  misc_feature: GYAE6OF01AH1M7.46.34.D01.1.454.CMB.1.raw
  modified_base (255)..(255): a, c, t, g, unknown or other
  misc_feature (255)..(255): n is a, c, g, or t
tcagactagcagtacacgaccggtgctcgatttagatcgtctgtgttgggtttgggctgatcaggactcctcagttcaccttctcacaatgaggctccctgctcagctcgtggggctgctaatgctcgtgggtcccaggattcgaggtggggatgttgtgatgactcagtcctccacgtcctcctcgccgtcaccgtggacacggccgtcctcactcctcgtgactacggtctagtacaacgtctacgtataccnctagacgtaacggaacctccgtacggcgttagggtactttcggtaactaccaccggacggaccgggtaccggaaccggtaccctaaacgttcccgtaccgggtaaccgggttaccgtttaaccgttttaaaagtttttaacggtttaaaccgggttttaacccggaaacccggggtttacgttcccggggtaaccgggttacccaacggttaacgttacgggttaacttaccgggtggtacggggtaaccggtagggtaccggggtactaacgggtctacggttagtaccttaccgacgtaacgttagaaacgttcgacgggtaacgggtgggtagggacgtacggtaagggtaggttacggtttacggtttaggtaactttacggtctaggtcgtgtacggacgtagtacgacgttcgtacgttacgtccggttaccgtggttacgttccggaacggtaccggtacgaggtcctagggacttaacggtacgtacgtacgggtcgcgttcgtacccgg

SEQ ID NO: 55920 - DNA, 805 bp, Homo sapiens
  misc_feature: GYAE6OF01AN4S9.46.34.D01.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggatgttgtgatgactcagtctccactcctccctgcccgtcacccgttggacncgccgcctcagtctcctgcgagtctagcaagtcctacgatactacgtggaactacggaaaccncgtgccgtagtacttggactcgaccgagccgacgacggacctacgtcctacgacgtaccgtacctttaaagtttacttaacgggtttaccgtaacccggtactcggtacgggtacccaaggtacgtaacgtaacgttcgtagggtttacggaacgtacgggttacccgggtacggaacgggttaccctacggtacggttaaacgttacccgtaacgttaaccgtaaacggtaaacgtaccggtaagggtccggtaaaggggtacggtaccgggaacggttacgggtaacgggttaggttaaccgggtttaggttaaacttttacggttacgttacgtacgtaacgtacgggtaaccggtaaggtaccgttaaccgtacgttagggttacccgttccgttacccgggttacgtttaccgggttaccggaaccggggttaccggtaaacccgggtacggttaccgggttaacggttaaaccgaacgggttaaccgttaaaaaccgggttaccggttcgggtaccgggttacccgtaacccgg

SEQ ID NO: 55921 - DNA, 752 bp, Homo sapiens
  misc_feature: GYAE6OF01A0BDD.46.34.D01.1.454.CMB.1.raw
  modified_base (166)..(166): a, c, t, g, unknown or other
  misc_feature (166)..(166): n is a, c, g, or t
  modified_base (198)..(198): a, c, t, g, unknown or other
  misc_feature (198)..(198): n is a, c, g, or t
  modified_base (265)..(265): a, c, t, g, unknown or other
  misc_feature (265)..(265): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggatgttgtgatgactnagtctccactctccctgcccgtcaccttgacncgccgcctcatcctcctgctaggtctagtaccaaacgtcctagtactacactgaagtacggaaaccncctggccgtggtacttggtactaccaccgaggcccggaccacggacctaaatcccgtaccgaacggtcccgtaacctttaaattttaacggttaaacgggttttccgtaaacccggggtctttaccggtacggggtaccccaaggacctagtacgttacgaggtgggactagggttcgggtacagggtactacgtgtacgtaccacgtacgtaagaaatcgaagtacggaggggtacggagtcgtagggtacggtagttacggtttaaggttaacttttacgttcgtacgagtaacgtagtacggtaagggttcgaaccgtacgttacggttacccggtcccgtttacccgggttacgttaacccgggttttacgggaacccgggttaacgggggtaaccgtaaccggggtcggttaaacgggtaaacgttaaccggttaaaccggaaaaccgggttaagttacggggtaccgtaccggtaacccgg

SEQ ID NO: 55922 - DNA, 862 bp, Homo sapiens
  misc_feature: GYAE6OF01EOFES.46.34.D01.1.454.CMB.1.raw
  modified_base (474)..(474): a, c, t, g, unknown or other
  misc_feature (474)..(474): n is a, c, g, or t
tcagactagcagtacacgaccggtgctcgatttagatcgtctgtgttgggtttgggctgatcaggactcctcagttcaccttctcacaatgagctccctgctcagctccgtggggctgctaatgcctcgtcgggtcccaggtattcgaggtggggatgttgtgatgactcacgtcctccactcctccctcgcccgtccaccgtggacacggcccgcctcactctcctgacgtacgtaccagtaccaacgtcctacgtactaccgacgtaggacgtaaccggaaacctccgtacggtaccgttaggtacgttggtacctaccgaccgacgggtcccggaccgaccggtaccctaacgttcccgaccgtaacgggtaccttaaccgttttaaagttttaaccggtttaacgggtttaaccggtaaccccgggtcttaccggggtaccgggtaacccaggtaacgtagttactaggnggtacggcgtagggttacggacgtacgtcacgttaggtacttacactaacgtaacgaacgtacgtacgggacggtaggggtacggacggttacggtagggtaaacggttaggtttacggtttaaggtttaacgttttaaccgttacggtaacggtacgttacggttaacggtacggtaacgggttaccgttaacgtaacgtttacggtttacccgggtaccccgtttccgggttaacgggttttacccggggttaccggggtaaacccggggtaaccggggggtaaacccttaggggttaacccgggtaaagggtaaaccccggttaaacggtaaaacccggttaaccgggttaacggttccggggtaacggttacccgggtaacccg

SEQ ID NO: 55923 - DNA, 788 bp, Homo sapiens
  misc_feature: GYAE6OF01E1WBY.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtgggggatggttgtgatgactcagtcctccactcctccctcgcccgtcctacccgttggaccacggcccggcctccacttcctcctgactaggtctagtacaaacgtccgtacgtatacacgtagacgtacggaaacctaccgtcgtaccggtaggtagtttacgggtaactccgaaccgtacgggaacccgggcccgtaacgggaaccctaaacgtaccggtaccgaaacgggtcccgtaccctttaaaagtttttaaactaaacgggttttaccgtaaacccgggggtacttccgggttacggggtccccaaggtacgtaacgtaacgttccgaagggttcgacgtaggttcgggtacgacgggactacggtagtacgttaccctacgaacgttaacgtaaaaccgtcggtaacggtaaccggtagggggtaacgggacggtaccggtaaggtagggttacggtttagttaacgggtttaactttaacgtttaacgacgtctaagtaacgggtcgaagggttacgacgtacgttacgttccgggtcccgttaccggttcgttaccggttaccgggaccgtacggggaacctacggtcggtaggaacgtacgtaaccgaacggtaacggtcgtggcgtaccg

SEQ ID NO: 55924 - DNA, 805 bp, Homo sapiens
  misc_feature: GYAE6OF01B1T00.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggattcgaggtgggggattgttgtgatgactcagtcctccactcctccctcgcccgtcacccgttggacacggcccgccctccatcctcctgcgaggttctagtacaacgtcctacgtataccactgactacggaacctaccgtcgaccgtggtacttaggtactccaccgacggccggaccgacggaccctaactccgtaccgaacggtccgtaactttaagtttaagttaacggtttaccgtaaccgggtacgttccggttacgggacctaaggaccgtaagtacgttacggaacgggtcgggacggtagggttacggggtacaacgggtaccgtaacgttacggtaacgttaccaacgtaaacgtaaacgtaaacgtacggtaacgggtacggtacgggggttaggacgggtacggtagggtaaggttacggtttaagggtttaaggtttaaacgtttttcgtttaacggtacgttaacgtacggttaacgacgggtaacgggtacgtaaccgtacgttacggttacccgggttaccccgttcgggtttacctttaccgggtttaccggggacccgggtaaggggtacccgaacgggttcggtaacggtaacgtaacccgttaaaccggaaacggttaaccgtgggttacgggccgtaaccgg

SEQ ID NO: 55925 - DNA, 896 bp, Homo sapiens
  misc_feature: GYAE6OF01A3PJO.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctgggctgctaatgctctgggtcccaggtattcagtggggattgttgtgatgactcagtctccactcctcctcgccctcacccgttggacacgccgcctcatcctctgctacggtctagacaaacgtccgtacgttaacactactgaacgttacggaaaacctccgtgtacccgttaggtactttacggaactaccgaaccgacggcccggtacccgaacggacccttaacgtcccgtacccgaaggtccgtaaccttttaaacgtttaacgttaacgggtttaacccgtaaacccgggttacgttacccggttaccggggtaacccaaacgtaccgtaaacggtaccttacggaacggtttacgggacgtaacgggtcgggtaccgaaggttacccgtaacgttacgggtaaccgttacgtaacccgttaacggtaaaccggttaaacgtaccgaacggggttacccggtaagggggttacggaaccgggttacgttaacggggtaagggttacggtttaacggttaaggggtttaaaccttttaaagttacccggtttaacggtacgtttaaaggttaccggttaaccggtaaacgggttccgtaaccggtttaaaccgtaccgggtttaccgggttaccccgttaaccgggttacccgttaaccggggtttttaccgggaacccgggtaaacggggttacccgtaacgggttccgttaacgggtaaagtaacccgttaaaccggtaaaccggttaacgttacggaccggttacggtaaccccgg

SEQ ID NO: 55926 - DNA, 751 bp, Homo sapiens
  misc_feature: GYAE6OF01DPU4Z.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtgggctgctaatgctctgggtcccaggtattcagtggggatgttgtgatgactcagtctccactcctccctgcccgtcaccgttggacacgcccggcctcactctcctgctaggtctagtacaacgtcctacgtatactacgtagagtaacggaacctccgtcgtaccgttggtaacgtttggtaacctaccgaaccgacggccgggtacccgaacggtaccaacgttcccgtaaccggacgggtccttaacctttaaagttttaacgtttaacgggtttacccgtaacccgggtacttcggtaccgggtaccaaggtacagtacttacgagggtcggacgtggttacgggaccgaggtacctacggttgtaaccgttcaaacgtaacgtaagtaaaacgtcggaacggtacgggtaggggtacgggacgggtcgttagggtacgggttaaggtttaccggtttaaggtttaacgtttttacgtacgttacgtacgtaacgtacggtaacggtaggtacgtacgttacgttaaccggttccggtcccgttaccgttaccgttaccggtttacggaaccgggtacgggaacgtacggtacgtaggaagtacgtaacgtaacgtagtacggtcgtcgtaccg

SEQ ID NO: 55927 - DNA, 743 bp, Homo sapiens
  misc_feature: GYAE6OF01C4BUQ.46.34.D01.1.454.CMB.1.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggtattcgaggtggggatgttgtgatgactcagtctccactcctccctgcccgtcacctggacncgccgcctcatcctcctgctaggtctagtacaaacgtcctagtatacactgactacggaaacnccgtgccgtaggtattggtacnccacgacggtccgggaccaacggaccaactccgtaccgaaacgggcctaaccttaaatttaacgttaaacgggtttccgtaaacccgggtacttccggtacggggaccccaaggacctaggtactacgaggtacggacgtagggtcggtacgacggtcctaagttgtacgttaccaacgtaacgtaagtaaacgtcgaaggacggtagggtagggaacggtcgtagggaaggtaggttggttaacggtttaaattttacgttacgtacgtaacgtacgtacggtaacggttaaggtacgtaacgtaacgttaacggttccggttaccccggttaccggttaccggttaccggttttaccgggaccgggtaaaccgggaaccgtaacggtacccggtaagggtaaacgtaacgtaaaccgtaaaccggtaggttaccggtcgggtaccgtaaccgg

SEQ ID NO: 55928 - DNA, 771 bp, Homo sapiens
  misc_feature: GYAE6OF01D7I14.46.34.D01.1.454.CMB.1.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctctgggtcccaggattcgagtgggatgttgtgatgactcagtctccactctcctcgcccgtcaccttgacncgccgcctccatctccgtgacgagtctacgtacaaacgtcctacgtatacactgagtacggaaaaccnccgtgccttaggtatttcggtaactccaccgacggccggaccgaacggaccctaaacttccctaccggaacggtccgttaaccttttaaaagtttttaacggttaacggttttacccggtaaccgggtaccttccgggttacggggtaaccccaaggaacgtaacgttattaccgaaggttcggacgtacgggttacgggtaccgaggtcctaacgttgtaacgttccaactaacgtaacgtaaaacgttcggaacggtacggtaaggggtacgggtaacgcgggttaagggtaacggttaagtttacgggtttagtttaaacgttttacgtttaacgtagtacgtaacgttgtaaccgaagggttcgtaaccgtacttaccgggttccggttacccggttacccggttacgtttaccggtttaccggggacccggttaaccgggtaaccgtaggtacgtacgggtaataaacgtacggtaaaaccgtcggtaggtcgtccggtaacg

SEQ ID NO: 55929 - DNA, 568 bp, Homo sapiens
  misc_feature: GYAE6OF01C940B.46.34.D01.1.454.CMB.1.raw
  modified_base (252)..(252): a, c, t, g, unknown or other
  misc_feature (252)..(252): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (337)..(337): a, c, t, g, unknown or other
  misc_feature (337)..(337): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctcactctccctgcccgtcacccttggacagccggcctccatctcctgcaggtctagtcaaagcctgtatacactgatggaaacnctgcctggattggatcacagcggcagcaatcncagcnctattatagttcacggatcgnggtccagacagatcagtggcaggtggnaggcagtgagttcacactagaaaatcaagcgagggtaggacggcgtaggaggtagttaggttaggtaacttttagttaactgacgaagttgacgtaaagggtcgacgtactagttacggtcccgttaccgggttacgtaccgttttacgggacccggtaacggggtaacccgtaaggccgttagggaagtaaacgtaaccgaaaaacgtaacgttacgtggtcgtaaccgg

SEQ ID NO: 55930 - DNA, 770 bp, Homo sapiens
  misc_feature: GYAE6OF01CGS82.46.34.D01.1.454.CMB.1.raw
  modified_base (201)..(201): a, c, t, g, unknown or other
  misc_feature (201)..(201): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtcgggtccaggtattcgaggtggggattgttgtgatgactcagtctccactctcctcgcccgtcacctgacncgccgctcactctcctgcgaggtactacgtacaaacgtcctacgtatacactagaataacggaaacctacctcgtaccgtaggtacttcggtactaccgaccgacggccggacgacggacctaactaccgtaccggaacggtcccgttaacctttaaaagttttacgttaaacgggtttaccgtaaaccgggtccttacggtaccggggtacccagacgtaacgtacgtttcgaacggtcggtacgtacggtacgggtacgacggactacgtaggtacttacacgtaacgtaagtaaacgtcgaggacggtagggtacggtaggtcgttagggtaaaggttagtttacggtttaaaggttaactttttaacggttaacgttacggtaacgtacggtacgggtaacgtaacggggttacaaccggtttacgttaacggtttcccgggtacccgtttaccgggttacgtttaaccggggtttccggaaaccgggtaccggggtaaccgtaagggtcgttacgggaaacgttacgttaaactaaacggttacggtaacgttgggtcgtacgg

SEQ ID NO: 55931 - DNA, 848 bp, Homo sapiens
  misc_feature: GYAE6OF01DTAHY.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgcttcgtgggtccaggattcaggtgggatgttgtgatgactcagtctccactcctccctgcccgtctacccgttggacacgcccggtcctccattccgtccgtgacgtaggtctagtccaaagtcctacgtataccactaggaactacggaaacctaccgtcggaccgttaggtactttggtacctcgaccgaggccggacctacggtacctaacgttccgaccggtaaggcccgttaacctttaagttttaacgtttaaacgggtttacccggtaacccgggtcttaccgggtaccgggacccctaaggaaccgtaggttaacttaccggtaaggttcgggaccgtacgggttacgggtacccgaacgggtaccctaaaccgggtttggtaaaccgtttaccaaaccggtaaaccttaaacggtaaaaacgtttcgaaaccgggtacgggtacgggggtaacgggtaacgggtaccgtaggggtaacggttacggtttaggttaagggttttaactttttaacggtacgttaggtacgtaacgtttacggtaacggtaagggtcgtacgtaacggtttacgttaccgggtcccgtttaccggttaccgtttaccgggtttaccggtaaccggtaaccggggttaaccctagggtaccggttaccgggtaaacgtaccgttaaaccggaaacgttaccggttacgggtaccgggtcctaaccgg

SEQ ID NO: 55932 - DNA, 583 bp, Homo sapiens
  misc_feature: GYAE6OF01B2WTX.46.34.D01.1.454.CMB.1.raw
  modified_base (215)..(215): a, c, t, g, unknown or other
  misc_feature (215)..(215): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
tcagactagcagtacacgaccggtgctcgatttagatcgtctgtgttgggtttgggctgatcaggactcctcagttcaccttctcacaatgaggcctccctgctcagctccgtggggctgctaatgctcgtcgggtacccaggtattcgaggtggggattggttgtagatcgactcagtcctcctacctcctccctcgcccgtccaccgtggacncggccgcctccatcgtctgcgtaggtctagtacaaacgtcctagtatacgatgatacggaactctgctagattgancacgnggccgacagtnaactcaccgaggctacttaattagtaacggttcgaaccggactcggtcggtaaccagactagtaactcgaggtcggacgtggtgtaccaggctaacgtgtacgtactacaagtaagaaactgagtagtaggtagacgngagagtagttagtagttaattagtagngacgtagtcgacgaagtgactagtacgtcggaccttcggtacgtacgttacggacggtaacggaacgagtacggtagataaacggtaacgtaaacgtacgaggtgcgtacg

SEQ ID NO: 55933 - DNA, 666 bp, Homo sapiens
  misc_feature: GYAE6OF01A1HFS.46.34.D01.1.454.CMB.1.raw
tcagactagcagtacacgaccggtgctcgatttagatcgtctgtgttgggtttgggctgatcaggactcctcagttcatcttctcacaatgaggctccctgctcagctcctggggctgctaatgctctgggtcccaggattcagtggggatgttgtgatgactcagtctccactctccctgcccgtcacccgttggacacgcccggcctccatcctcctgcaggtctagtacaaacgtcctacgtatacactgataggaaccacgtgccgtaggtattggtactcaccgaggccggacctacggcctaatccgtaccgaaggtcctaccttaaatttagttaacggtttaccgaaccgggtactccggtccggggtacccaaggacgtagtacgttaccgaggttcggacgtagggtcgggtacgaacggcctacgtagtacgttacgaaccgtacgtaagaaacgtcgaaggacggtaggggtaggacggtacgtaggtaggtagttaggttaaggtaattttacgtacgtagtacgtagtacggaacgtacggtacgacgtacgtacgttcccggccgttccggttaccgttacgtttacgggaccggtacgggtaccgacggtacgtaggacgtaacgtaccgaaacgtactcggtggtaccg

SEQ ID NO: 55934 - DNA, 972 bp, Homo sapiens
  misc_feature: GYAE6OF01ECR8D.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtgggtcccaggattcgaggtgggggtattgttgtgatcgactcagtcctccactcctcctcgcccgtacctaccgttggaccacggcccggtccctccacttcctcctggacgtacggtccttacgtaccaaacgtcccttacgttactaacctacgtagaacgtaacgggaaaacctaccgtcggtacccgtagggttaactttacggttaacctacccgaaccggaccgggccgggaccccgtaaacgggaccctaaacgtttcccgtacccggaaacgggtacccgttaaccttttaaaagtttttaacggtttaaacgggttttacccgtaaaacccggggttaccttccgggttacccggggtaccctaaaggtaaaccggtaacggttaacttaccggtaagggtcgggtaccggttaacggggttaccgggggttaccgaacgggtcccgtaaacggtttcgggttaaaaccgttaccgtaaccggttaaaaccgttaacggtaaaaaccggttacgaaccgggggtacgggtaacgggggttaaggggtaaccggggtacggttaaggggtaaacgggtttacggtttaaggggttttaaacggttttaaacggttttaacgttttacccgttaggtacgtaacgggttaagggtaaccgtaaggggttaacgtaccgttaacgttaccggtttcccgggtaacccgtttacccgggttccgtttaacccgggtttaccggggaccgggttaaaccggggaacctaacggggttacggtaacgggtaacgtaaccgttaaaccggtaaacggtaagttcgggacggttcgtaccg

SEQ ID NO: 55935 - DNA, 835 bp, Homo sapiens
  misc_feature: GYAE6OF01DVYJE.46.34.D01.1.454.CMB.1.raw
  modified_base (690)..(690): a, c, t, g, unknown or other
  misc_feature (690)..(690): n is a, c, g, or t
tcagactagcagtacacgaccggtgctcgatttagatcgtctgtgttgggtttgggctgatcaggactcctcagttcaccttctcacaatgaggcctccctgctcagctccgtggggctgctatgctcgtcgggtccaggtattcgaggtggggtattggttgtgatgactcacgtcctacctacctcctccctcgcccgtcctaccgtggaccgcggcccgtcctctacttcctccgtagcgtacggttactacgtaaccgaaccgtccttacgtactaaccacgttacggaacgtaaccggaaacctccgtcggtacgttagggtactttaggtacctaccggaccgacgggcccggaccgaaccggaccctaacgtcccgaaccggtaaccgggtaccctttaaacgtttaaaacgtttttaacgggttaaccgggttttaacccggtaaaccccgggttaccgttccgggttaaccgggacccaaaggtaccgtaaggttactttcgggaaggttccggaacgttacggggtacggtacgaacgggttactacggttaacgaccggttaacctaacgaacgttaaacgaacgttaccggagggttaacgggaacggggttacgggacggtaaggtacggggtaaggttaaggttacgggttttaacgtttaaacgtttcgttacgngtaacgtgtaacgacggtaggtaccgacgttacgttcggtccggttacccgtcggttaccgttacgggttacccggacgggtacgggtaacacgggttcggacgtaagaaccgttaacgaacggttagcgggtaaccgctaccgg

SEQ ID NO: 55936 - DNA, 660 bp, Homo sapiens
  misc_feature: GYAE6OF01D4SCW.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacctgacagccgcctccatctcctgcaggtctacgtacaaagcctacgtatacactgatacggaaactaccgtgccgtggatttggtaactccgaccgaggccgggaccacgggacctaaagtcctaccgaacgggcctacctttaaattttacgtaaaggttttacgtaaaccgggacttcgtacgggtacccaagaactagtacttcgaggtcggacgtaggtcgggtacaggtcacgttagacgttacaacgtactaagaaatcgaggacgtagggtaggagtcgtaggaggtagttaggttagtaagttttagttacgtgtacgtaagtacgagtaacgggtgtaccgacgtacgttcggtacccgttaccggtacgtttaccggtttacggaccggtacggggtaaccgaacggtcggtacggtaagtaacgtaacgtaaaacgtacgttacggtgtaccgtaaccg

SEQ ID NO: 55937 - DNA, 696 bp, Homo sapiens
  misc_feature: GYAE6OF01CFEKK.46.34.D01.1.454.CMB.1.raw
  modified_base (259)..(259): a, c, t, g, unknown or other
  misc_feature (259)..(259): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtcctccactctccctgcccgtcacctgacacgccgcctcatctctgctagtctagtacaaacgcctacgtatacatagacgtacggaaaaccncctgccgtaggattaggtactcaccgaggccgaccgacggcctaacgtcctaccgaacggtctacttaaattttaacgttaacggtttccgtaaaccggtctcggtcgggtaccagacagtactcgaggtgcgtaggtcgggtcaaggtcacgtgtacgttacactaacgtaataaactcgaaggacgaggggtaggaggcgtaggaggttagttgtttaaggttaattttagtaccgttagcgtagtacggacgtaacggttcgaccgttaacgttaccggtttcggccccggtttacccggttaccgtttaacccgggtttccgggaaccccgggtaacggggtaaaccccttaagggtacccggttaacggtaaaccgtaaacggtaaaccgtaaaaaccggttacgttacgggttcggtacccgttaaaccgg

SEQ ID NO: 55938 - DNA, 776 bp, Homo sapiens
  misc_feature: GYAE6OF01EABBB.46.34.D01.1.454.CMB.1.raw
tcagactagcagtacacgaccggtgctcgatttagatcgtctgtgttgggtttgggctgatcaggactcctcagttcaccttctcacaatgaggcctccctgctcagctccgtggggctgctaatgctcgtcgggtcccaggattcaggtggggatgttgtgatgactcagtcctccactctcccgtcgcccgtccacccgttggaccacgcccgcctaccactctcctgctaggtcctacgtacaacgtcctacgtataccactgaacgtacggaaacctacctcgcgtaggtattcggtactaccgacgacggaccggccgtaacggaccctaaacgtcccgtaccggaacgggtaccgttaaccttttaaagttttaacggttaaccgggtttaaccggttaaacccgggtcgttaccggtaccggggtacccaaggtacgtaagtacgttcgaggtcggacggtagggtcggggtacaacgggtactacggttacggtaacgttacctaacgaacgttaaacgaaaacgttaccgacggggtaaccggtagggggtacgggtaacggtacggtaagggtaggttaaggtttacgggtttaagggtttaacttttacgttacgtcgtactagtacggtacggtaggtacaccgtattacggtccggtaccgttcgttaccgttacggttaccgggaccggtaacggggtaacaacggtgtaaacgggacgtaaaccgtaaacgtaaaccggttagtcgggtcggacccgtacg

SEQ ID NO: 55939 - DNA, 787 bp, Homo sapiens
  misc_feature: GYAE6OF01CH6FL.46.34.D01.1.454.CMB.1.raw
  modified_base (108)..(108): a, c, t, g, unknown or other
  misc_feature (108)..(108): n is a, c, g, or t
  modified_base (183)..(183): a, c, t, g, unknown or other
  misc_feature (183)..(183): n is a, c, g, or t
  modified_base (560)..(560): a, c, t, g, unknown or other
  misc_feature (560)..(560): n is a, c, g, or t
tcagactagcagtacacgaccggtgctcgatttagatcgtctgtggttgggtttgggctgatcaggactcctcagttccaccttctcacaatgaggcctccctgctcncgtcctccgtggggctgataatggcctcggtcgggtacccaggtcttgagggtgggtattgttggagatcgaccntcgtcctcccactccctcccgtcgtccctaccgtaccgtcgacgtccggcccgtcctcctacgtcctccgtagacgttacgtacgtagaccgtaaacgtcccgtagtactaccgacgaggtaacgtaacgaaccgtaccgcggtcgtaggttagtacgttacaccgaaccgaggacccggacgtaaccggacctaaccgtccgtaaccggaaccgtaccgtttaacgttaaaacgtttttaacgtaaccgggtttaacccgaaccggggtacggttacccggtaccggggtaccaacggataacggttacgtacggtcgacggttcggaggggttacccgagacgtacgtcgtaacgcgttacaacgtaacgttaanaacgacgtaaggtcgggaaaggggtaccgggtaaggtagtagggaaggtttagtttaaccgggttaagtttaacttaagtacgtacgtacgtaaggtacgtacggtacgtacgttaagacggttaccggtaccggtacccggtttccgacggtttcgggtacccggtaccgggaagtaccgtaacgtcggaagtacaacgtaacgtaacgtagtcgacgttcaacgg

SEQ ID NO: 55940 - DNA, 845 bp, Homo sapiens
  misc_feature: GYAE6OF01CUBUT.46.34.D01.1.454.CMB.1.raw
  modified_base (224)..(224): a, c, t, g, unknown or other
  misc_feature (224)..(224): n is a, c, g, or t
tcagactagcagtacacgaccggtgctcgatttagatcgtctgtgttgggtttgggctgatcaggactccctcagttcaccttctcacaatgaggcctccctgctcagcctccgtggggctgctaatgctcgtcgggtcccaggtattcaggtgggattgttgtgatgactcagtcctccactcctcccgtcgcccgtctacccgtgaccacgtcccgcctccncttcctcctgcgtaggtactacgtacaacgtcctacgtataccagttagaacgtaacggaaacctccgttacggtccgttaggtaactttcggtaccaccgaacccgagggcccggaccgtacgtacctaactccctaccggaaacgggtccttaaacctttaagttttaacggtaacggtttacccgtaaaccggcgtttccggtacgggacccaaggtaacctaagttccttaggaaggtcggaccgtagggtacgggtaccgacggacttaggttcggaactttacaaccgttaacgtaacgtaaaagtccgtaagggaccgggttaaggggacggtaacgggtacgttaggggtaacggtttaaggttaaggtttaagttttaaacgttttaacgttaaccgtaggtaaccgtttaggaacggttaaccggttaaggtcccggttaacgtaacggtttacggttacccggttacccgggttttaccccgggttactttacccggggtttacgggaaacccgggttaaaccggggaccgttaacgggtacccggttaagggtaaactaaaccggttaaccggtaaacggtacggttacggtccggtaacgttacccgg

SEQ ID NO: 55941 - DNA, 756 bp, Homo sapiens
  misc_feature: GYAE6OF01BDXVW.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggtattcgaggtgggggtattggttgtgatgactcacgtcctcctacttcctccctcgcccgtcctacccgttggaccacggccccgtccctcctacttcctccgtgtacgtaggttcctaacgtacgaaactccgttacgtaatacctacgtgaacgtacggaaacctccgtagtccgttaggtaagttcggtacaccaccgacggccggaccgtaacggccctaacgtccgtaccgaacggtccttaacctttaagtttaacgttaacggttaccgtaaccgggtcctcgggtacggtaccagaaccgtgtacgttaccgaggtcggtacggtaggtcggtacgacggtacgtcgtacgtacgtacctaactaacgttaaagtaacgtaccggaagggtacgggaggggttaacggggaggtacggtaggggtaacggtttagggttaaggttttaacgggttaaactttttacggtaacgtacggtacgtacggtaacggtacggtacggtacgtacgtacgttacggtccggtccgttcgtaccgttacgtccgggtaacgacggtactaggtacggtagaacgactaacggaacgtagtcggcgtcgtaccg

SEQ ID NO: 55942 - DNA, 985 bp, Homo sapiens
  misc_feature: GYAE6OF01DR0OC.46.34.D01.1.454.CMB.1.raw
tcagactagcagtacacgaccggtgctcgatttagatcgtctgtgttgggtttgggctgatcaggactcctcagttcaccttctcaacaatgaggcctccctgctcagctccgtggggctgactaatgcttcgtcgggtaccaggtacttgagggtgggtattgttggtgatcgacttcgtacgtcctacccgtaccttcccgttcccgttacggtccccgttaccgtaaccccggttgggaacccgaccgggtccccgtcccttccgtacttcccgttccggtacggtacgtacgttacgtaacgtaactaaccggtccttacgtaatacgacgttagaacgtaacggaacctccgtcgtacggttaggtacgttacggtacctaccggaccggaccgggtaccggacccgtaaccggtacccttaacgtacccggtaaccggtaaaccggttaccgttttaaaccgttttaaaagtttttaaccgggtttaaacccgggttaaccccgggtaacccggtaccggttaccgggttacccgggttaaccaacggtaaccgtagttacgtaccggtaggtcgtacggtacggggtacggaccgtacgggtacctacgggttaacgtaccggttaaccctaacgtaaccgtaaaacggtaccgtagggtaacggggtaacggggttaacggggtaccgggtaaaggttacgggtaacgggttagggtttaaggtttaacggttttaacggtttaacgtttacgttaccgtgggttaacgtcggttaacgggtaacggttaacgggttaccgtaacgggttaccgtttaccgggtttccggtaccccggtttacgggtttacccgttaaccggggttccgggaaacgggtaccggtttaaaccgggaccggttaacgggtaacggtaaccgtaaccggttaaacccggtaacgggttaccggtacgggtaccggtttaccgaaccccg

SEQ ID NO: 55943 - DNA, 728 bp, Homo sapiens
  misc_feature: GYAE6OF01D5NHR.46.34.D01.1.454.CMB.1.raw
  modified_base (269)..(269): a, c, t, g, unknown or other
  misc_feature (269)..(269): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctctgggtcccaggattcgaggtgggatgttgtgatgactcagtctccactctccctgcccgtctacccttggacacgcccggcctcctatcctcctgcgtaggtctagacaaacgcctacgtactacacgtgaatacggaaaccnccgtgccgtaggattggtaactccaccgaggcccggccgaacggaccctaacgttccgtacccgaacggtccgtaaccctttaaaagtttttaacgttaacggtttaccggtaaacccgggtacttccggtcggggtaccccaaggaccgtagtactccgaggtacggcgtaggtgggtaccaggtcacgtagtacgttacaacgtactaagaaacgtgaggtacggacgggtaggacggtacgtaggtaacggtagttaggtttaggtttaaacgttttacgttactacggtacgtagtacggtacgtaaggggtcaaccgttaacttacggttcggtacccgtttacccggttaccgttaccggttttacgggaccccggttaaggggaacccgtaggtacggttaggaaccgtaacgtacccgaaacggttaccgtgggttacggtaccgtaccgg

SEQ ID NO: 55944 - DNA, 715 bp, Homo sapiens
  misc_feature: GYAE6OF01AMI3W.46.34.D01.1.454.CMB.1.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (524)..(524): a, c, t, g, unknown or other
  misc_feature (524)..(524): n is a, c, g, or t
tcagactagcagtacacgaccggtgctcgatttagatcgtctgtgttgggtttgggctgatcaggactcctcagttcaccttctcacaatgacggctcctgctcagctccgtgggctgctatgctcgtcggtccaggtattcgaggtgggatggttgtgatgactcagtcctccactcctcctcgccctcctaccgtggaccncggcccgtcctccgtctcctcgngcgtacggtctaacgtacaaacgtcctacgttacacacgtgtaacgtacggaaacctcgtgtaccgtaggtattcggtacaccgaccgcggtaccgggaccaacggtaccctacgttccgaaccgtaacggtcctttacttttaaaagttttacggtaacggtttacccgtaaccgggtcttcgggtaccggtaccaaggacgtacttcggtcgacgggtcggacgtcgggtacgggtcaggtcctagttcgtaaaccttctaacgacttaagagttcgagggacggtagggtacggnggtacgtaggtacggtagtttagtttacgtaacttttacgacgtcgtagaacgttacggtacggtaacgtccgtataacggttccgttccgggtaacccgtttccgttacgttaacccggttcggaccggtaacgggtaccagggtacggtagaacgtttaacgaccgtaacgttgggctcgggtcaaccg

SEQ ID NO: 55945 - DNA, 717 bp, Homo sapiens
  misc_feature: GYAE6OF01AW9H4.46.34.D01.1.454.CMB.1.raw
  modified_base (602)..(602): a, c, t, g, unknown or other
  misc_feature (602)..(602): n is a, c, g, or t
  modified_base (699)..(699): a, c, t, g, unknown or other
  misc_feature (699)..(699): n is a, c, g, or t
tcagactagcagtacacgaccggtgctcgatttagatcgtctgtgttgggtttgggctgatcaggactcctcagttcaccttctcacaatgaggcctccctgctcagcctcctggggctgctaatgctcgtgggtcccaggattcagtgggggattgttgtgatgactcagtctccactctccctgcccgtcacccttggacacgccgcctcatctcctgcaggtctagtacaaacggtcctgtatacactgataggaaccaccttgccgttggacttggtactccgaccgtaacggccggtccgaacggaccctaacgtacccgtaccggaaacggtaccgttaaccctttaaaaatttttaacggttaaacgggttttacccgtaaacccggggtaccgttacggttaccggggtcccgtaaagtaccgaagtacgttacgaacggtcggcgtaagggtcgggtacgacggtactacgttggaacgtttaccacctaacgtaagtaaaacgtgacggtaagtaacgggggtagacgggtcgtacggtaggtagttaggtttagttaagttttaattacgtagtactgtagactagggtcntaacgttcgtcggtacccgttcggtaccgttacggttacggaccggtacggggaccgtaaagggtacgtaaacgtaaccgtaaacgtcggttaacgnggtacctggaacctacgg

SEQ ID NO: 55946 - DNA, 885 bp, Homo sapiens
  misc_feature: GYAE6OF01EJU8K.46.34.D01.1.454.CMB.1.raw
tcagactagcagtacacgaccggtgctcgatttagatcgtctgtgtttgggtttgggctgatcaggactcctcagttcaccttctcacaatgaggctccctgctcagctccgtggggctgctaatgctcgtcgggtcccaggtattcgaggtgggggtattggttgtgatgactcacgtcctccacttcctccctcgccccgtacctaccccgttggaccgacgcccggtcctcctacttcctccgtgcgtacggtacctagaccaaacgtccttacgtaactacactgaacgtaacggaaacctaccgtgtccgttaggtagtttggtacctaccgaccgtaccggcccgggaccgaaccgggtaccctaaacgtttaccccgtaaccggaaaccgggtaccgtttaaccgttttaaaaggttttttaaaccggtttaaacccggggttttttaaccccgggttaaaaccccggggttaccgtttacccgggttacccggggttaaccccaaaggtaaccgtaacggttacgttaccggtaggggttacggtacggttaagggtcgggtaccgagggtacctaaggttacgtaacgttaccgaacttacgtaaacgaaacgtcgaaggtacggtaggggagacggtacggtaggtagggttaagttaggtttaagtttaacgttttacgttacggaccgttagtaagttacgggaacggtaaggttccgaccgttaaaggtttccggttacccggtacccgtttccgggttacccgttttaagggtttacccggaacgggggttaaaccgggaaccgttaagggtccggtaaaaggacgttaaaccgtaaaccggaaacgttaccggttggcggtaccgtaccg

SEQ ID NO: 55947 - DNA, 738 bp, Homo sapiens
  misc_feature: GYAE6OF01AJLFM.46.34.D01.1.454.CMB.1.raw
  modified_base (216)..(216): a, c, t, g, unknown or other
  misc_feature (216)..(216): n is a, c, g, or t
tcagactagcagtacacgaccggtgctcgatttagatcgtctgtgttgggtttggctgatcaggactcctcagttcaccttctcacaatgaggcctccctgctcagctccgtggggctgctaatgctccgtcgggtcccaggtattcgaggtggggattggttgtgatgactcgagttcctcctaccttcctccgtcgcccgtccaccgttggacncgcccgtcctctactcctcctgcgtacgtctacgttacaacgtcctagtactacgtacgtagagtaccgtaaacctcctacgtaccgtaggttacttacggttacacctacccggacggacccggacccgaccggtacctaacttcccgtaccgaacgggtccttaaccgttttaaagttttaccgttaacggtttacccgtaacccggttctccggtcgggtaccaagtaccagtagtcgagttaggcgtagtcggactagtcctgtagtcgttacacgtagtacgaaacgttcgacggtaggtcggggtacggtacggtcggtaaggttacgggttagtttagggttaacggtttaactttacggttttacgcgtacgtagtacgtacccggagtttacgcgtaacgtttcgtcccggtccgttacggtcccgtttagggttacccggaccgggtacggtaacggcgtacgggtaacgtacgtaacgtaaccgtaacggttaaggcggttacgtcctacg

SEQ ID NO: 55948 - DNA, 742 bp, Homo sapiens
  misc_feature: GYAE6OF01CFNGO.46.34.D01.1.454.CMB.1.raw
  modified_base (222)..(222): a, c, t, g, unknown or other
  misc_feature (222)..(222): n is a, c, g, or t
tcagactagcagtacacgaccggtgctcgatttagatcgtctgtgttgggtttgggctgatcaggactcctcagttcaccttctcacaatgagcctccctgctcagcctccgtggggctgctaatgcctcgtcgggtcccaggtacttcgaggtggggattggttgtgatcgactcacgtcctccacctccgtcccttcgcccgtcctacccgttggaaccncggcccggtacctccactccgtcgtcgactacggtctacgtacaacgtcccgtagtactactagtgaacgtacgaacctcgtgcgtaggtacttggactccgacggaacggccgacacggtacacgtcctacgacggtacctactttaagttacgttaacgttccgaacggtctcggtcggaccagaccgtaagtcgtacggaggtcggagtacgggttcgtacgacgacgttacgtaggtacttaaccgacgtaacgtaacgaaacgtcgtaacgggacggtaagggtacggtacggtaggtacggtacggtttaaggttacgggttttaaacgtttaagttttacgttaacggtcgtacgttaggtacggtaacgtacggtactacgtacgttaccggttaccgtaccggttccggttccgttacgggtttccgggaaccggtacgggtaacgtaacggtcggtaacggtacgttaaccgtaaacggtaaccgtaccggtaggtaccggtcgtaaccg

SEQ ID NO: 55949 - DNA, 722 bp, Homo sapiens
  misc_feature: GYAE6OF01CPJUV.46.34.D01.1.454.CMB.1.raw
  modified_base (182)..(182): a, c, t, g, unknown or other
  misc_feature (182)..(182): n is a, c, g, or t
  modified_base (519)..(519): a, c, t, g, unknown or other
  misc_feature (519)..(519): n is a, c, g, or t
  modified_base (581)..(581): a, c, t, g, unknown or other
  misc_feature (581)..(581): n is a, c, g, or t
tcagactagcagtacacgaccggtgctcgatttagatcgtctgtgttgggtttgggctgatcaggactcctcagttcaccttctcacaatgagctccctgctcagctccgtgggctgctatgctcgtcggtcccaggtacttgaggtgggtattggttgtagatcgactctacgtcctaccnctccgtccctcgcccgtactaccgtagacacggccgtcctcctactccgtcctagacgtacgtactacgtaacgaacgtcctagtataccagtagaactaacggaacacgtagcgtagtagttgtacacgacgacggccgaccgaacggcctaaacgccgtaaccgaacggtacctaacgtttaaagtttaacgtaacggttaccgtaaccggtcgttcggtacgggtacccaagtaaccgtagtacgttcgaggtcgtacggtaggtcggtacgaacgtactacgtacgtacgttaaccaacgtaacgtaaaggaactcgaacggaggttaacggngggaacggtagtaagggtaaggttagttacggttaagtttaaacgtttagtacgttacgaanaggtaacgtacggaaaggtcgtaacctaagttccggtacggtacccgttcggtacgttaaccggttacggaaccgggtaacgggactaagggtctaacggggaaacttacgaaacgaacggttatcgggtcgtacgtaccc

SEQ ID NO: 55950 - DNA, 802 bp, Homo sapiens
  misc_feature: GYAE6OF01ANRSI.46.34.D01.1.454.CMB.1.raw
  modified_base (687)..(687): a, c, t, g, unknown or other
  misc_feature (687)..(687): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctctgggtcccaggattcgaggtgggggattggttgtgatgactcagtctccacctcctccctcgcccgtcctacccttggacacgcccggcctaccatcctcctgcgaggtctacgtacaaacgtcctacgtactacacgtgaactacggaaaacctcctaggccgtggtagttcggtactaccaccgacggccggccgacggaccaactccgtaccgaacggtccgtaaccttttaaagttttaacgttaaccgggttttaaccgtaacccggggttaccgttccgggttaccggggttaccccaaggtaaccgtaagttacgttcgtagggttcggacgttagggtacgggttaccgacgggtacctacgtcggtaacgttccgaaacgtacgtaaagtaaacgtcgtacgggacgggttaagggggtacgaccgggttagtacgggtaagggtttagttacggtttaaggttaacttttcgttaacgtcgtacgtaagttacggtaacgaacgggttcaacgttaccggtacgggtttcccgtcccgttaccgggttnttacccgggtttcggggaccggtaaccggggtaacgtaaccggttcggtaacggggtaaccttaacggtaaaacccggtaaacgtaagggtttcgggtaccgtcggtaaacccgg

SEQ ID NO: 55951 - DNA, 837 bp, Homo sapiens
  misc_feature: GYAE6OF01B43WZ.46.34.D01.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (760)..(760): a, c, t, g, unknown or other
  misc_feature (760)..(760): n is a, c, g, or t
tcagactagcagtacacgaccggtgctcgatttagatcgtctgtgttgggtttgggctgatcaggactcctcagttcaccttctcacaatgagcctccctgctcagctccgtgggctgactaatgctcgtcggtaccaggtatcgaggtgggtattgttgtgatgactcgactcctccactcctccctcgcccgtcctaccgtgacncgccgcctcnctctcngcgtgtactacgtacaacgtcctacgtactacacgtagacgtaacgtaaccgcgtcgtacgttggtagtttacgaactccgaccgacggccgtaccgacggacctaaccgtccgaaccggtaacgtccgtttaaaccgtttaaagttttaaccggtttaaccggtttaacccggttaacgggtacccggtttaccgggtaccggtaacccgaacggtacgtaacggttacgtaccgtaggttacgggacggttacgggtacggggtaccgcgggtaacgtacgtaccgttacgtaaccgtaaccgtaaagtaaacgtaaacgttaccgggacggggaaggggttaagggggttaaccgggtaacgggtagggtaacgggttaaggggttttaacggtttaaacgggtttttagttttaaaacgtttccggttaaaggttacggtaacgttcggtaagggttaccggtaaagtcccgtaacggtacttacgggttccggttaaccttcccgggttaacggtttcgggttaaacccggngggttaccggtaggaacggtcgggttaacggaaacgttaacgaaacgttaaccggtaggttacgtagtaccggtccg

SEQ ID NO: 55952 - DNA, 812 bp, Homo sapiens
  misc_feature: GYAE6OF01A8IQ6.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctcgtatacactgatggaaacacctgcctggattggtatcaccagccggaccacggaccctaatcctaccgaaacggtccgtaccttaaactttttaacgtaacgggttttaccgtaaacccggggtaccttaccggttacggggggttacccctaacggtaacctaacggtaacgtttacccgtaagggtttcgggaccgtacgggtttagggggttacccgacggggtaccgttaaccgttacgggtaacggttttacccaaaccgtaacgtttaacggaaaaaaccgttcccgtaaacgggaccggtaacggggggttagggaacggggtaccgttacgggtaagggtaacggttaggttaggttaaagtttttacgttacgtacgaccgttaagttacggtaccgttaaaggggttccgaccgtaacgttaacggtttccggtaccccgttcccgggttaccgtttaccggttttaccggggaccccgggttaacgggggaccccttaaagggtccggtaacggggtaacgtaacgtaaccgtaaaaccggtacgttcgggtagggtacctaccggg

SEQ ID NO: 55953 - DNA, 663 bp, Homo sapiens
  misc_feature: GYAE6OF01CRL7B.46.34.D01.1.454.CMB.1.raw
  modified_base (448)..(448): a, c, t, g, unknown or other
  misc_feature (448)..(448): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggtattcgaggtgggggattgttgtgatgactcagtcctccacctcctccctcgccccgtcctacccgttggaccacggcccggtcctccacttcctccgtgctaggtactagtacaaacgtcctagtactaccactgacaacggaaaccacctgaccgttggacgtttggactccacgacggcggaccgacgaccaatccgtacgaacggtccgtacttaaagttttacgtaacgggtttccgaaccgggtaccttcggtccgggacccaagaccgtagtacttcgaggtggacgtacggttgggacnggtacacgttgtacgtacaacgtacgtacgtaaactcgagtacggagggtaggtacggcgtggtaaggttagttaggttagttaactttagtactagtacgtagtagacgtaaggtcgtagtacgtacgttcgtccgtaccgttcgtaccggttcggaccggtaacggacgtaggtcgacggagtacgtaacgaacgtacgtaggtcgtgtaccg

SEQ ID NO: 55954 - DNA, 886 bp, Homo sapiens
  misc_feature: GYAE6OF01ETUES.46.34.D01.1.454.CMB.1.raw
tcagactagcagtacacgaccggtgctcgatttagatcgtctgtgtttgggtttgggctgatcaggactcctctagttcaccttctcacaatgaggcctccctgctcagctccgtgggctgctaatgctcgtcgggtaccaggtattcgaggtggggtattggttgtgagtactactcgtagtcctaccaccttcctcctcgcccgttacctacccgtttgaccgaccggcccggtacccttacctattccctccttaggaccgtacggttaccttaaccgacgtaaaccgtccgtttaacgttaacaccgtaagttcgaacgtaaaccggtaaccctaccggtgtacccggttaggtacttaggtaccaccgtaacgacggccgaccgtaaggtaccctacgtacccgtaaccgaaccggttacctttaacccgtttttaaaaggttttaacggtaaaacggttttaccccggaaaccggggtttacccgttacggggttaccccgggtaaaccgtacgtaccggttaaagttaccggtaaccgtagtcgggaccggttacgggttcgggtaaaccgcgggtaacttacgggttaacgtaccgttaacgaaccccgttaaacggtaaactaaacggtcgaaacgggtagggtaaccggggtaaggaaccggttagtacgggaaacggtttaagtttacgggttaaagttaactttacgtttacgacggtaagtagtagggaccttaggtaccaatttaccggtacgtttaccgggtcccgttaacggttttcccgtacgggaacgggttacccgaaggggttaccagggttccttaaagggacccttaaataacccggtaagaccggttcgggataccgtaccgg

SEQ ID NO: 55955 - DNA, 731 bp, Homo sapiens
  misc_feature: GYAE6OF01DH9JB.46.34.D01.1.454.CMB.1.raw
  modified_base (483)..(483): a, c, t, g, unknown or other
  misc_feature (483)..(483): n is a, c, g, or t
tcagactagcagtacacgaccggtgctcgatttagatcgtctgtgttgggtttgggctgatcaggactcctcagttcaccttctcacaatgaggcctccctgctcagctcgtgggctgctaatgctcgtcgggtccaggtattcgaggtggggattggtgtgatcgactctacgtcctcctacttccgtcccgtcgtaccccgtccgtacccgttaggaaccgccggtcccggtaccctccgtacttcctcgtcgacgtaggtctaacgtacgtaacgtccgttacgtaactaccacgtagtaacgtaaccggaaacctccgtaggtccgtaggttacgttacggtacaccgaaccgacgggacccggaccgacgaccctaacgtccgtacggaacgtaccttaacgtttaaaagtttaacggtaccggttaccggtaaccggtcgttcggtacgggtaccaagtacgtaacgtcgttacggngtacggacgtggtcggacaggtctacggtagtacgtacaacaacgtaacgtaagcgaacggtcgggagggtcggaggtagtaacggaggttagttaggtttaacgttaatttcgtaacgtgaaccgtggtacgacgtagggtcaacgttcgttacggtacgtccggttaccgttagttaccggtacgtaccgggaacgtagtcggacgtaacgtaagaaccctaacggtacggtagtcggcgtcgtac

SEQ ID NO: 55956 - DNA, 890 bp, Homo sapiens
  misc_feature: GYAE6OF01C0HIZ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcgaggtggggatgttgtgatgactcagtcctccactctccctcgcccgtcaccttggacagccgcctcactcctctgcgagtctacgtacaaacgcctacgtatacactagagtaacggaaacctaccgtcgtccgttaggtaacgtttggtaactccgaaccgtaggaccgggtaccgaacgggtacccaacgttccgtaacccggaaacgggtaccgttaaccttttaaaacgtttttaacgtttaaaccggggttttacccgtaaaacccgggggtacccttacgggttccggggtaccccgtaaggaacctaaggttacgtttccgtaagggtcgggtacgggtagggttcggggtaccggtacgggtaccgtaaccggtttacggaacgttttacccgaaaccgttaaccgttaaacggtaaaaacttaccggaacggggtaacggggtaaccgggggttaggggtaaccggggtaccggtaagggttaaggggttaaggtttagggtttaagggttaaacttttttaacgttaacggttacgtacgttacggtaacggtacggttaaacgggttcgaccggtaaacgtttccgtttccgggtaccccggttttaccgggttaccgttaacccgggttttacgggaccccgggtaaacgggggtaacctaccgggtaccggttagggtaaccgtacgttaaaccggtaaaccggttaacgttacgggtcggtaacccggtacgg

SEQ ID NO: 55957 - DNA, 585 bp, Homo sapiens
  misc_feature: GYAE6OF01C3GSJ.46.34.D01.1.454.CMB.1.raw
  modified_base (83)..(83): a, c, t, g, unknown or other
  misc_feature (83)..(83): n is a, c, g, or t
  modified_base (142)..(142): a, c, t, g, unknown or other
  misc_feature (142)..(142): n is a, c, g, or t
  modified_base (167)..(167): a, c, t, g, unknown or other
  misc_feature (167)..(167): n is a, c, g, or t
  modified_base (217)..(217): a, c, t, g, unknown or other
  misc_feature (217)..(217): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (399)..(399): a, c, t, g, unknown or other
  misc_feature (399)..(399): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
tcagactagcagtacacgaccggtgctcgatttagatcgtctgtgttgggtttggctgatcaggactcctcagttcaccttcncacaatgaggctccctgctcagctcctggggctgctaatgctctcgggtccaggattgngtggggatggtttgagatagctcgngtctccactcctccctcgccccgtacacccgttggaccacgcccgcctcnctcctcgtacgacaggtcctaagctaaacgtcctacgtataccatganacggaaacnctgctagatgtacncaccgngccggacacgacactacaccgaaggtctaacttagttaacgtaacggttaccgtaacggctcgtcgggaccctagacgacgtatcgagtgacgagtcggtcaggnataggactacacgaacataactcgaagngtagggngaagcgtagtaggtagttagtagttaagtttgtagtacgtacgagtgacgtaagtcgacgacgttattccggaccttacgtacgtaccggttcggaacggacggaacacggtacaggtaacacgtaaaccaacgtagaggcgttcgaaccg

SEQ ID NO: 55958 - DNA, 715 bp, Homo sapiens
  misc_feature: GYAE6OF01DHZHI.46.34.D01.1.454.CMB.1.raw
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
tcagactagcagtacacgaccggtgctcgatttagatcgtctgtgttgggttgggctgatcaggactcctcagttcaccttctcacaatgaggctccctgctcagctccgtggggctgctaatgctcgtcggggtcccaggtacttcgagggtggggtattggttgtgatgactcagtcctccactcctccctcgcccgtctacccttggacacgcccgcctccatcctcctagctaggtctagtacaaacgtcctgtaactacacgtagagtaacggaaaccnccgtgaccgtggtattggtacncgaccgcggccggaccacggacctaacgtccgaccgaaacggtccttaacctttaaagtttaacgttaacgggtttaccgtaacccgggtctcggtaccgggtacccaaggtactacgtagttaccgaggttggaccgtaggtcggtacgaggacctacgtagtaaccgttctaacgtacgtaacgtaaacgtacgacggacggtaggggtacggtacggcgtaaggtaggttaggttaaggttagtttaacgttttacgttacgtgtaaccgtagtaggtacggtaaggtcgacgttacgtacgttccggtcccgttaccgttacgtaccggtttacgggaccggtaacgggacgtacggtcggtaacgtacgaacgtaacgaaacgtaggttacggcggtacgtacg

SEQ ID NO: 55959 - DNA, 701 bp, Homo sapiens
  misc_feature: GYAE6OF01BLDYR.46.34.D01.1.454.CMB.1.raw
  modified_base (165)..(165): a, c, t, g, unknown or other
  misc_feature (165)..(165): n is a, c, g, or t
  modified_base (181)..(181): a, c, t, g, unknown or other
  misc_feature (181)..(181): n is a, c, g, or t
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcagtggggatgttgtgatgactnagtctccactctcccngcccgtcaccttggacacggcccgcctccatctcctgcagtctacgtacaaagtcctacgtanacactgaatacggaaaccncgtacgccgtgtattcggtaactccaaccgacggcccggtacgacggtacctaacgtccgtaccgaacgggtcccttaacttaagtttaacgttacgggttttaaccgtaacccgggacgttaccggttaccgggtaccaaggtactaaggtacttccgtaggtcggactagggttcgtagaggacctacgtgtagttacaactaacgtagaaacttcgaaaggtcggtaaggggtcgggaaggtccgtagggtaaggtagtttagggtttaaggtaaccttttaggtaactcggtaactaggtacggtaacggtaagtaccggttacaacggttaccggttaccgaccggtttccgttacgttaccggttcgggtaccgggtaacgtaccgaggtagtacgagtaacgtaaccgaacggtactcggtacgcgtaccg

SEQ ID NO: 55960 - DNA, 689 bp, Homo sapiens
  misc_feature: GYAE6OF01C8AT6.46.34.D01.1.454.CMB.1.raw
  modified_base (679)..(679): a, c, t, g, unknown or other
  misc_feature (679)..(679): n is a, c, g, or t
tcagactagcagtacacgaccggtgctcgatttagatcgtctgtgttgggtttgggctgatcaggactcctcagttcaccttctcacaatgagcctcctgctcagcctccgtggggctgctaatgctcgtcgggtcccaggtattcgaggtggggtatggttgtgtagtgactctatcctaccctctcctcccgtcgcccgtcctaccgtggacaccggcccgtcctcactccgtcctgctaggtctacgtacaacgtcctagtacaccatagataacggaaacctcgtcgcgtaggattgtaactcgaccaggtccgacgacgaccaacgtccgaccgaaggtccgtaactttaaagtttaagttaaccggtttacgaaaccgggtccgttcggtaccgggtaccaacgtacgtattacgtcgaggtcggtggaggtccggtagacggtcagtttacggaattcgaactaacgtaacgtaaactagtacgggaggtcggggttagaggtcggtaagggtaggttaagtttcggttaagtttaaattttcgtattagcctaggtaactaggtaagtcaccgttagttccgtcggtcccttcgtttccgccggtttacgttcggaaccggtaacgggaactggtacgtaaggaccgtaactaaaccggtaaagttaccgngttgggtacc

SEQ ID NO: 55961 - DNA, 855 bp, Homo sapiens
  misc_feature: GYAE6OF01EJM9X.46.34.D01.1.454.CMB.1.raw
  modified_base (208)..(208): a, c, t, g, unknown or other
  misc_feature (208)..(208): n is a, c, g, or t
tcagactagcagtacacgaccggtgctcgatttagatcgtctgtgttgggtttgggctgatcaggactcctcagttcaccttctcacaatgaggctcctgctcagctccgtggggctgctaatgctcgtcgggtcccaggtattcgaggtggggtatggttgtgatgactcagtcctccactcctccctcgcccgtcaccgttggacncggcccgcctccactcctcctgacgtaggtacttaggtaccaacgtccgttacgtaacacgtactaggaagtaaccggaaacctcccgtaggtccgtttagggtactttaggtaccaccgacccggaggtcccggaccgacggtaccctaaacgtccgaccggtaacgggtacccttaaccttttaaaagttttaaccggttaaacgggttttacccgtaaacccggggttacgttccgggtaccggggtaccctaaggacgtagtacttcggaaggttcggacggtacggtcggacgacggtcctaagtcggtaactaaccgacttaacggtaacgtaaacgccggtaaggtacggggtaaggggtacgggtacgggtagttacgggtaaaggtttagttaacgggttttaagtttaacgtttttaacgtaccttacgggtaacgtacggttaacggtaaacggtaccgggttaacggacccgttaaacggttccgggttacccgggttaccccggtttacgggtttaccgtttaccgggggtttaacgggaaccccggtaggggggtaaaccctggttaacgggtaacggaaccgtaaacgtaacggttaaaaccggttgggtttacgggaccgtcgtacccggg

SEQ ID NO: 55962 - DNA, 772 bp, Homo sapiens
  misc_feature: GYAE6OF01A27QZ.46.34.D01.1.454.CMB.1.raw
  modified_base (207)..(207): a, c, t, g, unknown or other
  misc_feature (207)..(207): n is a, c, g, or t
tcagactagcagtacacgaccggtgctcgatttagatcgtctgtgttgggtttgggctgatcaggactcctcagttcaccttctcacaatgaggctccctgctcgagctcctggggctgctaatgctcgtcgggtcccaggattcgaggtggggatgttgtgatgactcagtcctccactcctccctcgcccgtcacccgttggacncgcccgctcatctcctgctagtctagtacaacgtcctagtatacactgacgtacgaaacctccgtgccgtaggtagttggtaactccgaccgacggccggccgacggtaccctaacgtaccgtaccggaacgggtcctaacctttaacgtttaacgtttaacgggttttacccggtaacccgggtaccttccgggtaccggggtaccctaacggacgtaggtacttaccgtaggtcggtaccggtagggttcggggtaccgtacgggtactacgttacggtacgttaaccgaaccgtaacgttaaacgtaaaacgttcggaacgggtacgggtaacgggggttacgggaacggttacggttagggtaacgggtttagttaagggtttacggttaacttttaacgttacgtacgtaacgtagttacggaacggtaacgttgaccttacgtacgttccgggccgtttaccgggtcgtttacggttaccgggaccggtacgggtaaccagggtccgtacgggagttaacccgtaacgtaaaccggttacgtcggttagccgttaacgg

SEQ ID NO: 55963 - DNA, 767 bp, Homo sapiens
  misc_feature: GYAE6OF01DJQRW.46.34.D01.1.454.CMB.1.raw
  modified_base (160)..(160): a, c, t, g, unknown or other
  misc_feature (160)..(160): n is a, c, g, or t
  modified_base (214)..(214): a, c, t, g, unknown or other
  misc_feature (214)..(214): n is a, c, g, or t
  modified_base (492)..(492): a, c, t, g, unknown or other
  misc_feature (492)..(492): n is a, c, g, or t
  modified_base (530)..(530): a, c, t, g, unknown or other
  misc_feature (530)..(530): n is a, c, g, or t
  modified_base (748)..(748): a, c, t, g, unknown or other
  misc_feature (748)..(748): n is a, c, g, or t
tcagactagcagtacacgaccggtgctcgatttagatcgtctgtgttgggtttgggctgatcgaggctcctcagttccaccttctcacaatgacggcctccctgcctcagccttccgtgggctagactatgctcgtcgggtccagtcttcgaggtgggtntggttgtcgatgcctcacgtcctcacttcctccctcgccctctaccgtggaccnccggccctctacctctccgtccgttacgcgttacgttactacgtaccgaacgtcccctttagtaaccttcgaacgttacggtaagtaaccggtaaccctccgtcgtacgttggtactttacggacaccgtaccgccggtaccggtacacggtacctaacgtccaaccggaccggtactttaacgttaagtttaccggtacgttaccggaaccgttcgtcgggtaccggaaccgtacgtagacgttcgttacggacgtcggtacgtcggtcgtacccgngggtacccttgtacggtaacctctaacgtaaccgttanaacgtcgaggggtacgtaggagttagtcgaagttgtagtttagtttaacgtactttacgacttggcgttaacggtcgaaacggtccgttaaccgactacgggttacctttcccggacccgtttaccggtttacgtacccgggtttcccgaaacggggttaaccttaccggggttaacggcgtttaaaccgcccgttaaacgttaaccggaagttacgnggtcccgtaggtacccccg

SEQ ID NO: 55964 - DNA, 832 bp, Homo sapiens
  misc_feature: GYAE6OF01C78PW.46.34.D01.1.454.CMB.1.raw
tcagactagcagtacacgaccggtgctcgatttagatcgtctgtgttgggtttgggctgatcaggactcctcagttcaccttctcacaatgagctccctgctcagctccgtggggctgctaatgctcgtcgggtcccaggtattcgaggtgggggtattggttgtgatgactcagtcctccactcctccctcgccccgtcctacccgttggaccacggcccgcctccacttcctcctgcgtacggtctacgtaccaaacgtcctacgtataccacgtagaacgtacggaaaacctaccgtcggtacccgttaggtacgtttacggtaacctaccgaacccgacggcccggaccgaaccggtaccctaaacgttcccgtaacccggaacggtccttaaacccgttttaaagtttttaaacggtttaaaccgggtttaacccggtaaacccggggtaccgtttccgggtaccggggtacccaagtacgtaagtacgttcggaggtggacgtagggtcggcgtacggtctacgtaggtacttacaaccgtaacgtaagaaaacttcggaacggtacgggtaggggtagggacggtacggtagggtaaggttacggtttaggtttaacggttttaaacgtttttaacgttacggttaccgtaggtaacgttacgggaacggttaacgggtccgtaacgttaacgtacggtttacccggtcccggtttaccggttaccgttaccgggtttcgggaacccgggtaacgggtaccgaacgggttcgtaagggtaacgtaacgtaaccggtaaacggtacgttcgggtacgtcgtacccg

SEQ ID NO: 55965 - DNA, 740 bp, Homo sapiens
  misc_feature: GYAE6OF01CECPA.46.34.D01.1.454.CMB.1.raw
  modified_base (170)..(170): a, c, t, g, unknown or other
  misc_feature (170)..(170): n is a, c, g, or t
  modified_base (516)..(516): a, c, t, g, unknown or other
  misc_feature (516)..(516): n is a, c, g, or t
  modified_base (736)..(736): a, c, t, g, unknown or other
  misc_feature (736)..(736): n is a, c, g, or t
tcagactagcagtacacgaccggtgctcgatttagatcgtctgtgttgggtttgggctgatcaggactcctcagttcaccttctcacaatgaggctcctgctcagctccgtggggctgctatgctcgtcgggtcccaggtattcgaggtggggtattgttgtgatgactnacgtctcctactcctccgtcgcccgtactaccgtcggacgacggcccgcctccgtactcctcgtcgtaccgtaggttctaacgtacgaaacgtccttacgtactaaccgtacgttaggaacgttaaacggaaacccgtccttacggtccgttaggttacgttcgggtaaccaccgaaccggacggccgggaccgaacggtaacctaacgtcccgtaacgtaaccgggtaccttacttttaaaagttttaacggtttaaaccggttaccggtaaaccgggtcgttaccgggtaccgggtaacccagtaaccgtagtacgttcgtacgggttgacggtggtaccgggngtacggtacctacgtaggtacttaccaaccgtaagtaacgtaaacgtcgaaacggtcgggtagggtacggacggtaggtaagtaggttaggttagttaagttactttagttacgtagtatagtacgacggtacgtgaacgtcgtagtccgtccgttcgttacgttaccggttggaccggtacgaagagtcgtacgatacgtaaacgacgtagtggacgtntacg

SEQ ID NO: 55966 - DNA, 758 bp, Homo sapiens
  misc_feature: GYAE6OF01EW5K6.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcgaggtggggatggttgtgatgactcagtcctccactctccctcgcccgtcctacccgttggaccgacggcccggtccctacctacttcctccgtagccgtacggttaccttaacggtacaaaccggtcccgttacgttaactaaccgtacttaggaaacgtaacgggtaaaacccaccgttcggtaccgttaggtacgtttaggttaacctaccgaaccgtacggacccggaccgaaccggacctaacgtccgtaccgtaacggaccgttaacctttaaagttttaacgttaacgggtttaccggtaacccggtacgttacggtcgggtaccaagtactagtactacgaggtcggacgtaggtggtaccgaggtactacgtcgtacgtacaacgtaacgtaagaacgtcgtaaggacggtaggggtacggtacggtaggtacggtaggttacgttaggtttaggtttaatttaagtacgtagtacgtacgtagtaacggtagtacgtactaacgtggttaccggtccgttaccggttagttaccggttccggaacggtacggtaaccgtaggtcgtaagggactaaacgtaacgaaccgttagtcgtcgccgtacg

SEQ ID NO: 55967 - DNA, 749 bp, Homo sapiens
  misc_feature: GYAE6OF01BAQFK.46.34.D01.1.454.CMB.1.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
tcagactagcagtacacgaccggtgctcgatttagatcgtctgtgttgggtttggctgatcaggactcctcagttcaccttctcacaatgaggctccctgctcagctccgtggggctgactaatcgctcgtcgggtcccaggattcgaggtgggatgtgtgatgactcagtctccactctccctgccctcaccgtgacncgccgcctcactctcagccgtagtctagtacaacgtcctacgtatactacgtagagtacggaaactcccgtgtaccgttggtaacgtttggaacnccgaaccggtacggacccggtacccgaaccggacccctaaacgtccccgtaaccggaacgggtccctttaaaccgttttaaaagttttaacggtttaaaccgggtttacccggtaaccggtaccgttcggtaccgggtaccaagtacgtaaggtacttaccgaagggttcggacgtaggggttacggacgacgggtcctacgtaggttaccgtaacgaacctaagtaagaaacgtcgaaggtacggtagggtcgggacgtacgtagggaaggttagtacggtttaattaacgtttacgacgttacgacgttagtacggtaacgagggtactacgttacgtaccggttcgtaccggttaccgttgttaacccggttacggaaccgggtacgtaaacgacgggttctaacggggtaaacacccgttaaaggacccgtaggttcgcggtctaaaccgg

SEQ ID NO: 55968 - DNA, 887 bp, Homo sapiens
  misc_feature: GYAE6OF01CQMSA.46.34.D01.1.454.CMB.1.raw
  modified_base (244)..(244): a, c, t, g, unknown or other
  misc_feature (244)..(244): n is a, c, g, or t
  modified_base (845)..(845): a, c, t, g, unknown or other
  misc_feature (845)..(845): n is a, c, g, or t
tcagactagcagtacacgaccggtgctcgatttagatcgtctgtgttgggttgggctgatcaggactcctcagttcaccttctcacaatgaggcctccctgctcagcctccgtggggctgctaatgctcgtacggtccaggtattcgaggtgggattggttgtagattcgactactacgtccctaccctaccttcccgtcccgttccggaccccccgttaccgtaaccccgttcgggaaacccnccgggtcccccgtccttaaccaacgtttccctccgtacgtacgtacgggttaactaacggtaacgtaaaccggtcccttaacgttaactaccgtaacgttagaaccgttaacggaaaccctacgtccggccgttagtacgtttaggtaaccaccaccggacggcccggaccgaccggtaaccctacttacccggtaccgtaacgggtacccttaactttaaacgttttaaacgttaacccgggttaccgttaacccgggtacgttacccggtacggggtacccaaggtacctaagtgttacggaacgttggggaacgtgggtggtacccaggggtacctagttacggtacgttaacaccgtaaagtaaacgaacgtaccggtaaggaccgggtagggtaacggtaacggtggaagggtagggtttaacgtttacggtttaaggtttaattttcccgggttaaatggtaaccttaggtaaccggttaaggttacggaccgtacgttacggttacggtcccggttaccctttacccgggttaacgttcggggtaaccgtaccgggaaacggttggtaacccggtaaggttcggaaacccgttntaaaacgggttaacgacgggtttcggcccgtgttaaccccgg

SEQ ID NO: 55969 - DNA, 691 bp, Homo sapiens
  misc_feature: GYAE6OF01C8T8A.46.34.D01.1.454.CMB.1.raw
  modified_base (225)..(225): a, c, t, g, unknown or other
  misc_feature (225)..(225): n is a, c, g, or t
  modified_base (268)..(268): a, c, t, g, unknown or other
  misc_feature (268)..(268): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcgaggtggggatgttgtgatgactcagtcctccactcctccctcgcccgtcaccttggacacgcccgcctccatcctctgcgnggtacagtacaaacgtcctacgtatacatgatacggaaaaccncctgccgttggacttggtactcacccgaggccggaccaggaccaatccgaccgaagccgtaacttaatttagtaacggtttaccgaaccgggtacttccggtacgggtacccaaggtacagtacttcgaggtggacgaggtacgggcgaggcctagtacgggactttacaacgtaccgtaagtaaacgtcgtaacgggacggtagggtagggaacggtcgtagggtaggtagttacggtttagttaacgttttaataccggttgacgtaggttcggaacgtaggtcgacgtacgtaacgttccgggtaaccggttcccggttacgttaccggtttcgggaacccgggtacggggtaaccctaggtcccgttagggacgtaaacgtaaaccgaaacggttaaccgtcgggtggtcgtaacccgg

SEQ ID NO: 55970 - DNA, 847 bp, Homo sapiens
  misc_feature: GYAE6OF01BA8NN.46.34.D01.1.454.CMB.1.raw
  modified_base (475)..(475): a, c, t, g, unknown or other
  misc_feature (475)..(475): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
tcagactagcagtacacgaccggtgctcgatttagatcgtctgtgttgggtttgggctgatcaggactcctcagttcaccttctcacaatgaggcctccctgctcagctccgtggggctgctaatgctctcgggtcccaggtattcgaggtgggggatgttggtgatcgactcagtcctccacctcctcccgtcgcccgtcctacccgttcggacacggcccggtccctccctacgttcctccgtagccgtacggttctacggtaaccaaacggtccctacgtactaaccgactagagtacggaaacctccgtcgaccgttaggtatttcggtaactccaccgacggtcccggacgtaacggttaccgaactacctaccggaacggtccgtaacctttaaatttaacggttaacgggtttaaccgtaaccgggtaccgttacggtcccgggtaccaaggactacgttactacggngtggacgtgtagggtaccaggccagttgacgtacgactaanaacgtaacncggaagacggtaggggtacggacgacggtagggaaacggtagtttacgggttaacgtttaaagttttacgttaacgtcctaagtaacgggtaacggtaacggttacgggtaacgtaacccgtaacgggtttaccggggtttaccggaaacccccgggttttccggtttaccgttttaaccgggttacccggggaacccgggtttaaaccgggggaacccggttaaaccgggttaccgggtaaaaggggtaaaccccgtaaagggtttaaaaacccaaacccgggggttaccgttgggtacccgggttaccgttaaccccggg

SEQ ID NO: 55971 - DNA, 732 bp, Homo sapiens
  misc_feature: GYAE6OF01CNU42.46.34.D01.1.454.CMB.1.raw
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
tcagactagcagtacacgaccggtgctcgatttagatcgtctgtgttgggtttgggctgatcaggactcctcagttcaccttctcacaatgaggctcctgctcagctccgtggggctgctaatgctcgtcgggtcccaggtattcgaggtgggggattgttgtgatgactcagtcctccacctcctccctcgcccgtaccaccgttggaccacgcccggctccactcctcctgcgacggtctacgacaaacgtcccttagtactaccacgtgtaacgtacggaaacctcccgtcggcgttagggtaactttcggaactacccgacgtaacggcccggtaccgtaaaccggctaactccgtaaccgaacgggtccttaaccgtttaaagttttaaacggtaaccggttttaccggaaccggggtcttccggggtacggaccctaagaccgtacgtgttacgaggtcgacgagggttcgacgtagcgtaccgngtactacgaactacgaataacngacggtacggaggtgaaggcgtaggaggttatacggttaatttaacgtttacgtaacgtgacgtaacgtacggtacgtaggttcgaccgttagttacccggttacggttacccgtcggttaccttaaccgggttcggaacccgggtaccggtaacgtaacggtccggtacggaaacggtaaccgtaaacggtaaacgtaacggttcgacgtcgtacccg

SEQ ID NO: 55972 - DNA, 909 bp, Homo sapiens
  misc_feature: GYAE6OF01B82HW.46.34.D01.1.454.CMB.1.raw
  modified_base (196)..(196): a, c, t, g, unknown or other
  misc_feature (196)..(196): n is a, c, g, or t
tcagactagcagtacacgaccggtgctcgatttagatcgtctgtgttgggtttgggctgatcaggactcctcagttcaccttctcacaatgacggcctccctgctcagtctccgtggggctgactaatcgctcgtcgggtcccaggtacttcgagggttgggtattggttgtagagttcgtactcagtcctacccncttcctccctcgccccgtctaccgttgacgcgcccgtcctccattccgtctgacgtagtactacgtacgaacgtccgtacgtatactacgtacgtaagacggtaaactcccggttgaccgttaggttacgttacggtacctacccgaaccgtcgggacccggtaccgaccgtaccgtacctttacccgaccggaaacggttcccgtttaaacgtttttaacggttttaaaccgtttaaccgggttttacccgtaaacccggggttaccgttcccgggttacccggggtaaacccgtacgaaacccgtttaaggggttacccttacggggttacggtaaaccgggtcgggttaacgggttccggggttaaccaacccggggttacttaccggttacgggtaaccctttacccgtaaccggtaacgttaaaaccggttaacgtaaccgggacggtacccggggttaaagggtcgggggtaaccgtgggttacggaagggtttaacggtttacgttaaacggttttacgtttaacgtacggttaccggtacgttacggtaggtaccggttaacgggttcaaccggttaagtccgggtccgtttacccggtacgtttcggttaacccggttcggacccgggttaacggacgtaacggtttccggaacgttacccggtaagtaaccccgtaagggttcctacggtggtaacccgtacg

SEQ ID NO: 55973 - DNA, 939 bp, Homo sapiens
  misc_feature: GYAE6OF01B7NZB.46.34.D01.1.454.CMB.1.raw
tcagactagcagtacacgaccggtgctcgatttagatcgtctgtggttgggtttgggctgatcaggactcctcagttcaccttctcacaatgaggctccctgctcagctccgtggggctgctaatgctcgtgggtccaggtattcaggtggggatgttgtgatgactctagtcctaccactcctcccgtcgccccgtctacccgttcgggaccaccggtccccggtcctaccctacgttccgtccccgtggtaccgtaacggttcgttaacgtaccgaaaaccggttcccgttactaactaaaccctgttacggaacttaaaccgggaaaccctaccgtcggtacccgttgggtaactttcgggtaaccttaccgaccgacgggcccggtaccgaacggaccccgtattccgtaacccggaacgggtccttaaccgttaaacgttttaacggtttaaacgggtttaaccgtaacccggggtacgttacccggtaccggggttacccaagtaaccgtacgttaacttacggtacgggtagggtaccggtacgggttacgggaccgtacggacccgttaaggtttagggtaaaccgtttcccaacgttaacccgttaaaggaaaaccggttaggaacggggtaacgggtacggggggtaacgggtacgggtaacgggtaagggtacggttaaagggttttagggttaaagtttaacgtttttaaacggtacggtttaacgaacgttaacggtacggtaacgggtaacgggtaacggtaaccgttcggttaaccggggtccgtttaaccccgggttacggttaccgggtttaccgggtttaccgggaccggtaaccgggggtaactacggggttacggaacggtaaacgggtaactaaacccgggtaacgttaaccggtagggtacccggttcgtaacccgg

SEQ ID NO: 55974 - DNA, 812 bp, Homo sapiens
  misc_feature: GYAE6OF01ARGE7.46.34.D01.1.454.CMB.1.raw
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
tcagactagcagtacacgaccggtgctcgatttagatcgtctgtgttgggtttgggctgatcaggactcctcagttcaccttctcacaatgaggctccctgctcagctcctggggctgactaatgctcgtcgggtcccaggtattcgaggtggggattgttgtgatcgactcagtcctccactcctcccgtcgcccgtcctacccgttgaccacggccgcctccntcctccngcgagtctagacaacgcctcgtactacactagacgtaacggaaacctaccgtcgtccgttaggttactttcggtaactccgaaccggaccggcccggtaccggaaccggtaccctaacgttacccgtaaccggaacgggtacccttaaccttttaaaagtttttaaccgttaaccgggttttaacccggtaacccgggtaccgtttacccgggttaccggggtacccaaggtaaccgtaggtaccgtttacggaacgggttacggaccggttagggtcggggtaccgtacgggtacctacggttacggtacgttaccgaaccgtaagtaaacgttaaacgacgtacgggtacggggtaacggggtagggtaaggtcggtaagggtagggttaaggtttagggtttaagtttaacgttttacgttaacggagttacggtacgtacggtaacgtagggtccgtacgtacgttaccgggtccgtccgttaccggttccggttaccggttaccgggacggtacggtaaccggagggtcccgtaggaaccgtacgtaaccggaacgttaggtcgtagtcctaccg

SEQ ID NO: 55975 - DNA, 942 bp, Homo sapiens
  misc_feature: GYAE6OF01BN4V5.46.34.D01.1.454.CMB.1.raw
tcagactagcagtacacgaccggtgctcgatttagatcgtctgtgttgggtttgggctgatcaggactcctcagttcaccttctcacaatgaggctccctgctcagcctccgtggggctgcttaatgtcctcgtcgggtcccaggtattcgaggtgggtattgttggtcgtagtcgactcgtacgtcctaccctacctccgttcccgtcggtcccgtacctacccgttggaccaccgggtcccggtccctaccgtacttccttccgtacggaccgtaggttaccttacgttaaccgaaccggtcccttaacgtacgttaaccacgttagtagttaaccggaaacctcccgttgaccgtttgaacgtttacgtactaccgaacgccggaccgccgtaaccggcctaacgtcccgtaacccggtaggtacccttaacgttttaaagtttaccggttaacgggttttacccgtaaaccccggggtcgttccgggttaacccgggtaacctaacggtaacgttaacgttcgtaaccggtagggttcccgggacggttagggtccgggtaaaccgaccgggtttactaacgggtacgggtttaacccgtaacccgtaacggtaaaccgttaaacccgtaaaaggtccggtaaaggggtaccgggttaaagggttcggggtaaacgggtacggttaaggggtaagggttttaccgggtttaaaggttttacccgtttaaagttttcggtaacgttaccgtcggtaaacggttaccgggtaagtcggggtaccgtaactttaaccgggtttcgggtacccggtacccggtttttacgggttaacccgtttacggttaccggggaaccggaaaccggttacgggtacggtaaacggggtcaaacggtttaacaaacccggtacgtttaaggcggtaacggtccgtacccg

SEQ ID NO: 55976 - DNA, 833 bp, Homo sapiens
  misc_feature: GYAE6OF01BMJW4.46.34.D01.1.454.CMB.1.raw
  modified_base (198)..(198): a, c, t, g, unknown or other
  misc_feature (198)..(198): n is a, c, g, or t
tcagactagcagtacacgaccggtgctcgatttagatcgtctgtgttgggtttgggctgatcaggactcctcagttcaccttctcacaatgagctcctgctcagctccgtgggctgctaactgctcgtcgggtccaggattcgaggtggggatgttgtgatgactcacgtctccactctcctcgccgtcaccgtgacncgccgcctcactcctctgcgtaggtctagacaacgtcctacgtactacacgtagacgtaacggaaacctaccgtcggtaccggttaggtaactttacggtactccaaccggtacggacccgggaccgaacggtaccctaacgtcccgtaaccggaacggtccgttaaccgttttaaacgttttaaccgttaaccgggtttacccgttaaaccgggtaccgttaccgggtaccggggtacccaaggtaacgtacgtacttaccggagggtacgggtacggttacgggtaccggggtaacgtacggtaccgtacggttacgttaaccggttaccaacggtaagttaaaccggtaaactcgggtaacgggtacgggaagggggttcggtaaaccgggtggttaacgggtaaggttaacggtttaggttttaagttaacttttaacggtacgtagtaaccgtaggttaaccggtaacggtaacgggttaccaacgtttaccggtaacggtttcccggtacccggtttacgggttaaccgtttccggggttaacggacccgggttaacgggaaccgttacggtacgggtaacggaaccgtaaacgtaaccggaacggttatcggggtacctacggtaccg

SEQ ID NO: 55977 - DNA, 613 bp, Homo sapiens
  misc_feature: GYAE6OF01CW5UF.46.34.D01.1.454.CMB.1.raw
  modified_base (274)..(274): a, c, t, g, unknown or other
  misc_feature (274)..(274): n is a, c, g, or t
tcagactagcagtacacgaccggtgctcgatttagatcgtctgtgttgggtttgggcgtgatcaggactcctcagttcaccttctcacaatgaggctccctgctcagctcctggggctgctaatgctctgggtcccaggattcagtgggatgttgtgatgactcagtctccactctccctgcccgtcacccttggacagccgctccatctcctgcaggtctagtcaaagcctgtatacactgatggaaaccacctgcctggattggactcaccncgcggccacgccatcaccgaagcgtacctaatttactaaggtttccgaaccggtactcgtacggggtaccagacgagattcgagtcgcagtgggtcaggcacgttcggacttcgaacctaactagtaaactaccaacggacgtagggtaggacggtcgttaggaggtagttaggttaggtaattttaacgtacgttagcgtaagtggtaacgtaaggtgacctaacgtacgttcggtacccgttacccggttcgtaccgttttcgggcccggtaacgggaaccgtaaggtccgtaggtacgacgtaaccgaaacgtaccggtacggtcggtcggtaccg

SEQ ID NO: 55978 - DNA, 887 bp, Homo sapiens
  misc_feature: GYAE6OF01AW0BK.46.34.D01.1.454.CMB.1.raw
tcagactagcagtacacgaccggtgctcgatttagatcgtctgtgttgggtttgggctgatcaggactcctcagttcaccttctcacaatgaggcctccctgctcagcctccgtggggctgctaactgctcgtgggtcccaggtacttcagggtggggatgttgtagagtgactacacgtcctcccacttcccgtcccttcggccccggttaccctacccgttagggaccgtaccggtcccggtacccctcctaacctcccgttacccgtggaccggtacgggttaccgttaacggtaaccgtaaaccggttccgttacggtactttaacccgaacggttaggtaaaacgtaccggaaaaccgtcccgttaacggtaccggttacgggtttacgttacggtaccctacccggaacccggtaccgggacccgggtaccccggacggtaaccctacggttacccgacccggtaaccgggtacctttaaccctttaaagtttttaaccgggtaaccggttttaaccccgggtaaacccggtccgttaccggggttcccgggtaccccgtaaggaccgttaacggtccggttacggtacgtacggttcgggaacggggtttcgggtacgaccgggtacgttcgtacgggtaacctacgaaccgttaataacgaaccgtcgtacggtgggaaacggggtgtaacgggtaggacgggtaaaggttcggttaggtttacggtttaactttacgtgtaccgtggtagttaccggaaggtacgtacgtacgtagttcgggtacgttccggttacttacggttccgtaaaccgggtcggtacggtacccgaaggtccgagtacgtaacgacggtacgtagacggtcgtcggtaaccg

SEQ ID NO: 55979 - DNA, 806 bp, Homo sapiens
  misc_feature: GYAE6OF01BQJPN.46.34.D01.1.454.CMB.1.raw
  modified_base (161)..(161): a, c, t, g, unknown or other
  misc_feature (161)..(161): n is a, c, g, or t
  modified_base (204)..(204): a, c, t, g, unknown or other
  misc_feature (204)..(204): n is a, c, g, or t
  modified_base (681)..(681): a, c, t, g, unknown or other
  misc_feature (681)..(681): n is a, c, g, or t
  modified_base (794)..(794): a, c, t, g, unknown or other
  misc_feature (794)..(794): n is a, c, g, or t
tcagactagcagtacacgaccggtgctcgatttagatcgtctgtgttgggtttgggctgatcaggactcctcagttcaccttctcacaatgaggcctccctgctcagtcctccgtgggctgctatgctcgtcggccaggtattcgaggtgggattggttgngatgtactcacgtctccactcctcctcgccctctaccgtgacnccggcccgtcctacctcgtcctactggtacgtaacgttacctacgtacgaaaccgtccttaacgtactacgaccgttagaaccggtaacgaaccgtccgtcggtacgttaggtacttaccggtaactcccggaacgtcggacccggaccgaaccggtaacccttaacgttacccggaccgggtaacggttacccgttaaacgttttaaaaggttttaaccggttaaccccgggtttaaccgggtaaaccccggttcggtaccgggttacccggaaaccgagtaacgtacggtaccgttacgaagggtccgtaagggttacgggtacggtacgtaacggtacttaaccgtagttaccgaacccgtaacgtaaaggtaaactaacgtaccggagggtaccgggtaagggtacggaacgggtgtacgggtagttacgggttaggtttaacggttaattcgtacgtaacgagtaccggtanaacggtgtaccgtacgtaaggttccgtacgttccggtccgttaaccggttccggttagggaccggtacggtacgaggtagaaccgtacgtaaacctacggaccgttaggtccnggtcgtaacccg

SEQ ID NO: 55980 - DNA, 671 bp, Homo sapiens
  misc_feature: GYAE6OF01B2LNX.46.34.D01.1.454.CMB.1.raw
  modified_base (282)..(282): a, c, t, g, unknown or other
  misc_feature (282)..(282): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtgggtcccaggattcgaggtggggattgttgtgatgactcagtctccactcctccctcgcccgtctacccgttggacacggcccgtcctccatcctcctgcgtacggtctacgtacaaacgcctacgtaatacactagaactacggaaaaccnccgtgaccgtaggtatttcggtaactccgaaccgtaggccggaccaggtacccaatccgtaccgaaggctaaccttaaatttacgtaaacgggtttccgaaaccggtcttccggtacgggtaccaagactagtcttacaggtcgacgtaggtcgggtaccagggtactacgtgaacgttaccaacgtaacgtaagaaacgtcgaagcggtaagggtacggaacggtaccgtagggtaacggtagtttaggttaagttaacgtttagttacgtagtcaagtcgacggtaagtcgctacgtacgttcgtacccgtccgttacgttaccgttacgggacgaacgggtacctaggtcgtaggactaacgtacgaaccgtagtgtcggcgtacg

SEQ ID NO: 55981 - DNA, 793 bp, Homo sapiens
  misc_feature: GYAE6OF01A4C0B.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtccaggattcagtgggatgttgtgatgactcagtctccactctccctgcccgtcacccttggacacgccggcctccattcctccgtacgcgtacggtctaagtacctaaacggtccttacggtacttaccgacttgaagtacggaaaactccgtagccgtaggtattggtaactcgaccgaacggccggaccgaggaccctaacttccaccggtaacgccgtacctttaaagttttaacgttaacggttttacccgtaaaccgggtacctttaccggtaccggggttaccccaaggtaaccgtaaggtacgtttacgacgtttacgggaccgtaacggggttgggttaccggacggtcgtaaccgttggtaacgtttacaacgtaacgttaagaaaaccgttgacgggtaacggtacggggttagggaacggtaccggtagggtaagggtaacggttaggtttaaggttaacttttaacgttactacggtacgtaacgttaccggtaagttacggacgtaccttaaggttccgtttacggtacccggttccgtttacggtttaccggtttaccgggaccggttaaccgggaacccgtaaggtacgtacggtaaacgtaaccgaacggtaaacgtaaccgttgggtaaccggtacgtaccggg

SEQ ID NO: 55982 - DNA, 785 bp, Homo sapiens
  misc_feature: GYAE6OF01AZ7HU.46.34.D01.1.454.CMB.1.raw
  modified_base (125)..(125): a, c, t, g, unknown or other
  misc_feature (125)..(125): n is a, c, g, or t
  modified_base (216)..(216): a, c, t, g, unknown or other
  misc_feature (216)..(216): n is a, c, g, or t
  modified_base (484)..(484): a, c, t, g, unknown or other
  misc_feature (484)..(484): n is a, c, g, or t
  modified_base (704)..(704): a, c, t, g, unknown or other
  misc_feature (704)..(704): n is a, c, g, or t
tcagactagcagtacacgaccggtgctcgatttagatcgtctgtgttgggtttgggctgatcaggactcctcagttcaccttctcacaatgagctccctgctcagctccgtgggctgctaagtcnctcgtcggtaccaggtattcgaggtgggatgttgtagatgactctacgtcctccaccttcctcccgtcgtcccgtactacccgttcggacnccgcccggtcctccctacgttcctccgtgtacccgtagggttacctacgtaaccgaaacgtccgttacgtataccacgttacgagttaaccgaactaccgtcgtaccgtgtagttacggttacaccaaccgccggaccgtaccggaaccgtaccctacgtaccgtaaccgacggttaaccgtaccttttaaacgtttacggtttaacccgttacggtaacccggttcgtaccgggtcggtacccgaagtacgtaacggtacttacggngggtaccgtgtacgggtcgtaccggagtctaacggtgtacctaacgtacgtaactaaaccggtaatcgtaaacgggacgaggggtaggacggtagtagggtacgttaggtagtttaagtttaagtttaccggttagcgttaacgtaggtaacggtcggtaacggtcgttacgtaccgtacggttaccgttcccgtacgttaccggtacggttacccgggnggtaaccgggtaccgaagtccgggtaacggtaaaccgtaccgtaaccgggtaacgttacgggagttccgcccggttaaccg

SEQ ID NO: 55983 - DNA, 906 bp, Homo sapiens
  misc_feature: GYAE6OF01BHVY8.46.34.D01.1.454.CMB.1.raw
  modified_base (200)..(200): a, c, t, g, unknown or other
  misc_feature (200)..(200): n is a, c, g, or t
  modified_base (215)..(216): a, c, t, g, unknown or other
  misc_feature (215)..(216): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggattgttgtgatgactcagtcctccactctccctcgcccgtcacctgacncgccgcctcatctcnncagtctagtacaacgtcctacgtatacacgtagaactacggaaacctaccgttcgaccgttacgggtatttacggtactacccaaccggtacggtaccgggtaccgaacgggtacccttaaacttcccggtaacccgaaacggggtcccgtttaacccttttaaaagttttacggtttaaaaccgggtttttacccgtaaaacccgggggtactttaccgggtacccgggggtacccctaaaggtacccgtaagttaacttccggtaacgggtacggtacgtacggggtttacgggaccgtaacgggtacaccggtttaggaaccgtttacctaaacgaacccgttaaggtaaaactcggaacgggtccgggtaaacggggttcggtaacgggtaaccggttaggggtaaccgggtttaaaggttttacgggtttaaacgggttttaaaacctttttacggttacggtaacgaccgggtttaacggaggttaaacccgggtaaccgggtacgttaacccgttaacttaccgggggtttcccggtacccgtttaccgggttaccggtttaccggttacccggggaaaccgggtaccggggtaaacccgtacggttacgggaaccggttaaagtaaacccggtaaaaccggttaacggtaggtttaccggttcggggtacccttaacccggg

SEQ ID NO: 55984 - DNA, 772 bp, Homo sapiens
  misc_feature: GYAE6OF01BLZVO.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgcctcgtgggtcccaggattcgaggtgggggatggttgtgatgactcagtctccactctccctcgcccgtcaccctggacacggcccgcctcatcctctgcaggtctagtacaagtcctagtatacgactaggaacgtacggaaaacctccgtgcccgtttagggactttacggaactccaaccgacggccgaccacggtacctaacgtcctacgaacggccgtacctttaaagtttagtaaacgggtttaccgaaacccgggtccttaccgggttccgggaccccgtaaagtaaccgtaagtttaccgttacgacgggtttacggacggtaagggttggggtaccaaacggccgtaaacgttgggtaaccgtttaacccgaacctaacgtaacggtaaaacgttccggaaacggtcggtaaggggtacgggaaggtaccggttaagggtaagggtagttacgggtttaacgttaagttttaacgttaacgttagtacggtaactacggacgtaacgggtacaccgttacgtaacgttccggtacccgttcggttaccgttaccggtttcggacccggtacggggtaccgtaacggtcgtaagggaacgtaaccgtaacggtaaaccgtagtaggtcctcgggtaccc

SEQ ID NO: 55985 - DNA, 856 bp, Homo sapiens
  misc_feature: GYAE6OF01A2MDO.46.34.D01.1.454.CMB.1.raw
tcagactagcagtacacgaccggtgctcgatttagatcgtctgtgttgggtttgggctgatcaggactcctcagttcaccttctcacaatgaggctccctgctcagcctccgtggggctgctaatgctcgtgggtcccaggtattcgaggtggggatgttgtgatgactctacgttctccactcctccctgcccgtcctaccgttcggacacggtccccggcctcctacttccgtccgtcgacgtacggtccttaacgtaccgaaacgtcccgtacgttaactactacgtcgtaagtacgggaaaaccctcccgtgtacccgttagggtactttcggtaacctcccgaaaccgtcggacccggtaccgaacgggtaccctaaacgtccctacccggtaaagggtccctttaacccgtttaaagtttttaaacgggtaccgggttttaaccggttaaaccccgggtaccgttacccgggtaccgggttacccaaacggtacgtaacgtaacttcggaacggtcgtcgttaggacgggtccgaaacgtcgtacgttacgggtaccttacactaacgtaaagtaaacgtaccggaaggtaaccggtaaggggtacgggtaacgggtacggtacggggtaagtacgggtttagttaacggtttaattttacggttaacgtggtacgtacgtaggaaccgtaagggttaccgtacgttaaccgttacggttcccgggtaccgttcccggttaccggttccggtttaccgggaaacccgggtaccgggtaacggtaaaggtcccgtaacgggtaacgtaaccggtaacgtaaacggtaagttacgggtacgtcggtacccgg

SEQ ID NO: 55986 - DNA, 843 bp, Homo sapiens
  misc_feature: GYAE6OF01ESOUH.46.34.D01.1.454.CMB.1.raw
  modified_base (235)..(235): a, c, t, g, unknown or other
  misc_feature (235)..(235): n is a, c, g, or t
tcagactagcagtacacgaccggtgctcgatttagatcgtctgtgttgggtttgggctgatcaggactcctcagttcaccttctcacaatgaggcctccctgctcagcctccgtggggctgactaatgctcgtcgggtacccaggtattcgaggtggggtattgttggtgatacgactcgagttcctaccctacctccctccccgtcgtccccgttccctacccggttggaaccnccggccccggtacccttccctattcccttcccgtgtaccgtacggttaccttacggtaaccaaacgtccccgtttataactaacctacgtagaacgttaacgaaaccctaccgtcgaccgtaggttagttacggtacctaccgaccgacggccggaccaccgggaccctaccgttccgacccgaacggtaccgtaacccttttaaaagttttaccggtttaaaccgggttttacccggtaaccgggtaccgttaccgggttaccggggtacccaacgtaaccgtacgttacgttacggtaggtcgggtactagggtacggtacgacggcctagtacggtacgttaccacgtaacgtaacgaaacgtgaacggtacgggtaagggtcggacgttacggtagggtaacggtgtttagtaacgtttaacgtttaacgtttacgagtacgtgtacgtacggacggttacgacgttacgtaccggtttaccggtccggttaccggtttacgtttaccgggttaccgggccggttaaacgggtaccgtacgggtacggtacggtaaacgttaccgtaaaccgttaacggacggttgggtccgacgttaacccgg

SEQ ID NO: 55987 - DNA, 838 bp, Homo sapiens
  misc_feature: GYAE6OF01EOQAI.46.34.D01.1.454.CMB.1.raw
tcagactagcagtacacgaccggtgctcgatttagatcgtctgtgttgggtttgggctgatcaggactcctcagttcaccttctacacaatggaggcctccctgcctcagctcccgtggggctgactaatgccttcgtcgggtacccaggtattcgagggtaggggattggttgtgtatcgaccgttacgtccctaccctaccgttcccttcccgtccgtcccccgttacctacccggttacgggaccgcccggccccggtacccctacctccttccgtccgtggccgtaacgggttaccttaacggtaaccgaaaccgtcccgtttagttaacctaccgtagtacgacgtaaccggaacctccggtcgtacgttaggtacttacggttacacccgagacgccggtaccaccggtacctacgtccacgtaccgtacgtacgtttaagttaacggtacgttacgtacccggtatccgggtaccggtaccagtacgtagttaacgtcgtcggtggtaacgtgggtacgggtacgacggtacgtacgtagtaaactcccaacgtaacgtaaacgtaaacgtaccggtacgggtacgggtaaaggggttaccgggtaacgggtacggttaacggtacgggttaagttttaggggtttaaacgtttaacggtttaacgttcccgtaggtacgtaggtacggtacggtacggtacgaccgttactccggtacggttcccgttcggttaccttaccggttaccggggaccgtaaccgggtacgtagtaccgggtaagacccgttaacggtaacccgtaaaggtcggttcggacgtaaccggtccg

SEQ ID NO: 55988 - DNA, 500 bp, Homo sapiens
  misc_feature: GYAE6OF02F6Y3S.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggtcaatctccaaggcgcctaatttataaggtttctaaccgggactctggggtcccagacagattcagtggcagtgggtcaggcactgagttcacactgaaaatcagcagggtggaggctgaggatgttggaatttattactgcatgcaaggtgcacattggcctccggtcacttttggccgagggaccaagctggagatcaaacgactgtggctcg

SEQ ID NO: 55989 - DNA, 501 bp, Homo sapiens
  misc_feature: GYAE6OF02F06MM.46.34.D01.1.454.CMB.1.raw
  modified_base (498)..(498): a, c, t, g, unknown or other
  misc_feature (498)..(498): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaatcagcagggtggagctgaggatgttggaatttattactgctatgcaaggtgcacattggcctccgtctacgtttggccgtagggaccaagctggagagtcaaacgactgtggntcg

SEQ ID NO: 55990 - DNA, 499 bp, Homo sapiens
  misc_feature: GYAE6OF02JJOBH.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaatcagcaggtggaggctgaggatgttggaattatactgcatgcaagtgcacattggcctcgtctacgtttggccgagggaccaagtctggagagtacgaaacgactgtggactcg

SEQ ID NO: 55991 - DNA, 512 bp, Homo sapiens
  misc_feature: GYAE6OF02JAAGV.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaaatcagcagggtggaggctgaggatgttggaatttattactgtcatgcaaggtgcacagttcggcctccggtctacgttttggccgaggggaccaaggctaggagatcgaaacgaacgtgtaggctcg

SEQ ID NO: 55992 - DNA, 512 bp, Homo sapiens
  misc_feature: GYAE6OF02I9HT0.46.34.D01.1.454.CMB.1.raw
  modified_base (507)..(507): a, c, t, g, unknown or other
  misc_feature (507)..(507): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaatcagcgagggtggaggcgtgaggagtgttggtaatttattactgcatgcagtgcacattggcctcggtctacgtttggccgtagggaccaagtcgtggagtatacgaaacgaactggtagngtacg

SEQ ID NO: 55993 - DNA, 517 bp, Homo sapiens
  misc_feature: GYAE6OF02IIU5G.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtgggtcccagacagatcagtggcagtggtcaggcactgagttcacactgaaaatcagcagggtggaggctgaggatgttgtaatttattactgcagtgcgaaggtgacacagttggcctccggtctacgttttggccgtaaggggaccaaggcgtaggagatacgaaacgaacgtgtcggactcgg

SEQ ID NO: 55994 - DNA, 512 bp, Homo sapiens
  misc_feature: GYAE6OF02GZN4M.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaaatcagcagggtggaggctgaggatgttaggaatttattactgcagtgacaaggtgcacattcggcctccggtctacgttttggccgaggggaccaaggctggagatacgaaacgaactggtggctcg

SEQ ID NO: 55995 - DNA, 514 bp, Homo sapiens
  misc_feature: GYAE6OF02HQ1UG.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtgggtcccagacagattcgagtggcagtgggtcaggcactgagttcacactagaaatcagcagggtggaggctgaggatgttggtaattattactgcatgacaaggtgcactagtgcctccgtctacgttttggaccgtagggaccaagctggagactacgaaacgaacgtagtaggcgtacg

SEQ ID NO: 55996 - DNA, 529 bp, Homo sapiens
  misc_feature: GYAE6OF02IXY6E.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtgggtcccagacagattcagtggcaggtgggtcaggcactgagttcacactagaaaatcagcagggtggaggctgaggatgttggaatttagttactgcagtgacgtaaggtgcacagttcggccttccggtctacgttttcgaccgtaacggggaccaaggcgtaggagacgtacaaacgaacgtaggtcggctacg

SEQ ID NO: 55997 - DNA, 498 bp, Homo sapiens
  misc_feature: GYAE6OF02GO6XB.46.34.D01.1.454.CMB.1.raw
  modified_base (378)..(378): a, c, t, g, unknown or other
  misc_feature (378)..(378): n is a, c, g, or t
  modified_base (478)..(478): a, c, t, g, unknown or other
  misc_feature (478)..(478): n is a, c, g, or t
  modified_base (495)..(495): a, c, t, g, unknown or other
  misc_feature (495)..(495): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcanactgaaaatcagcagggtgaggctgaggatgttaggaatttattactgcatgcaaggtgcacattggcctcggtcactttggccagggaccagctagganacgtcaaacgactgtgntcg

SEQ ID NO: 55998 - DNA, 529 bp, Homo sapiens
  misc_feature: GYAE6OF02HQIX5.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgacctaatttataaggtttctaaccgggactcgtgggtcccagacagattcagtggcagtgggtcaggcactgagttcacactagaaaatcagcgagggtggaggcgtgaggtagtgttaggtaatttattactgacagtgacgaaggtgcactagttcgccgtccgtctacgttttcggaccgtagggaccaaggcgtaggagacgtacgaaacgtacgtagtgctacg

SEQ ID NO: 55999 - DNA, 553 bp, Homo sapiens
  misc_feature: GYAE6OF02IEWES.46.34.D01.1.454.CMB.1.raw
  modified_base (299)..(299): a, c, t, g, unknown or other
  misc_feature (299)..(299): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcncctaaatttataaggtttctaaccgggactcgtcgggtcccagacagattcagtggcagtggtcaggcactgagttcacactagaaaatcagcgagggtggaggctaggaggagttgttaggtaatttagttactgacagtagacgaaggtgacaacgtagttacggccgttaccgggttactacgttttacggccgtaaggggtaacccaaggcgtaggagtactacgaaacgaaccgtggtacggtctacgg

SEQ ID NO: 56000 - DNA, 540 bp, Homo sapiens
  misc_feature: GYAE6OF02HQ4ST.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtggggtcccagacagattcagtggcagtggtcaggcatgagttcacactagaaaatcagcgagggtggaggctgaggatgttaggtaatttattactgcagtgacgaaggtgcacagttcggccgttccggtacgtacgttttcggaccgtacggggacccaaggtcgtaggagtacgtacgaaacgtaacgtaggtacggactacgg

SEQ ID NO: 56001 - DNA, 557 bp, Homo sapiens
  misc_feature: GYAE6OF02GFB1B.46.34.D01.1.454.CMB.1.raw
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
tcagactagcagtacacgaccggtgctcgatttagatcgtctgtgttggggtttggggctgatcaggacgtcctcctaggtttcggaaccttcgtacacaatggaccggcgtcccttgcgtcagcgtcctggggctggcctaagtgctctgggtcccaaggattcagtggggatgttgtgatgacgtcaggtctaccgactctccctgcccgtcacccttggacagccggcctccatctcctgcaggtctagtcaaagcctcgtatacactgatggaaacacctgcctggattggtatcaccagcggccaggccaatctccaaggccgcctaaatttataaggtttctaaccgggactcgtggggtcccagaccagattcagtggcagtgggtcagggcactgacgttcacactacgaaaatcagcgagggtggaggcgtgaggatggttaggtaatttattatgcatganaggtgcanattcggccttcggctacgtttggccggtacggggacctaaggcgtcggaagagtacgaaacgaacgtgttggctacgg

SEQ ID NO: 56002 - DNA, 549 bp, Homo sapiens
  misc_feature: GYAE6OF02INNE7.46.34.D01.1.454.CMB.1.raw
  modified_base (395)..(395): a, c, t, g, unknown or other
  misc_feature (395)..(395): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagcccggcctccatctcctgcaggtctagtcaaagcctcgtatacactgatggaaacacctgcctggattggtatcaccagcggccaggccaatctccaaggcgacctaatttataaggtttctaaccgggactcgtgggtccagacagattcagtggcaggtgggtcaggcacgtgagttcacactagaaatcagngagggtggaggcgtgaggtagtgttagtaatttattactgacatgacgaagtgacacgtagttcggtccgtccggttctacgttttcggaccgtaacggggtaaccgaaggacgtacggaagacgtacgaaacgaacgtcggtacggcgtacgg

SEQ ID NO: 56003 - DNA, 624 bp, Homo sapiens
  misc_feature: GYAE6OF02JYRWP.46.34.D01.1.454.CMB.1.raw
  modified_base (218)..(218): a, c, t, g, unknown or other
  misc_feature (218)..(218): n is a, c, g, or t
  modified_base (308)..(308): a, c, t, g, unknown or other
  misc_feature (308)..(308): n is a, c, g, or t
tcagactagcagtacacgaccggtgctcgatttagatcgtctgtgttgggtttgggtcgtgatcaggactcctcagttcaccttctcacaatgaggctccctgctcagctcctgggctgctaatgctctgggtcccaggattcagtgggatgtgtgatgactcagtctccatctccctgccgtcacccttggacagccggcctccatctccctgaccnggtctagtcaaagcctcgtatacactgatcggaaacacctgccctggattggtatcacagcgccaggccaatctccaagccgcctaattntaacggttctaaccgggactctggggtcccagacagtattccagtgacagtggtcagggcagtcgagttccagtactagaaatcgagtccgagggtggacgcgtaggacggaattggttaggtaaagttttagttaacgtcggtactaagttacggaccgtaaaggttcgtcccgtaagtacgttagggtccccgtaccgggttctacgttttcgggtacccgtaacggggggtaacctaaacggtccgttaacggggaagttaaccgttacggaaaacccggtaaccggtttcggttaacgggccgttaacccgg

SEQ ID NO: 56004 - DNA, 555 bp, Homo sapiens
  misc_feature: GYAE6OF02H4F9Y.46.34.D01.1.454.CMB.1.raw
  modified_base (254)..(254): a, c, t, g, unknown or other
  misc_feature (254)..(254): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctgtatacactgataggaaaacncctgcctggattggatcacagcggccaggcctaatcaccaaggcaccttaaatttataaacggtttcaaaccgggctcggtcgggtcccaagcagtattcagtggcaggtgggacaggcactgagttacacactagaaaatcagcgaagggtggaggcgtaggaggtagttggtaggtaacttttatactagactagtagacgtaaagggtgacaacgtagttacggccttaccgggtctacgttttgggcccgaaggggtaccaaggcgtaggagatacgaaacgtacgtgtaggctacg

SEQ ID NO: 56005 - DNA, 520 bp, Homo sapiens
  misc_feature: GYAE6OF02HT14R.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtgcagtgggtcaggcactgagttcacactagaaaatcagcagggtggaggcgtgaggagtgttggtaatttattactgtcagtgcaaggtgcactagttggccttccggtctacgttttcggccgaggggaccaagcgtggagagtacgaaacgaacgtgtggtctacg

SEQ ID NO: 56006 - DNA, 513 bp, Homo sapiens
  misc_feature: GYAE6OF02GCN9P.46.34.D01.1.454.CMB.1.raw
  modified_base (431)..(431): a, c, t, g, unknown or other
  misc_feature (431)..(431): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggtcaatctccaaggcgcctaatttataaggtttctaaccgggactctggggtcccagacagattcagtggcagtgggtcaggcactgagttcacactgaaaatcagcagggtggaggctgaggatgttggaatttattactgcatgnaaggtgcacattggcctccggtctacgttttggccgaggggaccaaggctaggagacgtcaaacggaactggtaggctacgg

SEQ ID NO: 56007 - DNA, 590 bp, Homo sapiens
  misc_feature: GYAE6OF02H0DNG.46.34.D01.1.454.CMB.1.raw
  modified_base (298)..(298): a, c, t, g, unknown or other
  misc_feature (298)..(298): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcacagcggccaggccaatctcaaggcncctaattataagtttcaacggactcgtgggccagacagattcagtggcaggtgggtcaggcactgagttcacactagaaaatcagcgagggtggaggcgtagaggagttaggttaggtaattttaattactagtactagtagacgtaagggtgacctaacgtagttacggcccgttccgggtaccgttacgttttcgggacccggtaacggggtaacccgtaaaggtccgtagggaacggtaacgttaaccggtaaaaccggtaaacggttacggttacgggtccttaacgg

SEQ ID NO: 56008 - DNA, 527 bp, Homo sapiens
  misc_feature: GYAE6OF02F2UUS.46.34.D01.1.454.CMB.1.raw
  modified_base (427)..(427): a, c, t, g, unknown or other
  misc_feature (427)..(427): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtgcagtggtcaggcactgagtcacactagaaatcagcagggtggaggctagaggatgttaggtaatttattactgnatgacaaggtgacacagttaggccttccggttctacttttcggaccgtacggggacctaacggcgtaggagactacgaaacgtaacgtcggtaggctacg

SEQ ID NO: 56009 - DNA, 539 bp, Homo sapiens
  misc_feature: GYAE6OF02G4RU5.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggtcaatctccaaggcgcctaattttataaggtttctaaccgggactcgtggggtcccagacagattcagtggcagtgggtcaggcacgtgagttcacactagaaatcagcagggtggaggcgtgaggtagtgttaggtaatttagttactgctatgacaaggtgactactagttcggccttccggtctacgttttcggaccgtacggggacctaaggctaggagtacgtacgaaacgtaacgtggtagcgtacgg

SEQ ID NO: 56010 - DNA, 554 bp, Homo sapiens
  misc_feature: GYAE6OF02FR6B5.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtggggtcccagacagattcagtgcagtggtcaggcacgtgagttcacactagaaatcagcgagggtggaggcgtgaggtatggttaggtaatttattacgtgtactagtagtacgaggtacgacacgtacgtcggtccgttccggtctacgttttacgaccgtaacggggaccgtaacggtcgtaggacgtacgtacgaaacgtacgtcggtacggcgtacgg

SEQ ID NO: 56011 - DNA, 518 bp, Homo sapiens
  misc_feature: GYAE6OF02F5XKF.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtgcagtgggtcaggcactgagttcacactgaaatcagcagggtgaggctgaggatgttggaatttatatgcatagcgaaggtgacactattcggccgttccgtctacgttttcgaccgtaggggacctaaggcgtaggagacgtacgaaacgaacgtgtaggctacg

SEQ ID NO: 56012 - DNA, 569 bp, Homo sapiens
  misc_feature: GYAE6OF02JCK61.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaattataaggtttctaaccgggactctggggtcccagacagattcagtggcagtgggtcaggcacgtgagttcacactagaaatcagcgagggtggaggcgtggaggagtgttaggtaatttagttactgactagtacgcgtaaggtgacacgtagttcggtccgtccggtactacgtttttcgggccgtaacgggggaaccctaacgggtcgtagggtacggtactaaccggtaaaccggtaacgtacggtacggacgttaccgg

SEQ ID NO: 56013 - DNA, 684 bp, Homo sapiens
  misc_feature: GYAE6OF02JU1RQ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctcgcccgtcaccttggacacgccggcctccatcctcctgcaggtctagcaaacgcctacgtactacactgatacggaaaccacctgccgtaggattcggtactcgaccgagccggaccgacggaccaacgtccaccgaacggtccgtaccgttaatttaacgttaacggtttacctaaccgggtaccttacgtcggggtacccagactagtacttacgaggtgacgaggtcggtacaggtccagtcgtagtaccgactacgtaacgaaattcgacgtacggtagggtacggaggtacgtaggaacggtagttagggttaggttaagtttaacgttacggtagtacgtacgtacggtacgtaaacggtcgtacgtaaccgttaaggttaccggtacccgttaccggttaccgttacgttttccgggaaccgggtaacggtaaccgtaaggtccggtaaggtacgtaaccgtaacggaaaccggtacgtacggtacggaccgtaccg

SEQ ID NO: 56014 - DNA, 560 bp, Homo sapiens
  misc_feature: GYAE6OF02H93T2.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaaacacctgcctggattggtatcaccagcgccaggccaatctccaagcgcctaattttaataaggtttctaaccgggactcgtgggtccagacagatcagtggcagtgggtcaggcatgagttcacactagaaaatcaagcgagggtggaaggctagaaggattgttaggtaattttatactgtacagtggacaaggtgacaacgtagttcggcccgttccggttctacgttttacggaccggtaacggggaaccctaaggccgttaggaagtaacgtaccgaaaacggaacgttaggtacggtctacgg

SEQ ID NO: 56015 - DNA, 555 bp, Homo sapiens
  misc_feature: GYAE6OF02FF6JY.46.34.D01.1.454.CMB.1.raw
  modified_base (449)..(449): a, c, t, g, unknown or other
  misc_feature (449)..(449): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaattataaggtttctaaccgggactcgtggggtcccagacagatcagtggcagtgggtcaggcacgtgagttcactacagaaatcagcgagggtggaggctagaggtatgttaggtaatttagttactgactagtgacgtaaggtnacacgaattcggccttccggtacttacgtttcgggaccgtaacggggaccaaggtccgtaggaagtacgtacgaaaaccggtacgttacggtacggtacgtaccgg

SEQ ID NO: 56016 - DNA, 599 bp, Homo sapiens
  misc_feature: GYAE6OF02F9KGJ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcacagcggccaggccaatctccaaggcgcctaatttataaggtttctaaccgggactcgtgggtcccagacagatcagtggcaggtggcaggcactgagttcacactagaaatcagcgagggtggaggctggaggagtggttaggtaatttagttacgtgacagttaggacgtaagggttgacctacgtaagtttcggacccgttaccgggtaccttacggtttttacgggaccccggtaagggggaccctaaagggtcccgttagggaacggtaacgttaaccggtaaaaccggtaacggttacgggttacgggaccgttaaccggg

SEQ ID NO: 56017 - DNA, 711 bp, Homo sapiens
  misc_feature: GYAE6OF02H0YH1.46.34.D01.1.454.CMB.1.raw
  modified_base (172)..(172): a, c, t, g, unknown or other
  misc_feature (172)..(172): n is a, c, g, or t
tcagactagcagtacacgaccggtgctcgatttagatcgtctgtggttggggtttgggctgatcaggactcctcagttcaccttctcacaatgagggcctccctgctcagcgtcctggggctgctaatgctcgtgggtcccaggacttcagtggggatgttgtgatgacctnagtcctccactctccctgcccgtcaccttggacaggccggcctccatctccctgcaggttctacgtcaaaagcctagtatacactgatggaaactacctgtacctggattggataccacgaacgcggccccaaggcctaatcaccgaaggtccgtccttaaagtttaactaaacggttttccttaaaccggggacttaccggtacgggggttaccccaagtaccgaaggtatttaccgaaggttcgggactagggtcgggttccgaagggactacgttacgtaacggttaccaactaaccgttaacggaaaacttcgaaacggcgtaacggggtagggacggcgttaggaaggtaggttaggtttaggaaactttttaagttaacgtagttacgtaatacggtacgaaggttacgtacctaccgtacggtttacggcccgttacccggttacgttaccgttttcgggacccgaaggggtacccgtaggtacgtacggagtaacgtaccgtaaaacgtaccggtcgtacggtactaccgg

SEQ ID NO: 56018 - DNA, 537 bp, Homo sapiens
  misc_feature: GYAE6OF02JBDVV.46.34.D01.1.454.CMB.1.raw
  modified_base (299)..(299): a, c, t, g, unknown or other
  misc_feature (299)..(299): n is a, c, g, or t
  modified_base (532)..(532): a, c, t, g, unknown or other
  misc_feature (532)..(532): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccagccaatctccaaggcncctaatttataaggtttcaaccgggatcgtgggtcccagacagattcagtggcagtgggtcaggcacgtgagttcacactagaaatcaagcgagggtggaggcgtaggaggagtggttaggtaatttattactagctagtgacgaaggtgacactagttggaccgtcgtactacgttttcggaccgaacgggaccaaggcgtaggagacgtacgaaacgtaacgtcggtaggntacgg

SEQ ID NO: 56019 - DNA, 565 bp, Homo sapiens
  misc_feature: GYAE6OF02JBSE5.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaacgggactctgggtcccagacagattcagtggcagtgggtcaggcacgtgagttcacactagaaatcagcgagggtggaggcgtggaggagtgttaggtaatttattactgactatagcgaaggtgacactagttcggtccgtccggttactacgtttttcggacccggtaaggggtaacccgaacggtccgtaggtaacggtaacgtacgaaaaccggtaacgtacggttacggaccgttacgg

SEQ ID NO: 56020 - DNA, 527 bp, Homo sapiens
  misc_feature: GYAE6OF02IDUSM.46.34.D01.1.454.CMB.1.raw
  modified_base (422)..(422): a, c, t, g, unknown or other
  misc_feature (422)..(422): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacactgcctggattggtatcacagcggccaggccaatctccaagcgcctaatttataaggtttctaaccgggactcgtggggtcccagacagattcagtgcagtgggtcaggcactgagttcacactagaaatcagcagggtggaggctgaggatgttggtaatttatacngtcagtgacaaggtgacgactagttggccttccggtctacgttttgggccgtaaggggacctaaggctaggagacgtacgaaacgtaacgtaggtcggactacgg

SEQ ID NO: 56021 - DNA, 526 bp, Homo sapiens
  misc_feature: GYAE6OF02IWMCY.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaacacctgcctggattggtatcaccagcggccaggccaatctccaaggcgcctaatttataagtttctaacggctcgtgggtcccagacagattcagtgcagtggtcaggcactgagttcacactagaaactcagcgagggtggaggcgtgaggtatgttggtaatttatactgacatcgacgtaaggtgcacgacgttcggccgtccgttcgtacgttttcggccgtacgggaaccaaggtcgtggagacgtaccgtaaacgacgtgtcggatacg

SEQ ID NO: 56022 - DNA, 515 bp, Homo sapiens
  misc_feature: GYAE6OF02IFBPL.46.34.D01.1.454.CMB.1.raw
  modified_base (511)..(511): a, c, t, g, unknown or other
  misc_feature (511)..(511): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactagaaaatcagcagggtggaggctgaggatgttggaatttattactgcatgcaaggtgacactattcggcctccggtctacgttttggccgaggggaccaaggcgtaggagatacgaaacgtactgtggntacg

SEQ ID NO: 56023 - DNA, 585 bp, Homo sapiens
  misc_feature: GYAE6OF02JPI1A.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccgagggaccggcccctaagctacctaatctatcgctgcatcctagtttgacgaaaggtcggggtcccatcggaggttcagtggcagtggatcgtagggactagtactttcactctaccacctatacgagttaactctagactaacgtagtaaacgtattttacgaacttaactttaattacgtagtaacaacgtagtaattactaagtttcgttaccggaccgtaagggtacacgttaactaactaaacgttaacgtacgttaggtggacttagacctaccgtaattcgtacttacttacctacttcctaccccgtac

SEQ ID NO: 56024 - DNA, 565 bp, Homo sapiens
  misc_feature: GYAE6OF02HH1W8.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggatcaccagcggccaggccaatctccaaggcgcctaatttataaggtttctaaccgggactcgtggggtcccagacagattcagtggcagtggtcaggcactgagttcacactgaaatcagcagggtgaggctgaggtatgttaggtaatttattacgtgcagttagcgtaaggtgacgaactagttacggcccgttccgggttacctaccgtttttgggacccgtagggggtaaccccaaggtccgttaggaacgtacgtaccgaaaaccggtaacgtacggttagggaccttacgg

SEQ ID NO: 56025 - DNA, 545 bp, Homo sapiens
  misc_feature: GYAE6OF02FYHQ5.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtcacccttggacagccgctcatctcctgcaggtctagtcaaagcctacgtatacactgatgaaacacctgcctggattggtatcaccagcggaccaggccaatcctaccaaggccgcctaatttataaggtttctaaccgggactcgtgggtcccagacagatcagtggcagtgggtcaggcacgtgagtcacactagaaatcagcgagggtggaggcgtgaggatggttaggtaagtttaattacgtgtactagtagcaaggtgactacgattggccttcggtcctacgttttcggaccgtacgggaacctaaggacgttaggaagactacgaaaccggtacttaggtacggtcgtacgg

SEQ ID NO: 56026 - DNA, 582 bp, Homo sapiens
  misc_feature: GYAE6OF02GH5WX.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgacctaatttataaggtttctaaccgggactcgtgggtcccagacagtattcaggtggcaggtgggtcaggcacgtgagttcacactagaaatcagcgagggtggaggctggaggagtggttaggtaatttagttacgtagactagtagacgaagggtcgacgtacgtagttcggtcccgttaccggttccgttacgttttcgggacccggtaacggggtaaccctaaggtccgttagggaagtacgtaaccgtaaaccggtaaccgttggtacggtctacgg

SEQ ID NO: 56027 - DNA, 561 bp, Homo sapiens
  misc_feature: GYAE6OF02IJULH.46.34.D01.1.454.CMB.1.raw
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatctcctgcaggtctagtcaaagcctcgtatacactgatggaaacacctgcctggattggtatcaccagcggccaggccaatcnccaaggcncctaatttataaggtttctaaccgggactctcgggtcccagacagattcagtgcagtgggcaggcactgagttcacactagaaatcagcgagggtggaggcgtaggaggagtggttaggtaatttagttactgctatagtacaaggtgactaactagttcggtcccttccggttacgtaccgttttcgggacccgtaaggggtacccaaggtccgtaggaaggtactaccgaaaccgtaacgttacggtcggacgtacgg

SEQ ID NO: 56028 - DNA, 534 bp, Homo sapiens
  misc_feature: GYAE6OF02HCOCD.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtggggtcccagacagattcagtggcagtgggtcaggcactgagttcacactgaaaatcaagcgagggtggagctggaggatggttgtaatttattactgcagtgacaaggtgcacagttcggccttccggtctacgttttggcccgtaaggggacccaaggccgtaggagtactacgaaaccggtaactggtacggctaccgg

SEQ ID NO: 56029 - DNA, 552 bp, Homo sapiens
  misc_feature: GYAE6OF02I0DCG.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggcccaggccaatctccgaaggcgacctaatttataaggtttctaaccgggactcgtgggtcccagacagattcagtggcaggtggtcaggcatgagttcacactagaaatcagcgagggtggaggcgtagaggagtgttaggtaatttagttactgactagtagacgaagggtgactactaagttcggtccgtcccggttactacgttttacggccgtaacggggacctaaggcgttaggagtactacgaaacgtaacgtggtcggtactcgg

SEQ ID NO: 56030 - DNA, 528 bp, Homo sapiens
  misc_feature: GYAE6OF02F58QH.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgacctaatttataaggtttctaaccgggactcgtggggtcccagacagattcagtgcagtgggtcagggcacgtgagttcacactgaaatcagcgagggtggaggctgaggagtgttaggtaatttattactgctatgacgaaggtgcactagttcggccgttccgtctacgtttcggccgtaaggggaccaaggctaggagactacgaaacgacgtgtcggactacgg

SEQ ID NO: 56031 - DNA, 550 bp, Homo sapiens
  misc_feature: GYAE6OF02F1315.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaattataaggtttctaaccgggactcgtggggtcccagacagattcagtggcagtgggtcaggcactgagttcactactagaaatcagcgagggtggaggctaggaggatgttaggtaatttattactgtcatggactaaggtgacacgtagttcggccttccgggtctacgttttcggaccgtaacggggacctaagggtctagggacgacgtacgaaaccggtaacgtacggtacggccgtacgg

SEQ ID NO: 56032 - DNA, 513 bp, Homo sapiens
  misc_feature: GYAE6OF02GZ47L.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaatcagcagggtggaggctgaggatgttggaatttattactgcatgacgaaggtgcacattggcctccggtctacgttttggccgtaaggggaccaaggcgtaggagatcgaaacgaacgtgtggctacg

SEQ ID NO: 56033 - DNA, 572 bp, Homo sapiens
  misc_feature: GYAE6OF02FH2ZU.46.34.D01.1.454.CMB.1.raw
  modified_base (439)..(439): a, c, t, g, unknown or other
  misc_feature (439)..(439): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatcctccaaggcgacctaatttataaaggtttctaaccgggactcgtggggtcccagacagattcgagtggcagtgggtcaggcacgtgagttcacactagaaatcagcgagggtggaggctagaggtatggttaggtaatttagttacgngtactagtgacgaagggtgactacgagttcggccttccggttacttaccgtttcggacccggtaagggggaaccctaagggtccgtagggaacgtaacgtaccgaaaacggtaccgtaggtacggccttacgg

SEQ ID NO: 56034 - DNA, 521 bp, Homo sapiens
  misc_feature: GYAE6OF02FJT4N.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaaatcagacgagggtggaggctgaggagtgttggaatttagttactgcatgacaaggtgctacattcggccttccggtctactttggaccgaggggaccaaggcgtaggagactacgaaacgtacgtcgtggctacgg

SEQ ID NO: 56035 - DNA, 542 bp, Homo sapiens
  misc_feature: GYAE6OF02JJN8Z.46.34.D01.1.454.CMB.1.raw
  modified_base (348)..(348): a, c, t, g, unknown or other
  misc_feature (348)..(348): n is a, c, g, or t
tcagactagcagtacacgaccggtgctcgatttagatcgtctgtgttgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgcaaagtgggtcccagtcgaggttcagtggcagtggatcgtggganagtatttcactctcaccatcagtaatctgactaacgtagaagtatttgactaacttattactgtacacagtaattacaattgtttacggacctaagggactacgaactaacaaaatttaaacgaacgtagtacggtctacggactaacctatctacgttacttactacttccttacccgcctactcctagtaac

SEQ ID NO: 56036 - DNA, 570 bp, Homo sapiens
  misc_feature: GYAE6OF02H5VQS.46.34.D01.1.454.CMB.1.raw
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtcacccttggacagccggcctccatctcctgcaggtctagtcaaagcctcgtatacactgatggaaacacctgcctggattggtatcaccagcggccaggcaatcncagcgcctaatttanaagttctaacggactgtcgggtccagacagattcagtggcaggtcggtcaggcacgtgacgttcacactgaaaatcgagcgagggtggaggcgtaggaggagttaggttaggtaattttaatacgtgacagtaggacgaaggttgacgtacgtaagttcggtcccgttcccgggttactaccggttttcgggaccgtaacgggggaaccctaaggtccgtagggaacgtactaaccgaaacgtaacggtaggtccggagtaccgg

SEQ ID NO: 56037 - DNA, 688 bp, Homo sapiens
  misc_feature: GYAE6OF02FPFU5.46.34.D01.1.454.CMB.1.raw
tcagactagcagtacacgaccggtgctcgatttagatcgtctgtgttgggtttgggctgatcaggactcctcagttcaccttctcgacaatgaggctccctcgctcagctcctggggctgctaatgctctgggtcccaggattcagtggggattgttgtgatgactcagtctccactctccctgcccgtcacccttggacagccggcctccatctcctgcaggtctagtcaaagcctcgtatacactgatggaaacacctgcctggattggtatcaccagcggaccaggccaatctccgaaggcgtaccttaatttataaggtttctaaccggtactcgtggggtcccagacagattcaggtgcgaggtgggtacgaggccacgtgagtccacaacgtagaaactcgaaggcggaaggggtaggacggtacgtaggtaacggttagttacggtttaaggttaaactttacgttacgtacgtacgtaacgtacggacggtaacggttacgaccttaccgttacggtttcccgggtacccgttacccgggtttaaccgttacccgggttttaccgggacccgggtaaaccggggtaacccctaaagggttacccgtaacgggtaacgtaaaccggttaacccggtaaaaccggttaaccggttaccgggttacggtacccgttaacccgg

SEQ ID NO: 56038 - DNA, 615 bp, Homo sapiens
  misc_feature: GYAE6OF02JGNNM.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctcgtatacactgatggaaacacctgcctggattggtatcacagccggaccaggccaatcctaccgaaggccgacctttaaatttaacgtaacggtttccgaaaccgggtactcggtcggggacccaggaccagtattcgagtggacagtgtcgagcactgagtcactactagaaatcgagcgagggtagaggcgtaggaggtagttaggttacggtaatttacttacgtgacgagtagacgtaaggtcgactacgtagttacggcccgttacggttaccgttacgttttcgggaccggtaacggggtaacctaagggtaccgtacgggtaacgtaacgttaccggaaaaccggttaacggttcggtacggtaccgttaaccgg

SEQ ID NO: 56039 - DNA, 563 bp, Homo sapiens
  misc_feature: GYAE6OF02FFV43.46.34.D01.1.454.CMB.1.raw
  modified_base (351)..(351): a, c, t, g, unknown or other
  misc_feature (351)..(351): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaacacctgcctggattggtatcaccagcggccaggccaatctccaaggcgactaattataagtttcaaccgggtactcgtgggtccagacagattcagtgcngtgggtcaggcactgattcacactagaaatcagcgagggtggaggctggaggtatggttaggtaattttagttacgtgcgtatgacgaaggttcgactacgaagtttcggacccgttccggttcgttacgttttcggacccggtaacgggggaacctaacggtcgttaggaaggtactaaccgaaaccggaacgttcggtacggtctaccgg

SEQ ID NO: 56040 - DNA, 649 bp, Homo sapiens
  misc_feature: GYAE6OF02I33TO.46.34.D01.1.454.CMB.1.raw
  modified_base (256)..(256): a, c, t, g, unknown or other
  misc_feature (256)..(256): n is a, c, g, or t
tcagactagcagtacacgaccggtgctcgatttagatcgtctgtgttgggtttgggcgtgatcaggactcctcagttcaccttctcacaatgaggctccctgctcagctcctgggctgctaatgctctgggtcccaggattcagtggggatgttgtgatgactcagtctccactctccctgcccgtcacccttggaccagccggcctccatcctcctgcaggtctagtcaaagcctcgtatacactgatggaaacncctgcctggattggtactcgaccagccggccaggcccaatcctccgaaggccgtacccttaatttacgtaacggtttcctaaaccgggtactcgtcggggtacccaagtacgacgtactttccgaaggtcggacgtaggttacgggtaccagggtccgtaacgttcggaagtttccaacgtacgtagaaaacttccgagacgtaagggtacggaaggtccgtaggacggtaagttggttaggttaagtttacgttacgtgacgtagtacgacgtaaggtgactacgtaagttcggaccgttccgtcttaccgttttcggaccggtacggggaacctaggtacgttacggaaggtaccgttacgaaaccggtacgtacggtacggtccgtaacg

SEQ ID NO: 56041 - DNA, 611 bp, Homo sapiens
  misc_feature: GYAE6OF02IZ6MY.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcacagcggccaggccaatctccaaggcgacctaattataaggtttctaaccgggactcgtggggtcccagacagattcagtggcaggtgggtcaggcactgagttcacactagaaatcagcgagggtaggaggcgtaggaggtagttaggttaggtaaattttattaacgtggtctaagtacgacgtaaagggtgtaccgtaacgtacgtttacggtccgttacccgggttcctaaccgtttttcgggacccggtaacgggggtaacccaaacgggtccgttacgggaacgtaacgttaaccgaaaaccggtaaccgttagggttacggtaccgttacgg

SEQ ID NO: 56042 - DNA, 605 bp, Homo sapiens
  misc_feature: GYAE6OF02ITM64.46.34.D01.1.454.CMB.1.raw
  modified_base (380)..(380): a, c, t, g, unknown or other
  misc_feature (380)..(380): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgataggaaacactgccgtgattggatcacagcgccagccaatcacagcactaattataaggttcaacggtactcgtcgggtacccagactaagattacgagtgacgtaggtgggtacaggcacgtgtagtaccaanactagaaatcgagtacgagggtgaggcgtaggtaaggtattacggttaaggtaaatttaacgttacgtagtacgagttacgacgtaaagggtcggactaagttcgtttaccggacccgttccggttaccgttacgtttttacggaaccgggaaccggggtaaccaacggcgttagggaacgtaacgtaaccgaaaaccggtacttagggtaccggtacgtaaccg

SEQ ID NO: 56043 - DNA, 592 bp, Homo sapiens
  misc_feature: GYAE6OF02FPUXY.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagccggccaggccaatctccaaggcgcctaattataaggtttctaaccgggactctgggtcccagacagattcagtgcagtgggtcaggcacgtgagttcacactagaaaactcgagcgaggggtggaggcgtaggaggtagtggttaggtaatttagttacgttgactataggacgtaagggtcgactaacgtagtttcgggaccgttccgggttaccttacgtttttcgggacccggtaacgggggaaccctaacgggtccgttacgggaaggtacgtaaccgtaaaaccggtaacgtggtacggtacgtaccgg

SEQ ID NO: 56044 - DNA, 539 bp, Homo sapiens
  misc_feature: GYAE6OF02JJCAU.46.34.D01.1.454.CMB.1.raw
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (416)..(416): a, c, t, g, unknown or other
  misc_feature (416)..(416): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcacagcgcagcaatcncagcnctaattatagttcacggactcgtgggtccagacagattcagtgcagtgggtcaggcacgtgagttcacactagaaatcagcgaggtggaggcgtgaggtagtggttagtaattaattacgtganatagacgtaacggtgacgactagttcggcccgttccgtcttacgttttcggacccggtacggggtaacccaaggtcgtaggtaaggacgtacgaaaccggtactacggtacgtaccgtaccgg

SEQ ID NO: 56045 - DNA, 563 bp, Homo sapiens
  misc_feature: GYAE6OF02GT8Y6.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatcctccaaggcgcctaatttataaggtttctaaccgggactctggggtcccagacagattcagtggcaggtgggtcaggcacgtgagttcacactgaaaatcagcgagggtggaggcgtaggaggtatggttaggaatttattactgctatgcaaggtgacgtactagttcggtccgttccggtaccgtacgttttcggcccggtaaggggaaccctaaggaccgtagggtaacgaacgtaccgaaaaccggtaacgtcggtacggtctaccgg

SEQ ID NO: 56046 - DNA, 891 bp, Homo sapiens
  misc_feature: GYAE6OF02G4CTV.46.34.D01.1.454.CMB.1.raw
tcagactagcagtacacgaccggtgctcgatttagatcgtctgtgttggggtttgggcgtgatcacggaacctccgtcagttcaccttctcgacaatgagggcctcctgctcagcctccgtgggctgctaatgctctgggtcccaggattcagtggggatgttgtgatgacttcacgtctccactctccctcgcccgtcaccttggacagccggctccatctcctgcaggtctagtcaaacgcctcgtataccacgtgaattagggaaaactaccttagtcccgtaggtacgttggtaatccgaacccgaagggtaccgggccccgaaggggacccaaacttcccgttaccgaaagggtccgtacccgttaaagttttaacgtaaacgggtttttaccctaaaaccggggtacttaaccgttacggggggtaccccctaacggtaacccgtaaggtacttaccggtaagggttacgggtcggtaagggttcgggggttaccgaacggggtacctaaccgtttcggtaacggtttaccaaccgtaacgttacggaaaaacgtccgaaacggtcccgtaagggggtacgggaacgggtcccgttagggaaacggggttaactttagggttttacgggtaaactttttaacgtttaaccgttaggttacccgttaaggttaccggtaaccgtaaagggttacggtaccgttaaaccgttaaccggttttaccgggtacccgtttacccgggttaaccgtttacccgggttttttaccggggacccgggttaaaccgggggtaacctaaacggggtaccggttaacggggtaacgtaacggttaacccggaaaaccggttaacggttacgggttacgggtacccgttaacccggg

SEQ ID NO: 56047 - DNA, 589 bp, Homo sapiens
  misc_feature: GYAE6OF02FY2AC.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtggggtcccagacagattcagtggcagtgggtcaggcactgagttcacactagaaatcagcgagggtggaggctggaggtatggttaggtaattttagttactgactagtgacgtaagggtcgactaacgtagttcggtcccgttccgggttaccttacgttttcgggcccggtaacgggggtaacctaaacgggccgttagggacggtaactaacccgtaaaaccggtaacgttacgggtacgggtaccgtaaccgg

SEQ ID NO: 56048 - DNA, 618 bp, Homo sapiens
  misc_feature: GYAE6OF02H7GYN.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagtcctgtatacactgaatggaaaccacctgcctggattggtatccaccagcggcccaggccaatccaccgaaggccaccttaaatttagtaacggtttcaaccgggctcgtacgggtcccagacagtattcgagtggcaggtgggtcaggctacgtgacttcactactagaaatcgagacgagggtaggaggcgtaggagggtattaggttaggttaagttttacttacgtgtacgtataggtacgtaaggtcgtacctacgttacgttcggtacccgttaccggttaccgttacgttttaccggaccggtaacggggtaacccgtaacggtacggttacgggacgtacgtaaccgaaaccggtaacgtacggttacggacgtaccgg

SEQ ID NO: 56049 - DNA, 518 bp, Homo sapiens
  misc_feature: GYAE6OF02GXRVA.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaatcagcagggtggaggctgaggatgttggaatttatactgctatgcaaggtgcacgattcggccttccggtctacgttttggccgtaggggaccctaaggcctggagacgtcgaaacgacgtgtacggctacgg

SEQ ID NO: 56050 - DNA, 551 bp, Homo sapiens
  misc_feature: GYAE6OF02F3DNX.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggtactcgtggggtcccagacagattcagtggcagtgggtcaggcactgagttcacactgaaaatcagcgagggtggaggcgtagaggtagtgttaggtaatttagttactgtactagtagacgtaaggtgacgtacagttcggccttccggtcttacgttttcggaccgtaacggggtacctaacggcgtaggagactacgaaacgtaacgtggtaggtcgtacgg

SEQ ID NO: 56051 - DNA, 566 bp, Homo sapiens
  misc_feature: GYAE6OF02GP5PD.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccgttggacagccggcctccatcctcctgcaggtctagtcaaagcctgtatacactgatggaaacacctgcctggattggatcacagcggccaggccaatctcaggcgcctaattataaggtttctaacgggactctggggtcccagacagatcagtgcaggtgggtcaggcatgagttcacactagaaaatcaagcgagggtggaggctgaggtagtgttaggtaatttattacgtagacgtaagtagacgtaaggtgacaacgtagttcggaccgttaccggtccgttacgttttacgggaccggtaacggggtaacctaacggtacgttacggaagtacgtaacgtaaacggtaacgtcggtacggtctaccgg

SEQ ID NO: 56052 - DNA, 676 bp, Homo sapiens
  misc_feature: GYAE6OF02G5PP2.46.34.D01.1.454.CMB.1.raw
  modified_base (254)..(254): a, c, t, g, unknown or other
  misc_feature (254)..(254): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacncctgcctggattggtatcaccagccggaccaggacccaatcctaccgaaacggccgtacccttaaattttacgttaaacggtttaccgtaaacccggggtacttccgtacggggtacccaaggacagtattccgaaggtcgggacctagggttcggggtaccaacgggcctacgttggtaacggtttccaacgtaacgtaggaaaatccgaagggacgtaagggggtggaggtcgtaggaagggttagttaggtttaggtaaattttaagttactggtactagtagacgtaagggtgacgtacgttacggttcggtccgttccgttacgttacgtttcgggacccggtaacggggtacctaacgggtcgttagggaacgtaacgtaccggtaaaccggtacgttacgggtacggtactacgg

SEQ ID NO: 56053 - DNA, 595 bp, Homo sapiens
  misc_feature: GYAE6OF02FX9V0.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggccgcctaatttataaggtttctaaccgggactcgtggggtcccagacagattcagtggcagtgggtcaggcactgattcacactgaaaatcgagacgagggtgggaggcgtggaaggatggtttaggtaattttagttactgtacgtataggtacgtaagggttgacgtaactacgttcggtcccgttccgggttacctaccgtttttcgggacccggtaagggggtaaccctaagggtaccgtgggaagtacgttaaccgaaaacggtaaccgtcggttacgggccttaacccggg

SEQ ID NO: 56054 - DNA, 606 bp, Homo sapiens
  misc_feature: GYAE6OF02ITEQ8.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaaccacctgcctggattggtatcaccagcgccaggccaatcctccaagccacctaatttataaggtttctaaccgggactcgtcgggtccagacagacttcagtggctagtgggtcaggcacgtgagttcacactagaaatcagcgagggtggaggcgtaggaggtagtaggttaggtaatttagttactagtctagttagacgtaaggtgaccgtaacgttacgttcggtcccgttccgggttaccgttaccgtttttcgggacccggtaacggggtaacccgaacgggtacgtacgggtaacgtaacgttaaccgtaaaaccggtaacgttacggttacgggtaccttaccggg

SEQ ID NO: 56055 - DNA, 619 bp, Homo sapiens
  misc_feature: GYAE6OF02ID2A4.46.34.D01.1.454.CMB.1.raw
tcagactagcagtacacgaccggtgctcgatttagatcgtctgtgttggggtttgggctgactcaggactcctcagttcaccttctcacaatgacggctccctgctcaggctcctgggctgctaatgctctgggtcccaggattcagtgggatgttgtgatgactcacgtcctcccactcctccctgcccgttccacccttggacacgccggcctccatctcctgccaggtctacgtacaaagtcctacgtatacgactgataggaaacactgaccgtggattcggtatcaccgagcgccaggtaccaatcctacctaaggcctaccgttaaagtttactaaggtttaccgtaaacgggtactcgtcgggtcccaagacgatagttcgagtggacgaggtgggtcaggcacgtggacgttcacactagaaaactcgagtacgtaggggtgaggcgtagtaggtagttgtaggtaatttagttacgagtactagtagaccgtaaggtcgacgtaacgtagttacggaccttacccggtactaccgttttggaccggaacgggtaccacggaccgtaggtacgtaacgtacgtaaacgtaaccgtcggttaccgcgtaccg

SEQ ID NO: 56056 - DNA, 594 bp, Homo sapiens
  misc_feature: GYAE6OF02F1UZA.46.34.D01.1.454.CMB.1.raw
  modified_base (271)..(271): a, c, t, g, unknown or other
  misc_feature (271)..(271): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtcacccttggacagccggcctccatctcctgcaggtctagtcaaagcctcgtatacactgatggaaacacctgcctggattggtatnaccagccggccaggccaatctccaaggcgcctaatttataaggtttctaaccgggactcgtggggtcccagacagattcagtggcaggtgggtcaggcacgtgagttcacactagaaatcagcgaggggtggaggcgtaggagggagtggttaggtaaattttagttacgttaggctaagtggtacaagggttcgaccgtagtagttcggacccgttaccgggtccgttacgttttcgggacccgtaacgggggtaacctaaggccgttacgggaaggtacgttaccgtaaaaccggtaacgttacgggttcggacgtaccgg

SEQ ID NO: 56057 - DNA, 577 bp, Homo sapiens
  misc_feature: GYAE6OF02FLXBL.46.34.D01.1.454.CMB.1.raw
  modified_base (276)..(276): a, c, t, g, unknown or other
  misc_feature (276)..(276): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccctggacagccggcctccatctcctgcaggtctagtcaaagcctcgtatacactgatggaaacacctgcctggattggtatcaccancggccaggccaatctccaaggcgcctaatttataaggtttctaaccgggactctggggtcccagacagattcagtggcagtgggtcaggcactgagttcacactgaaaatcagcgagggtggaggctgaggtatgttggtaaatttattactgactagtagacgaaagggttgactacagtttcggcccgttcccgggttacttaccgttttcgggacccgtaacggggggaaccctaaagggtccgttagggaaggtaactaaccgaaaaaccggtaacctgggttacggtcgtaaccgg

SEQ ID NO: 56058 - DNA, 566 bp, Homo sapiens
  misc_feature: GYAE6OF02HBJFI.46.34.D01.1.454.CMB.1.raw
  modified_base (389)..(389): a, c, t, g, unknown or other
  misc_feature (389)..(389): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactcgtggggtcccagacagattcagtggcagtgggtcaggcatgagttcacactagaaaatnagcgagggtggaggctggaggagtggttggtaaatttattacgtgctagtgacgaaggtgcaacgtagttggcccgttccgggttaccttacgttttcgggacccggtaagggggtaacccaaggtccgtagggagtaacgttaccgaaaaccggtaacgtcggtacggcgtaccgg

SEQ ID NO: 56059 - DNA, 573 bp, Homo sapiens
  misc_feature: GYAE6OF02HO11G.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggatttggtatcaccagccggccaggccaatcctccaaggcgcctaatttataaggtttctaaccgggactcgtggggtcccagacagattcagtgcagtgggtcaggcactgagttcacactagaaaatcagcgagggtggaggcgtgaggattggtggtaatttatacgtgctatgacgtaaggtcgctaacgtagtttacggccgttccggtacctacggttttacggcccgtaagggggaccctaaaggtccgtacgggtaagaacgttaccgaaaaccgtaaccgttacggttacggacttaccggg

SEQ ID NO: 56060 - DNA, 581 bp, Homo sapiens
  misc_feature: GYAE6OF02GT960.46.34.D01.1.454.CMB.1.raw
  modified_base (407)..(407): a, c, t, g, unknown or other
  misc_feature (407)..(407): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctcgtatacactgatggaaacacctgcctggattggtatcaccagccggccaggccaaatcctaccgaaggccgtacctaaatttaataacggtttctaaccgggactcgtcggggtccagacgagtatcagtggcaggtgggtcaggcagtgagttcacactagaaaactcgagngaggggtggaggctaggaggtattggttagtaatttatacgtgatagtgacgaaggtgacacgtacgttcggtaccgtccggttctacgttttcgggaccggaacggggtaaccaacggtcggtaggaagtaacgtaccgaaaaccggtaacgttcggttacgggacttaccgg

SEQ ID NO: 56061 - DNA, 537 bp, Homo sapiens
  misc_feature: GYAE6OF02GLFTD.46.34.D01.1.454.CMB.1.raw
  modified_base (254)..(254): a, c, t, g, unknown or other
  misc_feature (254)..(254): n is a, c, g, or t
  modified_base (291)..(291): a, c, t, g, unknown or other
  misc_feature (291)..(291): n is a, c, g, or t
  modified_base (533)..(533): a, c, t, g, unknown or other
  misc_feature (533)..(533): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacncctgcctggattggtatcaccagcgccaggccaatcnccaaggcgcctaatttataaggtttctaaccgggactcgtgggtcccagacagattcagtggcaggtgggtcaggcacgtgagttcactactagaaaatcgagcgagggtggaggcgtggaggtagtggtttaggtaatttagttactggcagtgcgaaggtgacatagttcggccgttccgtactacgtttcgacgacgggaaccaggtcgtaggagactacgaaacgtacgtggtacggntacg

SEQ ID NO: 56062 - DNA, 931 bp, Homo sapiens
  misc_feature: GYAE6OF02IR9G4.46.34.D01.1.454.CMB.1.raw
tcagactagcagtacacgaccggtgctcgatttagatcgtctgtgttgggtttggggcgtgatcaggacgtcctcctagttccaccgttctccaacgaacttcgaggtcgtccctgtcctacgacgcctccgtggggcctacgactaaagtcgtcctacctgggtcccgaaggtaggttcaggtgggggattgggttttcgttggtagttagttaacgtacgtagttcctaccgtacgttccgtacccgtcggccccgtaccgtaccccgtttggggaccgacggtcccgggtcccgggtaccgtacgtttccgttcccgtacggcccgtacgggggttcccttacggtaccgaaaacggtcccgttccgttacgttacgtacgttcgtacgttagggaaaacctacctacggttaacctacggtaatttgggtattcgaccgacggtccgggtcccgacggaccgaacttccgtaccggaaacggggtccgtaccgttaagttttacggttaacgggtttacccgtaaaccgggtacttaaccggtacggggtaccctaaggtaaccgtaaggtaacgttaaacgtagggtttacgggtacggtaacggttcggggtacgtaagggtaaccggtaccgttacggtaccggttacccaactaaccgtttaacgaaaacgttccgaaacggtaccgaacggggtaacgggaacggtaccgtaaggttaacggtacgtttacggttaacgttaaaattttacgtaaacgtacgtaccgtaaggtacggtacggtaaacgggtagaaccgtaacgtacggtttacggtaccgttaccggttacgttacggtttcggaccggtaacgggtaacctaaggtccgtacgggaagtaacggtacgaaaaccggtacgtacggtaccggtcgtaaccgg

SEQ ID NO: 56063 - DNA, 627 bp, Homo sapiens
  misc_feature: GYAE6OF02GC8Y4.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagtcctacgtatacactgataggaaacacctagcctggattggtatcaccaggccgaccaggaccaatcctaccgaacgggccgtaccttaaagtttacttaaacggtttccgtaaaccgggacttcggtcggggtacccagaaccgagtacttaccgaggtcggacgtaggtgggtcgaaggctacgtgacgttacactaacgtagaaaatcgacgacgaagggtggaggcgtaggaggtagttggttaggttaatttagtactagtctagtagacgtaaggtgactacgtgttacgtccgttccggttacgttacgtttcggaccggtaacggggtaaccgaacggtcgtacggaagtacgtaacgtaaaccggtacgtcggtacggtacgtaccg

SEQ ID NO: 56064 - DNA, 606 bp, Homo sapiens
  misc_feature: GYAE6OF02IM7RE.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatctcctgcaggtctagtcaaagcctgtatacactgataggaaacacctgcctggattggtatcaccagcggccaggccaatcctccaaggccgtacctaatttataaggttctaaccgggtactcgtgggcccagacagtattcgagtgcgaggtgggtcagggcacgtggtacgttacacctaactaagaaaactcgaaggcgtaaggggtagggacggacgtagggaaggtagttaggtttagggtaaactttttaagtttacgtggtactagtggtagtaagggtcgtacgacgttagtcggtaccgttccggttcttacggttttcgggaccggtacggggtaaccctaggtccgtaggagtacgtacgaaacggtacgtggtcggactcgg

SEQ ID NO: 56065 - DNA, 675 bp, Homo sapiens
  misc_feature: GYAE6OF02G8ACQ.46.34.D01.1.454.CMB.1.raw
tcagactagcagtacacgaccggtgctcgatttagatcgtctgtgttggggtttgggctgactcaggactcctcagttcaccttctcacaatggacggctccctgctcagctcctggggctgctatgctctggtcccaggattcagtggggatgttgtgactgactcagtctccactctccctgcccgtcacccttggacagccggcctccatctcctgcgaggtctacgtcaagcctacgtatactactgatggaaccactgacctaggattaggtactcaccagcggtccaggtccaatcctccgtaaggccgaccttaagtttagtaacggtttcctaaccgggtacttcgttcggggtacccaggtaccagtacttcgaaggtcggactagggtgggtcaggtcactcggagttccaacgtacctagaaaacttcgaggtacgagggtaggtaggccgttaggtacggtagtttggttacggtaaattttagttaacgtgtacgtaacgttcgtaccgtaaggttcggtacgtaccgtagttcgggtacccgttaccgggtaccgttaccgttttcgggacccggtacgggggtaaccctaacgggtaccgttaagggtacgtaacgttaccgtaaaccggttacggtacggttaccgggtacctacccgg

SEQ ID NO: 56066 - DNA, 604 bp, Homo sapiens
  misc_feature: GYAE6OF02GYF1Y.46.34.D01.1.454.CMB.1.raw
  modified_base (417)..(417): a, c, t, g, unknown or other
  misc_feature (417)..(417): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgataggaaacacctgcctggattggtatcaccagccggccaggccaatcctccaaggccgacctaatttaataacggtttctaaaccgggactcgtacgggtcccagacagattcgagtggcagtggtcaggcacgtgagttcacactagaaatcgagacgagggtggagggngtaggaggtagttaggttaaggtaatttagttacgtagtctaagtcgacgtaaggtcgactaacgtgttacggtcccgttaccggttcttaccgttttcgggacccggtaacggggtaacctaacgggtaccgttagggaacgtaacgtaaccggtaaacggtaacggttaggtcggtactacccgg

SEQ ID NO: 56067 - DNA, 574 bp, Homo sapiens
  misc_feature: GYAE6OF02G7V73.46.34.D01.1.454.CMB.1.raw
  modified_base (255)..(255): a, c, t, g, unknown or other
  misc_feature (255)..(255): n is a, c, g, or t
  modified_base (405)..(405): a, c, t, g, unknown or other
  misc_feature (405)..(405): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctacgtatacactgatggaaacncctgcctggattggtatcaccagccggccaggccaatctccaaggcgcctaatttataaggtttctaaccgggtactcgtcggggtcccagacagattcagtggcaggtgggtcaggcacgtgagttcacactagaaaatcagcgagggnggaggcgtagaggagttggttaggtaatttagttactgactagtagacgtaagtcgacgtacgtacgttcggacccttccggtaccttacgttttacggaccggtaacggggtaaccgtaacggtccgtaggacgtacgtacgaaaccgtacgtggtacggacgtacgg

SEQ ID NO: 56068 - DNA, 597 bp, Homo sapiens
  misc_feature: GYAE6OF02HQ4NY.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccgcctccatctcctgcaggtctagtcaaagcctgtatacactgatggaaacacctgcctggattggtatcaccagcggccaggccaatcctccaaggccgacctaatttataaggtttctaaccgggactcgtcgggtcccagcagattcgagtggcaggtgggtcaggcacgttgagtttaccactactagaaaacgttcagcgaggggtggagggactggaggtagttggttaaggtaattttagttactgactagtgacgtaaggtcgacacgtagttcggtcccgttaccggttaccttacgttttcggacccggtaacggggaaccctaagggtaccgttacgggaagtaacgttaaccggaaaccgtaacgtacggtacggtccgtacgg

SEQ ID NO: 56069 - DNA, 626 bp, Homo sapiens
  misc_feature: GYAE6OF02HX5C1.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacactgcctgattggtatcaccagcggccaggccaatctccaagcgcctaatttataaggttctaaccggactcgtcgggtacccagacagattcaggtggcagtgggtcaggcacgtgacgttcaacactagaaatcaggacgaggggtggaggcgtggaaggtcttagggttaggtaaattttagttactgtacgtatgtaccgtaagtcggtcaacgtcgttaggaccccgtttcccgggtacttaccgtttttacgggacccgggtaaacgggggtacccgtaaaggtcccggtttaagggtaaccggtaacgttaacccgggaaaaaaccggttaaccggttacgggttccgggtaaccgttaacccggg

SEQ ID NO: 56070 - DNA, 574 bp, Homo sapiens
  misc_feature: GYAE6OF02HRU6B.46.34.D01.1.454.CMB.1.raw
  modified_base (425)..(425): a, c, t, g, unknown or other
  misc_feature (425)..(425): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatctcctgcaggtctagtcaaagcctcgtatacactgataggaaaccacctgcctggattggtatcaccagccggccaggccaatcctccaaggccgtaccttaatttagtaaggtttcctaaccgggactcgtcgggtcccagacagattcgagtggcaggtgggtcaggcagtgagttcactactagaaatcagcgagggtggaggcgtgaggngttggtagttaatttatacgtgcgtatgacgtaaggtgacacgtagttcggccgttaccggtcttacgtttcgggaccggtaaggggtaccctaaggtcggtaggacgtaacgtaccgtaaaccggtacgttacgggtcggtactacgg

SEQ ID NO: 56071 - DNA, 522 bp, Homo sapiens
  misc_feature: GYAE6OF02I97QP.46.34.D01.1.454.CMB.1.raw
  modified_base (518)..(518): a, c, t, g, unknown or other
  misc_feature (518)..(518): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcacgtgagttcacactgaaaatcagcagggtgaggcgtgaggatgttaggaatttattactgcatgacaaggtgcacgtagttggccctccggtctacgtttcggccgtaggggaccaaggcgtggtagagtacgaaaccgtatggtcggntacg

SEQ ID NO: 56072 - DNA, 641 bp, Homo sapiens
  misc_feature: GYAE6OF02H6SFO.46.34.D01.1.454.CMB.1.raw
  modified_base (284)..(284): a, c, t, g, unknown or other
  misc_feature (284)..(284): n is a, c, g, or t
  modified_base (345)..(345): a, c, t, g, unknown or other
  misc_feature (345)..(345): n is a, c, g, or t
tcagactagcagtacacgaccggtgctcgatttagatcgtctgtgttggggttttggggcctggatcgtacggacttacctcagttccacccttctcacaatgtaggctccctgcctcagctacctggggctgctaactggctctcgggtccccagggattcagtggggatgttgtgatgactcagtctcctactctccctgccggtccacccttggacgagccggcctccatactcctgcaggtctagtcaaagccgtcgtagtacacgtgaatcggaaaccncctagcccctggacttcggtatccaccgagccggcctaggccgaagtctccaaacgggtcncccgttaaatttaataaggttcctaacgggactcgtagggtcccaggacagtcttcgaggtcggctaggtgggtcaggcgagtgagtttcaacgacgtacgaaaatcgaggacgtagggtggaggtctggaggagttggttaggtaatttagtaacgtgacgtaagtggacgaaggttcgactactacgtaccggtaccgtaccgtacttacgttttcggaccgtaacggggtacctaaggtcgttagggacgtaacgttaccgaaaccggtacgttacggtaccggacgtaccgg

SEQ ID NO: 56073 - DNA, 582 bp, Homo sapiens
  misc_feature: GYAE6OF02IT8WZ.46.34.D01.1.454.CMB.1.raw
  modified_base (368)..(368): a, c, t, g, unknown or other
  misc_feature (368)..(368): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatcctccaaggccgaccttaatttataacggtttctaaccgggctcgtgggtcccagacagattcagtggcagtgggtcnggcagtgagttcacactagaaaatcagcgagggtggagggcgtagaggtagttgggttaggtaagttttattactgactagtagacgtaaggtcgtacacgtagttcggtcccgttccggttaccttacgttttcggacccggtaacggggtaacccgtaacggaccgttaggagtaacgtacgtaaaccggtaacgtcggtaggcgttaccgg

SEQ ID NO: 56074 - DNA, 675 bp, Homo sapiens
  misc_feature: GYAE6OF02FVN0O.46.34.D01.1.454.CMB.1.raw
  modified_base (259)..(259): a, c, t, g, unknown or other
  misc_feature (259)..(259): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtcacccttggacagccggcctccatctcctgcaggtctagtcaaagccctcgtactacctacctgactcgaaacncctgccgtggacttcggtactcaccgagccggaccgacggcccaagtcctaccgaacggccgtacccttaaagttttaacttaaacggttttcccgtaaacccggggtacttccgttacgggggttaccccaaggaccgtaacggtactttaccgagggttacggccgtaggtcgggtacgaggccacgtgacgttcaacactagaaactcagcgagggtgaggcgtaggacggttgtaggttagttaaagtttattactgtactagtacgacgtaaggttgacgtaacgtagttcggcccgttaccggttcttaccgttttcgggacccggtaacggggaacctaacggtccggttagggtaacgtacgtaaccggtaaaaccggtaacggttacggtcgggtaccgttaaccgg

SEQ ID NO: 56075 - DNA, 625 bp, Homo sapiens
  misc_feature: GYAE6OF02G5MT3.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatcctcctgcaggtctagtcaaacgcctcgtatacactgataggaaacacctgcctggattggtatcaccagcggccaggccaatcctaccgaaggccgtacctaatttataaggtttctaaccgggactcgtgggtcccagacagtattcgagtggcaggtgggtcaggctacgtgtacgttcacacgtagaaactcgaggcgaggggtaggagggcgtaggaggtagttaggttaaggttaatttaagtttacgtagtaccgtagtacgacgtaaagggtgaccgtaacgttacggttcggtcccgttaccggttaccttacggttttccggaccggtacggggtaaccctaacggtccgtacggtaacgtaacgtaaccggaaaccgtaaccgtggttacggaccgttaaccgg

SEQ ID NO: 56076 - DNA, 645 bp, Homo sapiens
  misc_feature: GYAE6OF02JZI6N.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggcctccatctcctgcaggtctagtacaaagcctacgtatacactgactacggaacacctgcctggtattggtactcaccgagccggccgacggaccaactcctaccgaaggccgtaccttaaatttacgtaacggtttacctaaccgggtctaccgtcggggtacccaggactagtacttcgacggttggacgtaggttcgggtacgtaacgggctaacgtggttacgttaccgaacgtactaaggaaaactcgaacggacgaggggtacggaggcgtaggaggtagtggttagtaatttaagtactgatagtagtacgtagtacgacgtactacgttcggaccgttccgttacttacggtttacggacccggtaacggggtaaccgtacggtcgtaaggagtaacgtaacggaaccggtaacggtcggacggtctaaccgg

SEQ ID NO: 56077 - DNA, 585 bp, Homo sapiens
  misc_feature: GYAE6OF02GKZB2.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctcgtatacactgatggaaacacctgcctggattggtatcaccagcggccaggccaatcctccgaaggccgaccttaatttagtaacggtttcctaaccgggactcgtcggggtcccagacagtattcagtcggcaggtcgggtacaggctaacgtgacgttcacactagaaatcgagcgagggtggaggtcgtaggaggtattaggttagtaaattttattacgtgacgtagtagacgtaaggttcgacgtacgtagttcggaccgttccggtacttacgtttcggaccggtaagggtacctaaggtccgtaggacgacgtaacgaaaccggtacgtacggtacggcgtacgg

SEQ ID NO: 56078 - DNA, 562 bp, Homo sapiens
  misc_feature: GYAE6OF02JXYGX.46.34.D01.1.454.CMB.1.raw
  modified_base (423)..(423): a, c, t, g, unknown or other
  misc_feature (423)..(423): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggacttggtatcaccagcggccaggccaatctccaaggcgcctaatttataaggtttcctaaccgggtactcgtcggggtaccccagaccgagtattcaggtggacgagtgggtcaggcacgtgacgttcacactagaaaactcgaagacgagggtggaggngtagaggagtgttagtattatatgatagtagcgaagtcacgaacgtagtcgaccgttccgtcgtacgtttggaccgaacgggtaccaggtcctagggtaacgtacgtaacgaaccgtaacgtcgggtacggacgtacgg

SEQ ID NO: 56079 - DNA, 591 bp, Homo sapiens
  misc_feature: GYAE6OF02FVW12.46.34.D01.1.454.CMB.1.raw
tcagactagcagtacacgaccggtgctcgatttagatcgtctgtgttgggtttgggctgatcaggactcctcagtttaccttctcacaatgaggctccctgctcagctcctgggctgctaatgctctgggtcccaggattcagtggggatgttgtgatgactcagtctccactctccctgcccgtcacccttggacagccggctccatctcctgcaggtctagtcaaagcctcgtatacactgatggaaaccacctgcctggattggtatcaccagcgccaggccaatctaccaaggcgcctaaatttataaggtttctaaccgggctcgtggggtcccagacagtacttcgagttcgggctaggtgggtcaggcactgtacgttcacactagaaatcagcgtagggtggaggcgtggagtagttaggttaggtaatttagttaactgtcgagtgacgaagggtacgacgtaacgtacgttcggccgttcccggttacgtacgttttcggaccgtaacggggaacccgtaacggtcgtacgggagtaacgtacctaaacggtaaccgtacggtacgtaccgtagtaacccg

SEQ ID NO: 56080 - DNA, 852 bp, Homo sapiens
  misc_feature: GYAE6OF02IOP2K.46.34.D01.1.454.CMB.1.raw
  modified_base (275)..(275): a, c, t, g, unknown or other
  misc_feature (275)..(275): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcagtggggatgttgtgatgactctagtctccactcctccctgcccgtcacccttggacacgcccgcctccacgtcctcctgcacggtctagtaccaaacgtccctacgtataccacgtgtacgtacggaaacnccctacgaccgtaggtacgttcggtaactccgaacccgaggtacccgggacccgaacgggtaccctaaaacttccccgaaccggaaaccgggcccgtaaccgtttaaaacgtttttaacgttaaaaccgggttttacccgttaaaacccggggtaacctttcccgggttaaccggggggttaccccccaaagggtaacccgtaaacgggtttaaccgtttacccggtaaccgggtttagggtaccccggttaaaggggtttccggggttaccggaaacggtacccgtacccggttaggtaaccgtttaccgaaccgtacccgtaaaggtaaaaccttacggtaacggtaccgggtaagggggtttacggaagggtaccgtagggtaaagggttacgtttacggtttaaggtaaatttttacggttacgtacggtagtaacgtacggtaacgtaaacgggttcacgttaaacgtggtttacccggcccgtttacgttccgttacgtttaccgggaccggtaaggtaacccaggtccgtaggaacgtagaaccgtacgtaacgtggttacgcgtaaccg

SEQ ID NO: 56081 - DNA, 560 bp, Homo sapiens
  misc_feature: GYAE6OF02GX2S5.46.34.D01.1.454.CMB.1.raw
  modified_base (467)..(467): a, c, t, g, unknown or other
  misc_feature (467)..(467): n is a, c, g, or t
  modified_base (555)..(555): a, c, t, g, unknown or other
  misc_feature (555)..(555): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatcctaccgaaggccgtaccttaaatttataacggtttctaaccgggactcgtcgggtcccagacagtatcgagtggcaggtggtcaggcactgagttcacactagaaaatcgagcgagggtggaggcgtaggaggtagttaggttaggtaatttagttactgctagtgacgtaaggtnacgtatgttcggaccgttccgtactacgtttcggaccggtaacggggaccaacggtcgtaggagtaactacgaaacgacgtggtcggngtacg

SEQ ID NO: 56082 - DNA, 648 bp, Homo sapiens
  misc_feature: GYAE6OF02H5JDS.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatctcctgcaggtctagtcaaagcctgtatacactgataggaaacacctcgcctggattggtatcaccacgcggccgacggaccaactctaccgaacggacgtaccttaaacttttaacgttaacggttttaccgtaaccgggtaccgttcggtcggggtacccacgacgacgtacttcgtaggtggcgtggtaaaagggtcgaggacacgtagtacgttcactactagaaatacgacgacgagggtaggaggcgtaggtaggtagttaggttaggttaagttttaagttacgtagtcgtagtagtacgtaggtacgacgtacgttacgttacggtcccgttccggttacgttaccgtttcggtaccgtaacggtacggaaccgtaaggtacgtacgggtacgaacgtaaccgaacggtaacgttcggtacggtaccgg

SEQ ID NO: 56083 - DNA, 709 bp, Homo sapiens
  misc_feature: GYAE6OF02INOKM.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctcctgcccgtcacccttggacagccggcctccatctcctgcaggtctagtcaaagcctacgtataccatcgataggaaacactgcctgattggtatcacgacgcgccaggccaatctaccaacggacgaccttaatttaagtaacggtttacgtaaccgggtactcgtcggggtcccaaggtacagtacttcaaggttggacgtaggttcggggtacgaacggtcgtacgtacggtaggttaccacgtaaaccggttagtaaaaaccttcgaaacggtacggtacgggggttaagggacgggtacgtacgggtaagggtagtttagggtttaggttaaagtttttagttaaccggtaggtacctaaggttaccggtacgtaaaggggttcgtacgtaacgttaacggttcggtacccgttaccgggtttcgtacggtttttccgggaccgtaacgggggtaacctaacgggacgtttacgggaacgttacgtaaccgtaaaacgttaaccggtacgggttacggtccgtaacgg

SEQ ID NO: 56084 - DNA, 559 bp, Homo sapiens
  misc_feature: GYAE6OF02H5G5D.46.34.D01.1.454.CMB.1.raw
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgtgtgatgactcagtctccactctccctgcccgtcacccttggacagccggcctccatctcctgcaggtctagtacaaagcctcgtatacactgatcggaaacacctgcctggattggtatcacgagcggacccaggccaatcctaccgaaggccgaccttaaatttattaaacggtttactaaccgggtactcgtcggggtcccagacagtattcgagtggcaggtgggtcaggcagtgtagttcacactagaaatcagcgagggtggagcgtgagtagtgttagtaatttatntagntagtagacgtaggtgactacgtagtcggtccgttccgtacttacgtttcggaccggtaaggggacctaggcgtacggagtacgtacgaaacggtactaggtcggctacg

SEQ ID NO: 56085 - DNA, 575 bp, Homo sapiens
  misc_feature: GYAE6OF02IJT5L.46.34.D01.1.454.CMB.1.raw
  modified_base (410)..(410): a, c, t, g, unknown or other
  misc_feature (410)..(410): n is a, c, g, or t
  modified_base (468)..(468): a, c, t, g, unknown or other
  misc_feature (468)..(468): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctgtatacactgatggaaaccacctgcctggattggtatcaccagccggccaggccaatcaccaaggcgaccttaatttataaggtttctaaccgggacttcgtcggggtcccagaccagacttcgagttggctaggtgggtcaggccagtgattacacatagaaatcgagagtagggnggaggcgtagaggtattggttagttaattttagtacgtgtactagtagacgtaaggtnacgtaactagttcggccttaccggtcttaccgttttcggaccggtaagggtaaccaggtacgtagggaacgtacgtaaccgaaacggtactaggtccggtacgtacg

SEQ ID NO: 56086 - DNA, 560 bp, Homo sapiens
  misc_feature: GYAE6OF02FWW3Y.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatcctccaaggcgacctaatttataaggtttcctaaccgggactctggggtcccagacagatcgagtgcagtggtacaggcatgagttcacactagaaatcagcgagggtgaggcgtaggtaggagtggttaggtaatttagttactgtactagtgacgtaaggtgactagtacgttcggaccgttccggtcgttacgttttcgggaccgtaacggggtaccaacggtcgtacggaagtacgtacgaaaccggtacgtcggtaggtcgtacg

SEQ ID NO: 56087 - DNA, 543 bp, Homo sapiens
  misc_feature: GYAE6OF02H22CQ.46.34.D01.1.454.CMB.1.raw
  modified_base (538)..(538): a, c, t, g, unknown or other
  misc_feature (538)..(538): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtccacccttggacagccggcctccatctcctgcaggtctagtcaaagcctgtatacactgatggaaacacctgcctggattggtatcaccagcggccaggccaatctcaaggccgaccttaatttataaggtttactaaccgggactcgtcgggtaccagacagtatcagtgcgaggtgggtcaggctacgtgagttcactacgtagaaatcagtacgaggggtggaggcgtaggaggtattggttagtaatttatacgtgactagtagacgtaagtgacacttagtcggccttcgtctacgtttcggacgaagggacctaaggcgtaggagactacgaaacgacgtgtcggntaccg

SEQ ID NO: 56088 - DNA, 584 bp, Homo sapiens
  misc_feature: GYAE6OF02GPIAF.46.34.D01.1.454.CMB.1.raw
  modified_base (294)..(294): a, c, t, g, unknown or other
  misc_feature (294)..(294): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagcccggcctccatcctcctgcaggtctagtcaaagcctcgtatacactgatggaaacacctgcctggattggtatcaccagcggccaggccaatcnccaagcgacctaatttataagttctaaccgggactcgtgggtacccagacagacttcgagtggacaggtgggtcaggcacgtgtacgttcacactagaaaatcgaagcgagggtggaggcgtaggaaggtagttagttaggtaatttagttacgtgtactagtagacgtaaggtcgactacgtacgttcggacccgttccggtaccttacgttttcgggaccggaacggggtaaccaacggtaccgtagggaatacgtaaccgaaaccgtacgtaggtacggctaaccgg

SEQ ID NO: 56089 - DNA, 605 bp, Homo sapiens
  misc_feature: GYAE6OF02GT1WM.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggccgaccttaatttataaggtttctaaccgggactcgtcgggtcccagacagattcagtggcaggtgggtcaggcacgtgacgttcacactagaaaatcagcgagggaggaggctaggaggtagttggttaggtaatttattaactgactagtacgtacgtaaggtcgactacgtaacgttcggtacccgttccgggttacgttaccgttttcgggacccggtaacgggggtaaccctaacgggtcgttagggaacgtaacgttaaccggtaaaaccggtaacggttacgggtacggtaccgtaccgg

SEQ ID NO: 56090 - DNA, 784 bp, Homo sapiens
  misc_feature: GYAE6OF02JN37D.46.34.D01.1.454.CMB.1.raw
tcagactagcagtacacgaccggtgctcgatttagatcgtctgtgttgggtttgggctgatcacggactcctacagttcaccttctcacaatgaggcctcctgctcagctcctgggctgctaatcgctcgtggtcccaggtacttcgaggtgggatgtgtgactgacctcacgtctccactctccctgcccgtcacccgttggacgacgcccggacctcaagtcctccgtggctacggtactagtaccgaaacgtccctaggtaactaccgacttggactacggaaacctcctgcctaggtattcgtaactccaccgtaggtccggaccaggaccctaagtcccctacggaaacggaccggtaccctttaaagttttacggtaaacgggttttacccgtaaacccgggggtaccttaccggttaccggggttaccccgaaagggtaacctacggggtagttaccgaaggttcggtaccgtaggttcgggtaccaagggtacctacgtacggtaaccgtttcgtaaccgtaacgttaacgtaaaacgttccgaaacggtccggtaaggggttacgggaacggtacgtaacggtaggttaggttaggttaaggttaacgtttacgttacgtacgtacgtaacgttacgacgtaacggtgtaccgtaacgtacgtacggtacccgttacggttacgttacgtttcggaccggtaacggggtaacctagggtaccgtagggtaacggacgttaacggaaaccggtaagtacggtacggtaccgtccgg

SEQ ID NO: 56091 - DNA, 568 bp, Homo sapiens
  misc_feature: GYAE6OF02HAUM8.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccccttggacagccggcctccatctcctgcaggtctagtcaaagcctcgtatacactgatggaaacacctgcctggattggtatcaccagcggccaggccaatcctccaaggccgacctaatttataagttttcaaccgggtactcgtgggtccagacagattcagtgcagtggtcaggcactgagttcacactagaaatcagcgagggtggaggcgtagaggatggttaggtaatttagttactgtcagtgacgtaaggtgacgtacagttcggaccgtccggttccgtacgttttcggaccggtaacggggtacccgtaaggtccgttagggaacgtaacgttaccgtaaaccgtaacgtacggtacggtacgtacgg

SEQ ID NO: 56092 - DNA, 756 bp, Homo sapiens
  misc_feature: GYAE6OF02HNKU7.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagcccggcctccatcctcctgcaggtctagtcaaagcctcgtatacactgatggaaacacctgcctggattggtatcaccaggcggcccaggcctaaatcctaccgaagggccgtacccttaaaatttttacgtaaacgggttttaccgtaaaccggggtaccttaccggttacgggggtaccccaacggtaccgtaacggttacgtttaccgtaagggttcgggtaccgtaagggttcgggggtaccgtaagggtacctaacgttacggacggttttaccaaccgttaacgtaaacgtaaaaacgttcgaacgggaccgtaagggggtcggggacggtccgtaggagggtagttacgggttaggttaaattttagtacgtaggtcgtaagttcgacgtaaggttcgacgtacgtacgttcggacccgttaccggttccgttacggttttaccggacccggtaacgggggtaaccctaaacgggtccgtttaacgggaagttaaccgtaaccggtaaaaccggttaacccggtttagggttaccggtaccgttaaccgg

SEQ ID NO: 56093 - DNA, 542 bp, Homo sapiens
  misc_feature: GYAE6OF02HKWHT.46.34.D01.1.454.CMB.1.raw
  modified_base (434)..(434): a, c, t, g, unknown or other
  misc_feature (434)..(434): n is a, c, g, or t
  modified_base (538)..(538): a, c, t, g, unknown or other
  misc_feature (538)..(538): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccccttggacagccggcctccatctcctgcaggtctagtcaaagcctcgtatacactgatggaaacactgcctggattggtatcaccagcggccaggccaatctccaaggcgcctaatttataaggtttcaaccgggactcgtgggtcccagacagatcagtgcagtggtcaggcactgagttacacactagaaaatcagcgaggtggaggcgtgaggatggttagtaatttagtactgcagtagngaaggtgacacgtagttcggccttaccgggtctacgtttacggccggtaacggggacctaacggtcgtagggtagaatacgaaaaccggtaacgtaggtacggntacg

SEQ ID NO: 56094 - DNA, 602 bp, Homo sapiens
  misc_feature: GYAE6OF02H2CYV.46.34.D01.1.454.CMB.1.raw
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (464)..(464): a, c, t, g, unknown or other
  misc_feature (464)..(464): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggatgttgtgatgactcagtctccactcctccctgcccgtcctacccttggacacgccggcctccatcctcctgctaggtctagtcaaagcctgtatacactgataggaaacnccncgcgtggattggtancaccgagcggcccaggaccaatcctacgagccgtacttaaagtttagtaacgtttccgaaccggtctcggtcgggtaccaagacagtatcgagtggacaggttggcaggtctacgtgtacgttcactactagaaatcgacgtgagggtggaggacgtaggaggagttgttaggtaatttatagngtactagtgtacgaagtcgacgtagtacgttcggacccttaccggttcgttacgttttcggaccggtaacgggtaaccgtacggtacgttacggaagtacgtaacgaaaccggtacgtttaggacggtccgtaaccgg

SEQ ID NO: 56095 - DNA, 607 bp, Homo sapiens
  misc_feature: GYAE6OF02GBGXP.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaacgcctacgtatacactgataggaaacacctgcctggattggatcacagcggccaggccaatcctaccgaaggcgaccttaaatttagtaaggtttccgtaaccgggcttcgtcggggtacccagacagtattcgaggtggacgtagtgggtcaggcacgtgacgttcaactacgtagaaaacttcgaagcgtaaggggtcggaaggtcgtaggtagggtattgggtttaacggtaattttattacgtgactagtgacgtaagggtgactaactagttacggtcccgttccggttaccgttacgttttgggtaccggtaacggggtaccaggtcgtaggaagtactacggtaaaacgacgtcggtacggtacgtaccg

SEQ ID NO: 56096 - DNA, 576 bp, Homo sapiens
  misc_feature: GYAE6OF02GGQPY.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgacctaatttataaggtttcctaaccgggactcgtcggggtcccagacagattcagtggcaggtgggtcaggcactgtagttcacactagaaaatcagcgagggtggaggctggaggagtggttaggtaatttattacgtgactagtgacgtaaggtgacgtaactagttcggcccttccgggtacttaccgttttacggacccggtaacggggaacctaacggacgttagggaagtacgtaaccgaaaaccggtaacgttcggtaggtcctaccgg

SEQ ID NO: 56097 - DNA, 599 bp, Homo sapiens
  misc_feature: GYAE6OF02ISZSN.46.34.D01.1.454.CMB.1.raw
  modified_base (334)..(334): a, c, t, g, unknown or other
  misc_feature (334)..(334): n is a, c, g, or t
  modified_base (405)..(405): a, c, t, g, unknown or other
  misc_feature (405)..(405): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacccttggacagccggcctccatctcctgcaggtctagtcaaagcctacgtatacactgatggaaacacctgcctggattggtatcacgagcggccaggccaatcctaccgaaggcgaccttaatttagtaaggtttcaaccgggntcgtcgggccagacagattcagtgcagtgggcaggcactgacgttcacactagaaatcagcgaggggtggnggctaggaggtagttaggttaggtaattttattactggtactagtaggacgtaaggtgactacgtaagttcggtacccgttccggttacgtaccgttttacgggacccggtaacggggtaacccgtaaggtaccggtagggtaacgtaacgtaaccgtaaaccggtaacgttacggtacgggtaccgtaaccgg

SEQ ID NO: 56098 - DNA, 621 bp, Homo sapiens
  misc_feature: GYAE6OF02FE3QN.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctcatctcctgcaggtctagtcaaagcctacgtatacactgataggaacacctgcctggattggtactcaccgagccggccacggccaatcctaccaacggccgtaccttaatttagtaacggttttaccgtaacccgggtacttcgtcggggtacccagacagtattcgaggtgcgtagtgggtacaggcacgtgacgttcacatagaaatcgagcgagggtggaggctaggagtatggtttagtaatttattacgtgtacataggacgtaaggtcgactacgtacgttacgggtcccttaccgggttaccgttacgtttacgggacccggtaaaccgggggtaaccaacggtccgttacgggaacgtaccggtaacgtaaaaccggtaccgtacggttaccgggtacctacccgg

SEQ ID NO: 56099 - DNA, 633 bp, Homo sapiens
  misc_feature: GYAE6OF02IQHHQ.46.34.D01.1.454.CMB.1.raw
  modified_base (250)..(250): a, c, t, g, unknown or other
  misc_feature (250)..(250): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccttggacagccgctcatctctgcaggtctagtcaaagcctagtatacactgataggaaacncctgcctggattgatcacagcgcagccaatcaccgaagcgtacctaaatttataacggtttctaaccggacttacggcggggttacccaagtaccgtaagtactttccgaagggttcggacgtaagggttcgggtacaacgggctaacgtggtaacgttaccaacgtaacgtaaggtaaaaactcgaacggtacggtaaggggtagggaacgggtacgtagggaggtaagttaggttacgggtaaattttaacgtacgtacgacgtaagtcggtacgtaagtgactacgtaagttcggtaccgttcgtacgtacgtttcggaccggtaacgggaacctaaggtcgtaggtagacgtacgaaacgtacgtcggtacgtctacgg

SEQ ID NO: 56100 - DNA, 114 bp, Homo sapiens
  misc_feature: GYAE6OF02F5SUT.46.34.D01.1.454.CMB.1.raw
  modified_base (107)..(114): a, c, t, g, unknown or other
  misc_feature (107)..(114): n is a, c, g, or t
tcagactagcagtacacgaccggtgctcgatttagatcgtctgtgttgggtttgggctgatcaggactcctcagttcaccttctcacaatgaggctccctgctcagnnnnnnnn

SEQ ID NO: 56101 - DNA, 559 bp, Homo sapiens
  misc_feature: GYAE6OF02GT20M.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatcctccaaggccacctaatttataaggtttctaaccggctcgtgggtcccagacagattcagtggcagtgggtcaggcagtgagttcacactagaaaatcagacgaggggtggaggcgtggaggtagtggttaggtaatttagttactgctagtgcgtaaggtgacacgtagttcggccgttccggttctacgttttcggaccggtaacggggtaccaaggccgttaggagtaactacgtaaaccgtaacgtacggttacggtactacgg

SEQ ID NO: 56102 - DNA, 780 bp, Homo sapiens
  misc_feature: GYAE6OF02ISIG3.46.34.D01.1.454.CMB.1.raw
  modified_base (196)..(196): a, c, t, g, unknown or other
  misc_feature (196)..(196): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctctggtccaggattcagtggggatgttgtgatgactcagtctccactctccctcgcccgtcacccttggacncgccggcctccatcctcctcgactaggtctagtacaaacgtcctagtactacacgtgacgtacggaaacctaccgtcgccgttggtattacgggtacttaccgaaccgaggtaccggacccgacggtacctaacgtcctaccgaacggaccgtacctttaaattttacgtaacggtttacccgtaaaccgggtcttcggttccggggttaccaagtacgtaagtacttacgaacggttggacgtaggtcgggtactacggactacgtgtacgttaccaacgtaacgtacgtaaaacgtcgaggtaccggtagggtacgggaggacgttagggaacggtaggtttagggttaacgttaagttttacgttacgtcggttaacgtacggtaacggtacgtaaacgggtacgtacccgttaaacgttcggtttaacccggcccggtttaccgggtttaccggttaaccgggtttccggggtaacccggtaaccgggggtaacctaacgggtaccgggttacggtaaacggttaccggtaaccgtaaaacccgggttacggttacgggttaccggtagttaaccccggg

SEQ ID NO: 56103 - DNA, 548 bp, Homo sapiens
  misc_feature: GYAE6OF02F4SFC.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctgtatacactgatggaaacacctgcctggattggtatcaccagcggccaggccaatctccaaggccgcctaatttataaggtttctaaccgggactctggggtcccagacagattcagtggcagtggtcaggcacgtgagttcacactagaaaatcagcgagggtggaggcgtagaggtatgttaggtaatttattactgtctatagcgaaggtgactactagttcggccttccggtactacgttttcggaccgtaaggggacctaaggtcgttaggagtacgtacgaaaccggtaacgtcggtacggtctacgg

SEQ ID NO: 56104 - DNA, 858 bp, Homo sapiens
  misc_feature: GYAE6OF02G0FIS.46.34.D01.1.454.CMB.1.raw
  modified_base (219)..(219): a, c, t, g, unknown or other
  misc_feature (219)..(219): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacccttggacagccggcctccatctcctgcnggtctagtacaaagcctcgtatacactgatggaaacacctgcctggattggtactcaccaggccggaccaggaccaagttcctacccgaaagggtccgtaccttaaattttaacgttaaacgggttttaccgtaaacccggggtacttccggtcgggggttacccccaaaggtaccaacggtaacgtttcgaacggtttcgggaccgtaagggttcggggtaccgaaggggtccctaaacggttcgggtaacgtttacccgaaccgtaaccgttaaaggtaaaaaacttccgaacgggtacccgggaaagggggttacggggaacgggtaccggtaagggtaaacggggtaagtttacggggttttaagggttaaacgttttttaacgtttaaccgttacggtaaccgttaaggttaacgggtaccggtaaacggggttaccggtaaccgtaaccgttaacggtttacccgggttaccccggtttaccccgggttaccgttttacccgggttttttaccggggaccccggtaaacggggggtaaacccctaacggggttacccggttaacggggtaacgttaaacggttaacccgtaaaaaccgggttaaccgttcggggttaccggaccgttaaccgg

SEQ ID NO: 56105 - DNA, 636 bp, Homo sapiens
  misc_feature: GYAE6OF02GPDH8.46.34.D01.1.454.CMB.1.raw
  modified_base (276)..(276): a, c, t, g, unknown or other
  misc_feature (276)..(276): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctcatctcctgcaggtctagtcaaagcctcgtatacactgataggaaaccactgcctggattggtatcaccgngccggccgacggccaatcctaccgaacggccgtacctttaaatttaacgttaaacggttttaccgtaaacccgggtccgttacgttaccggggtacccaagactaagtattacgaggttggcgtaggtgggtacaggaccacgtgtaacgttcaacgactaagtaaactcaaggtacgaggggtaggaggtcgtaggaggtaagtggtttaaggttaatttacgttacgtcgtacgtagtaggacgtaagtcgtactacgtagttccggtccgttaccggtcgttacgtttcgggaccggtaacgggtaaccagggtacgtaggacgtacgaacgtaaacgtacgtggtacgcgtaccgg

SEQ ID NO: 56106 - DNA, 728 bp, Homo sapiens
  misc_feature: GYAE6OF02IXAOX.46.34.D01.1.454.CMB.1.raw
  modified_base (258)..(258): a, c, t, g, unknown or other
  misc_feature (258)..(258): n is a, c, g, or t
  modified_base (721)..(721): a, c, t, g, unknown or other
  misc_feature (721)..(721): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatcctcctgcaggtctagtcaaacgcctcgtatacactgatacggaaacncctgcctggattggtatcaccacgcggaccacggcctaatccgtaccgaacgggccgtaccctttaaagttttaacgttaacgggttttaccgtaaacccggggtacttccggtacggggtaccccaaggaaccgtaagtaacgttaccgtaggttcgggacgtagggttacggggtacgaacgggtcctaacgttggtaaccggtttccaaccgtaacgtaacggtaaaatccgaaacggtcggtaacgggggtacgggaacgggtaccgtagggaacgggtagtttacggttaaggtttaaacgttttaatttaaccggtgtacgtagtagtaacgtaaggttcgaacgtacttaagttccggtccgttaccgtaccgtttacgtttcggacccgggtaacgggaacctaagggtccgtacggtaacgtacgtaaccggtaaacggtacgtgggtacggtntaaccgg

SEQ ID NO: 56107 - DNA, 590 bp, Homo sapiens
  misc_feature: GYAE6OF02F08ST.46.34.D01.1.454.CMB.1.raw
  modified_base (392)..(392): a, c, t, g, unknown or other
  misc_feature (392)..(392): n is a, c, g, or t
  modified_base (427)..(427): a, c, t, g, unknown or other
  misc_feature (427)..(427): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctcgtatacactgatggaaacacctgcctggattggtatcaccagccggccaggccaatcctaccaaggccgaccttaaatttacgttaaacggtttcctaaaccgggtactcgtcgggtacccagacagtacttcaggtcgcgagtgggtcaggctacgngtagttcacactagaaatcagcgagggtggaggcnggaggtataggttggtaatttattactgctagtagacgtaaggtgactaacgtagttcggccgttaccggtccgtacgttttcgggaccggtaacggggtaaccgtaaggccggtaggaacggtaacgtaccgtaaaaccgtacgtacgggtacgtcgtaccg

SEQ ID NO: 56108 - DNA, 541 bp, Homo sapiens
  misc_feature: GYAE6OF02IP98G.46.34.D01.1.454.CMB.1.raw
  modified_base (344)..(344): a, c, t, g, unknown or other
  misc_feature (344)..(344): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagcccggcctccatctcctgcaggtctagtacaaagcctcgtatacactgatggaaacacctgcctggattggtatcaccagcggccaggccaatcctccaaggcgcctaattataaggtttcacggatcgtgggtcccagcagtnttcgagtggcaggtggtccgaggctatgagttcacactagaaaatcacggcgagggtgggaggcgtggaggagttggttaggtaatttaagttactgcagtgagaggtgacactagttcggccgtccgtctacgtttcggaccggcgggtaaccaaggcgtagggatacgtaaccaaggtaacgtggtaggctacgg

SEQ ID NO: 56109 - DNA, 648 bp, Homo sapiens
  misc_feature: GYAE6OF02HM4NF.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgataggaaacacctgcctggtattggtactccaccagccggaccaggccaatcctaccgaaggccgtaccttaaattttaacgtaacgggttttaccgtaaaccggggtacttcggtacggggtaccccaaggacctagtacttccgaaggttcgggacgtacggttggggtacagggacctacgtaggtacgttccgaactaacgtaagaaaacttcgaggacggtaggggtacgggacggcgtaggaggtagtttagggttaggttaatttagttacgtgtactagtagacgtaaggtcgcgtaacgtagttacggcccgttccggtacgttacgtttcggacccggtaagggaaccaggtcgtacggagtacgtacgaaacgtacgtacggtacggctacg

SEQ ID NO: 56110 - DNA, 606 bp, Homo sapiens
  misc_feature: GYAE6OF02G7O5F.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttagacagccggcctccatctcctgcaggtctagtcaaagcctcgtatacactgatggaaacacctgcctggattggtatcaccagcggccaggccaatctccaaggcgccttaatttagtaacggtttctaaccgggacttcgtggggtcccagacagattcagtggctaggtggggtcaggccacgttgacgttcacacgtagaaaatcagcgaggggtggaggcgtggaggtagttggtttaggtaattttacgtttagtgtacgtagtaggacgtaaggtgaccgtactacgtttcggtcccgttcccgggttcttacgtttttcgggaccggtaacgggggtaaccaacggtacgttacgggaggtaacgtaccgtaaaaccggtaacgttaggttacggtcgtaccgg

SEQ ID NO: 56111 - DNA, 560 bp, Homo sapiens
  misc_feature: GYAE6OF02GW45C.46.34.D01.1.454.CMB.1.raw
  modified_base (254)..(254): a, c, t, g, unknown or other
  misc_feature (254)..(254): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (357)..(357): a, c, t, g, unknown or other
  misc_feature (357)..(357): n is a, c, g, or t
  modified_base (433)..(433): a, c, t, g, unknown or other
  misc_feature (433)..(433): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctcatctcctgcaggtctagtcaaagcctacgtatacactgatggaaacncctgcctggattgtatcacagcgcagcaatcncagcnctattatagttctaaccggctccgggtccagacagatcagtgcagtggtcaggcacgtgagttcanactagaaactcgagcgagggtgaggcgtgaggtagttaggttaggtaattttagtacgtgactagtgacgtaggtncgacgtagttcggtcccgttccgtacttaccggttttcggaccggtaacggggacctaaacggtcggtaagggaacgtacgttaaccgtaaaccggtacggttacggtacggtcgtacggtaacccg

SEQ ID NO: 56112 - DNA, 817 bp, Homo sapiens
  misc_feature: GYAE6OF02HRA5M.46.34.D01.1.454.CMB.1.raw
  modified_base (263)..(263): a, c, t, g, unknown or other
  misc_feature (263)..(263): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctctgggtcccaggattcgaggtggggatgttgtgatgactcagtctccactctccctgcccgtcacccttggacacgccggcctccatcctcctgcaggtctagtacaaagcctacgtatacactgataggaaaccncctgcctggtattggtactcaccgaggccggacccagggcctaaacgtccgtacccgaacgggccgtaccttttaaagttttaacgttaaacggggttttccgtaaaacccggggtccttccgggttacgggggttaccccaaggtactaacggtattccggaaggtcggacgtagggttcgggtacacgggactacgtggtacgttaccgtaacaacgtaacggtaaaagtacgaacggaccgggtaaaggggtacggggaacgggtacggttagggagggttaaggtttacgggtttaaggttaaagttttaacgtttacgtaggtaacctaaggttacggtaacggtaaggttcggtaacgtaaccggttaggtttaccccggtacccggtttacccgggttacccgtttacccgggtttttaccggggaacccgggttaaaccgggggtaaccccgtaaacgggtaccggttaacggggtaaacggtaaccgttaaaccgggtaaaaccccggttaacgggtttaacggtaccgggtacggttaacccgg

SEQ ID NO: 56113 - DNA, 605 bp, Homo sapiens
  misc_feature: GYAE6OF02H460C.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctgtatacactgataggaaaccacctgcctggtattggtatccaccgagccggaccaggccctaatcctaccgaaggcgtaccttaaattttaataaggtttacctaaccgggcttcggtcgggtacccagacagtattcgagtggacaggtgggtcaggcacgtgacgttcacactagaaactcgaggacgagggtggaggtcgtaggaggtagttggttaggttaatttattacgtgtacgtagtagacgtaaggtgtacacgtagttcggtccgttccggttaccgttacgttttcggaccggtaacggggaccgtaaggtcgtaggaacggtacgtaccgaaaccggtacgttcggacggtacgtacgg

SEQ ID NO: 56114 - DNA, 575 bp, Homo sapiens
  misc_feature: GYAE6OF02GI9LH.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatcctaccgaaggccgtaccttaaatttagtaacggtttacctaaccgggtctcgtcggggtcccagacagattcagtggcaggtgggtcaggcacgtgtacgtcacactagaaatcgagcgagggtggaggcgtgaggtagtggttaggtaatttatactgactagtgacgtaaggtgactacgtacgttcggtccgttcggtaccttacgttttcggaccggtacggggaacctaaggtcgtaggagtaacgtacgtaaaccgtacggtacggtacggcgtacgg

SEQ ID NO: 56115 - DNA, 599 bp, Homo sapiens
  misc_feature: GYAE6OF02JHOEP.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctgggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcacagcgccaggccaatctccgaagcgcctaatttataaggtttcaaccggtatcgtgggtcccagacagtattcgagtggacagtggtcaggcactgagttcacacgtagaaaatcgagacgagggtaggaggcgtaggaggtagttagttagggttaattttaagttacgtagtcgtagtgtacgtaagggttgaccgttaactaacgtttcggacccgtttcccggtacgttaccgttttacgggacccgtaacggggtaaccaacggtaccgttaggaacgtaacgttacggtaaaacccgtaggtaggtaccggtacgtaccgg

SEQ ID NO: 56116 - DNA, 590 bp, Homo sapiens
  misc_feature: GYAE6OF02FT4YK.46.34.D01.1.454.CMB.1.raw
  modified_base (300)..(300): a, c, t, g, unknown or other
  misc_feature (300)..(300): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcncctaattataaggtttcaaccgggtactcgtgggtcccagacagattcagtggctaggtgggtcaggcacgtgagtcacactagaaatcgagcgagggtggaggcgtaggaggtaagtggtttagggtaattttacttacgtcgtactagtaggtacgtaaggtgacgtactagttacgggtcccgttccggttacttaccgtttcggtacccgtaagggggtaaccaacggtaccgtagggtaacgtacttaccgaaaaccggtaaccgtaggtaccggtcgtaaccgg

SEQ ID NO: 56117 - DNA, 744 bp, Homo sapiens
  misc_feature: GYAE6OF02IBXKG.46.34.D01.1.454.CMB.1.raw
  modified_base (199)..(199): a, c, t, g, unknown or other
  misc_feature (199)..(199): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactcctccctgcccgtcacccttggacncgccgcctccatctcctgcaggtctagtcaaacgcctcgtatacactgaatacggaaacacctcgccgtggtattaggtactcacgacgcggccgacggtaccaactcctaccgacggacgtaccttaaacttttaagttaaacggtttaccgttaaccgggtacttcggttcgggtacccaacgacgtagtacgttacgagtcggacgtaggtgggtacgacggaccgtacgtagtacgttaccgaactacgtaaaggaaaactacgaacggacggtagggggtacgggacgggtcgtagggtaacgggtagtttaggtttagggttaaaacttttacgttaccggtcgtaacgtacgttaggtacggtaaacggtggtaccgtaacgtaccggtttcggaccccggtttaccggttaccgttacggttttaccgggacccgggtaaacgggggtaaccgtaacgggacccggtttaacggaacggttaaccgtaaccggtaaaaccggttaaccgggtttcggtaccggtaccggttacccgg

SEQ ID NO: 56118 - DNA, 588 bp, Homo sapiens
  misc_feature: GYAE6OF02FY7K9.46.34.D01.1.454.CMB.1.raw
  modified_base (255)..(255): a, c, t, g, unknown or other
  misc_feature (255)..(255): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacccttggacagccggcctccatctcctgcaggtctagtcaaagcctcgtatacactgatggaaacncctgcctggattggtatcaccagcggccaggccaatctaccaaggcaccttaatttataaggtttccaaccgggctcgtcggggtcccagacagtacttcaggtggctaggtgggtacaggcacgtgagtcacactagaaatcagacgagggtggaggcgtaggaggtagttaggttaggtaatttattacgtgacgtagtagacgaggtacgacgtacgtacgttacggtccgttccggttacgttacgttttcggaccggtaacggggaaccgtaaggtccgtagggtaagacgtaacggaaaccgtaacggtacggttacggtcgtaccg

SEQ ID NO: 56119 - DNA, 825 bp, Homo sapiens
  misc_feature: GYAE6OF02I14MK.46.34.D01.1.454.CMB.1.raw
tcagactagcagtacacgaccggtgctcgatttagatcgtctgtgttgggtttgggctgatcaggactcctcagttcaccttctcacaatgaggctccctgctcagcctccgtggggctgctaatgctcgtgggtcccaggtattcaggtggggatgttgtgatgactcagtctccacttcctccctcgcccgtcacccttggacacggccgcctccatcctcctgcaggtctagtacaaacgcctacgtatacactagatacggaaaccacctcgccgtaggtattaggtaactccgaccgaacggccggacccgacggaccctaaacgttccgtaaccgaaacgggaccgtaacctttaaacgttttaacgttaaaccgggttttacccgtaaaccggggtaccgtttaccgggttacggggtacccctaaggtaaccgtaacggtaacttaccgtagggtacgggacgtagggttcggggtaccgacgggtacctaacgttaggtaacgttaccgtaaccgtaacgtaaacgtaaaacgtaacgtacggacggtacggggtacgggtacggtacggtaggtaaggtaacgttaggtttaaggttaagtttaacgtttacgttacgtacgtacgtacggtacggtaacggtacgtacgtaacgttaacgttacggttaccgttccggttaaaaaaaaaaaaaaaaaaaaaaaaaaaaaaaccgttcggtttaccgggtaccgggtaacgggtaaccggtaacggtacggtacggtaacggtaacgtaacgtaaaccggtaacggtacggttacggtacgtacg

SEQ ID NO: 56120 - DNA, 592 bp, Homo sapiens
  misc_feature: GYAE6OF02IDMTX.46.34.D01.1.454.CMB.1.raw
  modified_base (364)..(364): a, c, t, g, unknown or other
  misc_feature (364)..(364): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggcctccatcctcctgcaggtctagtcaaagcctcgtatacactgatggaaacacctgcctggattggtatcaccagcggcccaggccaatcctaccgaaggcgaccttaattttaataacggtttccgtaaccgggacttcgtcgggtccagactagattnagtggcgaggtgggtcaggcactggtacgttcacacgtagaaactcaggacgtagggtggaggcgtaggacggtattggttagtaatttagtactagctagtagtacgtagggtcacacgttaacgtcggtacccgttaccggttcttaccggttttcgggaccggtaacggggtacctaagggcgtaggagtacgtaacgtaaaccgtaacggtggtacgcgtacgg

SEQ ID NO: 56121 - DNA, 611 bp, Homo sapiens
  misc_feature: GYAE6OF02IQZ1O.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgataggaacacctgcctggattggtatcaccagcggaccaggccaatctccaaggcgcctaatttatagttactacggactctggggtcccagacagtattcagtggcaggtgggtacaggcactgagttacacactagaaaactcgagcgtaggggtaggaggcctaggaggattggttaggtaagttttacttacgtgtacagttaggaccaagggttacgacgtaaccgtaagtttccgggtacccgttcccgggttaccgttaccgttttcgggacccggtaacgggggtaacccctaaagggtcccgttagggaagttaaccgtaccgaaaaccggtaaccgtgggttacggaccttaccgg

SEQ ID NO: 56122 - DNA, 795 bp, Homo sapiens
  misc_feature: GYAE6OF02JDSNS.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagtcctcgtatacactgataggaaaccacctgcctggtattggtatcaaccagcggccaggccaatcctaccgaaggtccgacctttaaattttaacgttaaacgggttttaccgtaaacccggggtaccttcggttacgggggtacccctaaggaaccgtaggtaactttaccgaggtttacgggactaagggttcgggggtaccaacggggtcctaacggtttcgggtaacggtttaccaaccgtaaaccgttaacggtaaaaacgtccgtaaacggtacggtaaagggggttacgggaacgggttaccggtaagggtaagggttaacgtttagggtttaagggttaaaacgtttttacgtttaacgttacggtacgttaagttacggaacgttaaagggtcgtaaccgtaacgttaacggtttccggtacccgtttacccgggttacctttaccggtttttacgggacccggtaacgggggtaaccctaacgggtcccgttaagggtaaccgtaacgttaacccgaaaaccggtaacggttacgggttaccggtacgtaccgg

SEQ ID NO: 56123 - DNA, 561 bp, Homo sapiens
  misc_feature: GYAE6OF02FF95C.46.34.D01.1.454.CMB.1.raw
  modified_base (276)..(276): a, c, t, g, unknown or other
  misc_feature (276)..(276): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtcacccttggacagccggcctccatctcctgcaggtctagtcaaagcctcgtatacactgatggaacacctgcctggattggtatcaccgancggccaggccaatctaccaaggcgcctaattataaggtttccaaccgggtactctcggggtcccagacagattcgagtggcaggtcgggtcaggcacgtgacgttcacactagaaatcagcgagggtgaggctggagtatggttaggtaaatttattactgacctagtgacgtaaggttgactacgattacggcccttaccggtcttacgtttcgggccgtaacggggacccaaacggtccgttaggagtaacgttaccgaaaacggtacctggtacggcgtacg

SEQ ID NO: 56124 - DNA, 577 bp, Homo sapiens
  misc_feature: GYAE6OF02G6OIC.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgccccgtcacccttggacagccggcctccatctcctgcaggtctagtcaaagcctacgtatacactgataggaaacacctgcctggattggtatcaccagcggccaggccaatcctaccgaagcgcctaatttataacggtttctaaccgggactcgtcggggtccagacagtattcagtgcgtagtggtcagcacgtgacgttacacactagaaatcgagcgagggtaggaggcgtaggaggagttgttaggtaatttaagttacgtgactagtcgacgaaggtgactaacgtagttccggtaccgtcccgttcgtacgttttcggacccggtaacggggaacccaaggtccgtaggtagaacgttacgaaaccggtagtaggtacggacgtacgg

SEQ ID NO: 56125 - DNA, 786 bp, Homo sapiens
  misc_feature: GYAE6OF02I1KWQ.46.34.D01.1.454.CMB.1.raw
  modified_base (195)..(195): a, c, t, g, unknown or other
  misc_feature (195)..(195): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctcctgccgtcaccttggacngccggctccatcctcctgcaggtctagtcaaacgcctacgtatacactgatacggaaactacctgcctggattggtatccacctaggcggaccacggaccaagtcctaccgaaggtccgtacctttaaatttacgttaaacgggttttccgtaaccggggtaccttcgggttacggggtacccaaggaaccgtaaggtacttacggtacggtacggtcgaacgggttcggggtaccgaagggtaccgtaacggttacgtaaccgtttacgaaaccgtaacttaaacggaaaaacttccgaaagggtacgtaagggggttacgggacggaccggtagggtaacgggttaagtttacggtttacggggttaaacttttacgtttaacgacggttacgtaaggttggtaaacggtaacggtacgtaccgaacggtttaacgttcccggggtaccctttaccggggttaacctttacgtttttaccgggaaccggtaacgggggttaaccccgtaagggtacccgttagggaaaccggttacgtaaaccgggtaaaacccgttaacggttacgggttaagggccgttaacccggg

SEQ ID NO: 56126 - DNA, 630 bp, Homo sapiens
  misc_feature: GYAE6OF02J04XT.46.34.D01.1.454.CMB.1.raw
  modified_base (524)..(524): a, c, t, g, unknown or other
  misc_feature (524)..(524): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacccgttggacacgccggcctccatcctcctgcaggtctagtacaaacgcctacgtataccactgataggaaacacctgacctggattggtatcaccgaggccggaccgacggccaactcctaccgaaggtccgtaccttaaattttaacgtaacggtttaccgaacccgggtactccggtacggggtaccccaagtaccgagtacttcgaggtcggacgtaggtcgggtcaggtacagtgacttcgaactactagaaactcgagtacgagggtcggagtcgtagaggttataggttagtaatttacgtagtacgtagtacgtaggacgtaaggtncgtagtacgttacggccgttacggttctacggtttacggaccggtaacgggtaacctacggacgtaggtaagacgtaacgaaacgtacgtcggtaggtacgtacgg

SEQ ID NO: 56127 - DNA, 672 bp, Homo sapiens
  misc_feature: GYAE6OF02I034X.46.34.D01.1.454.CMB.1.raw
  modified_base (72)..(72): a, c, t, g, unknown or other
  misc_feature (72)..(72): n is a, c, g, or t
  modified_base (439)..(439): a, c, t, g, unknown or other
  misc_feature (439)..(439): n is a, c, g, or t
tcagactagcagtacacgaccggtgctcgatttagatcgtctgtgttgggtttgggctgatcaggactcctnagttcaccttctcacaatgaggctccctgctcagctccgtggggctgctaatgctcgtcgggtcccaggtattcgaggtggggatggttgtgatgtactcagtctcctactcctcccgtcgtcccgtcaccccgttggacacggtcccggcctaccatcctcctgactggtctacgtacaacgtcctagtatacacgtagtacgtaacggaacctccgtgtacctaggtattcggtactacgaccgaggccgacgacgacctaatcccgaacgaacggtctaaccttaaatttagtaaccggttaccgaaccgggtactccgggtacggtaccaagactagtacttacgagtcgacgtggtcggtanacggactacgtagtactacaacgtaacgtaagaaagtcgaagtcggtagggtacggaggtacgtaggtaaggtagttaggttaaaggttattacgtacgtgtactaagtgaacgtaggtacgtacgtacgtacgttccggtacctacggttacgttacggttacgaaccggtacgggtaaccgagtacggtaaggtaactaacggtaaccgaaagttcgtaggacgtactacg

SEQ ID NO: 56128 - DNA, 599 bp, Homo sapiens
  misc_feature: GYAE6OF02GAONZ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaacgccccgtatacactgatggaaacacctgcctggattggtatcaccagcggccaggccaatctaccaaggcgaccttaatttactaaggtttacctaaccgggactcgtggggtcccagacagtattcagtggcaggtggtcaggcactgagttcacactagaaatcagcgagggtgaggtctaggaggagttggttaggtaaattttatacgtgtactagttcgacgaaggtagcgtaacgtagttacggtcccgttccggttacgttacgttttcgggacccggtaacgggggtaaccctaagggtccggtagggaacgttacgtaccgtaaaacggaaccgttagggtccggtactggtaaccccg

SEQ ID NO: 56129 - DNA, 700 bp, Homo sapiens
  misc_feature: GYAE6OF02FUBT4.46.34.D01.1.454.CMB.1.raw
  modified_base (251)..(251): a, c, t, g, unknown or other
  misc_feature (251)..(251): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctcctgcccgtcaccttgacagccggcctccatctcctgcaggtctagtcaagtcctgtatacactgataggaaacncctgccttggattggtatcaccagccggaccaggccaactccgtaccgaacggtccgtaccttaaattttaacgttaaacggttttaccgtaaaccggggtaccttccggttacggggtaccccaaggaccgtagtaactttccgaagggttcgggaccgtaagggttcgggggtacacggggtcctaacgttacggtacgttacaaccgtaacgtaagtaaaactcgagtacggtaagggggtacgggtaacggcggtagggaacgggttaagtttgggtttaaggttaagttttaacgttacgtgtaacgtagtaggcgtaaagggtcgtacctacgtacgttacggtcccgtaccggttcgttaccggtttcggacccggtaacggggtaccaacggtcgtaacgggtacgacgtaaccgaaacggtacgtggtacggtctaccgg

SEQ ID NO: 56130 - DNA, 700 bp, Homo sapiens
  misc_feature: GYAE6OF02HZLGN.46.34.D01.1.454.CMB.1.raw
  modified_base (255)..(255): a, c, t, g, unknown or other
  misc_feature (255)..(255): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcagtggggatgttgtgatgactcagtctccactctccttgcccgtcacccttggacagccgctccatctcctgcaggtctagtcaaagcctcgtaatacactgatggaaaacncctgcctggtattggtactccgaccgaggccggccaacggccctaaatccgtaccgaaacggcctaacctttaaattttaacgttaaacggttttaccgtaaacccgggtacttccggttacggggtacccaagacctaagtacgttcgaggtcggacgtagggtcgggtacacggctaacgttacggacgtttaccaaccgaacgtaagaaaaacttcgaacggtacggtaagggggttacgggaggtaccggttaggaacgggttaagtttgggtttaaacggttaaattttacgtaacgtagtacgtagtacggacgtaaggtcgtaaccgtagtacggttacggcccgttaccggttaccttacggtttccggaccggtaagggaccctaaggtcgtaggaagtacgtaaccgtaaacggtaccgtaggtcggtagtaccg

SEQ ID NO: 56131 - DNA, 568 bp, Homo sapiens
  misc_feature: GYAE6OF02F30HL.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatccaccaaggccgtaccttaaatttataacgggttttccaaccgggtactcgtggggtcccagacagtattcagtggcaggtgggtcaggcactgacgttcacactagaaaatcaggcgagggtggaggctaggaggtataggttaggtaattttattacgtgactagtagtacgaaggttgcgtaactagttcggtaccgtccggttacttacgtttcgggccgtaaggggaacccaaggtcgtaggagactacgaaaccgtacgtgtacggtctacg

SEQ ID NO: 56132 - DNA, 738 bp, Homo sapiens
  misc_feature: GYAE6OF02JO4CR.46.34.D01.1.454.CMB.1.raw
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (316)..(316): a, c, t, g, unknown or other
  misc_feature (316)..(316): n is a, c, g, or t
tcagactagcagtacacgaccggtgctcgatttagatcgtctgtgttgggtttgggtctgatcaggactcctcagttcaccttctcacaatgaggctcctgctcagctcctggggctgctaatcgctcgtcgggtcccaggtattcaggtcgggggatggttgtgatgactcgagtctccactctccctagcccgtcacccttggacacgccggtcctccactcctcctgccaggtcctacgtcaaacgcctacgtataccnctgatacggaaactccncgctggtatggtactcaccgtgaccgccagacctacncctacgaacgccgtaccttaagttaatacggttcaaacccgggtatccggtacgggtcccaaggtacacggtataccgtagtggacctagggtcgggtacctagggcctaacggtgtaacgttacaaccgtacttaagggaaaacttcggaacggtaccggtagggtaacgggtacggtacgacgggtaagggtaacgttttagggtaacgggttaaactttagtttaacccggagtttaccgaaggttacgtaaccggtaaggttaccggaacgttaacgttccggttaccggtaccccggtttacggttaaccggtttacggtttaccgggaaccgtttaaccggggggaccttaggtacccggttagggaaaccgtacggttaacgaaaccggttacgtcgggttacgaccggttaacg

SEQ ID NO: 56133 - DNA, 559 bp, Homo sapiens
  misc_feature: GYAE6OF02F1X11.46.34.D01.1.454.CMB.1.raw
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtacaaagcctcgtatacactgataggaaacacctgcctggattggtatcaccagcggccaggaccatctccaaggcacctaatttataaggtttcgtaaccggtactcgtcggggtcccagacagattcgagtggcaggtggtcaggcncgtgagtcacactagaaatcagcgagggtgagcgnggagtgtgttaggtaatttntacgtgactagtagacgtaaggtcgactacgtacgttcggcccgttaccggtcttacggttttacggccggtaacggggacctaaggtcgtcggaagtacgtaccgaaaggtaccgtggtacggactacg

SEQ ID NO: 56134 - DNA, 678 bp, Homo sapiens
  misc_feature: GYAE6OF02HN9RK.46.34.D01.1.454.CMB.1.raw
  modified_base (571)..(571): a, c, t, g, unknown or other
  misc_feature (571)..(571): n is a, c, g, or t
  modified_base (599)..(599): a, c, t, g, unknown or other
  misc_feature (599)..(599): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacagccggcctccatcctcctgcaggtctagtacaacgcctcgtatacactgatacggaaacacctgcctggtatttggtaactccgaaccaggccggacccaagggcccaaacgttcctacccgaaacggtccgtaaccctttaaagtttttaacgtaaacgggttttccgtaaacccggggtaccttcggttcggggtaccccaagtaccgaagtacttcgaaggttcggacgtagggttgggtacctaacggactacgtaggtacgttacaacgtacgttagaaaaacttacgacgacggtaggggtaggagggtacgtaggaggtacgttaggttaggtaaattttagtacgtgactagtcgacgtaggtnacgtacgtagttccgccgttaccggttnttaccggtttggacccggtacgggtaccacggtacggttacgacgaacgtacgaaaccggtagtacggtggtacctacg

SEQ ID NO: 56135 - DNA, 536 bp, Homo sapiens
  misc_feature: GYAE6OF02HDC67.46.34.D01.1.454.CMB.1.raw
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (415)..(415): a, c, t, g, unknown or other
  misc_feature (415)..(415): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctgtatacactgatggaaacactgcctggattgatcacagcgcagcaancncaagcnctaattanaagttcaacggntcgtgggtcccagacagattcagtgacaggtggtcaggcactgagttcacactgaaaatcagcgaagggtgaggcgagaggtagtggttagtaatttacgtatganagtagacgtaaggtgactaacgtagttcggccgttacgttcgttacgtttcggaccggtaacggggtaaccaacggtcgtacggagtaactacgaaacgtaacgtggtacggtactaccgg

SEQ ID NO: 56136 - DNA, 599 bp, Homo sapiens
  misc_feature: GYAE6OF02IPJXI.46.34.D01.1.454.CMB.1.raw
  modified_base (197)..(197): a, c, t, g, unknown or other
  misc_feature (197)..(197): n is a, c, g, or t
tcagactagcagtacacgaccggtgctcgatttagatcgtctgtgttgggtttgggctgatcaggactcctcagttcaccttctcacaatgaggctccctgctcagctcctggggctcctgctactctggctccgaggtgccagatgtgacatcgagctgacccagtctccatcctcctgtctgcaaccggtggganacagtgtcaccatcctacttggcccgggacaacggtccggaaactatttcggaacctaacctttaattttaaaagtttggttaactacaaacataacgaccgaaggggaccggacccctaagcctacctaatctatgctgctatcctagtttagacgtaaaggtcggggtaccagtcgaggttacgaggtcggcgaggtggagtcgtgggactagtacttccactctacacctaatactaagtactcgtagacgtaagtagtaagttatttacgtacttaacgttattactagtacaataagaacttatagttcgttacggacgtaaggacaacgtaactaactaaagttacgactggtcgtactagtaccactacttctacttctactacttccgtcctac

SEQ ID NO: 56137 - DNA, 633 bp, Homo sapiens
  misc_feature: GYAE6OF02JC4ZU.46.34.D01.1.454.CMB.1.raw
  modified_base (266)..(266): a, c, t, g, unknown or other
  misc_feature (266)..(266): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactcctccctgtcccgtccaccccgttggactagccggccttccatcctcctgacaggtctagtcaaagcctcgtatacactgatcggaaaacncctgcctggattggtactcacagccgacaggcctaagtctaccgaagctacctaatttacgtaaggtttcaacgggacttcgtcgggtccagacagtattcgaagtggacagtgggtacacggccagtgtacgttaccgactactaagaaatacgaggacgagggttaggaggtaccgtaggaggtacgttagttaggtaattttagtacgtagtactagtggtacgtaaggtacgtacgtacgtacgttacggtacccgttacggtccgtaacgttttcggaccgggtaacgggtaaccgtaacggaccggttaggtaacggtaaccgtaacggaaacccgttaacggtacggtcgacggttaacg

SEQ ID NO: 56138 - DNA, 864 bp, Homo sapiens
  misc_feature: GYAE6OF02H1QGW.46.34.D01.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
tcagactagcagtacacgaccggtgctcgatttagatcgtctgtgttgggtttgggctgatcaggactcctcagttcaccttctcacaatgaggctcctgctcagctccgtggggctgctaatgctcgtcgggtcccaggtattcaggtggggattggttgtgatgactcagtctccactcctccctggcccgtacctacccgtggacncgccggcctccatctccngacgtaggtctacgtaccaaacgtcctacgttanaccgtactgtaacgtacggaaaccactcgtaccgaggtagttagtaacgtccaacgaggaccggaccgtaacggacctaaacgttacccaccgtaacggtcccgtaacccgtttaaaagttttaacgttaaaccgggttaaccgttaaaccccggggtaccgttacgggtacccggggttacccgaaacggtaaccgtaagttacgtacgtaggggtaccggacgtacgggttacgggggactacggggtccgtaacggtcgtaacggttaccgaacgtaacgtaacggtaaaaacgtcggaacgggtaccgggtaggggttaacggggtaccggaacgggttacggtaaacgggtaaggtttacggttaaacggggttaaacttttaacggtacgtaacgggttacgtaacggttacggtacggtaaacgggttccgaacgtttaaacggtccggttaaccggtaacccggttccgggtaacctttaccgggtttaccgggtaaccgggtaacgggggtaaccttaaggggtcccggttaaggtaaaccggtaggtaaaacccgtaacgggttaaacgtcgggtaccgggttactaaccggg

SEQ ID NO: 56139 - DNA, 793 bp, Homo sapiens
  misc_feature: GYAE6OF02IFXZ8.46.34.D01.1.454.CMB.1.raw
tcagactagcagtacacgaccggtgctcgatttagatcgtctgtgttgggtttgggctgatcaggactcctcagttcaccttctcacaatgaggctcctgctcagctcctggggctgctaatgctctgggtacccaggattcagtggggatgttgtgatgactcagtctccactctccctgcccgtcacccttgacagccgcctccatctctgacaggtctagtacaagtctacgtatacactgatacggaacacctgcctggtactggtactcacctaggccggtaccacggacctaattcctaccgaaggtccgtacctttaaaagtttataacgggtttacccgtaaaccgggtacctacggttacggggtccccaagtacgagtacttccgaaggtcgggtacgtaaggttcggggtaccaacgggtcctaagttacgggtacgtttaccgacgtaaacgtaacggtaaaaattccgtaacggtccgggtaaggggtcggggtaaacggtccggttaagggttaacggggtaacggtttaggggttttaacgggttaaacgttttttaacggttttaaccgtcggttaagtacgggtttacgaacgggttaggggttaccacggttaaaccgttacgttttacccgggtaccgttttacccgggttaccgtttaccgggtttacgggtaacccggggtaaacgggggtaacccgtaaagggtccggttaacggtaacggaacccgtaacgtaaaccgggactttaacggggtaccggtattaacccggg

SEQ ID NO: 56140 - DNA, 937 bp, Homo sapiens
  misc_feature: GYAE6OF02G9PBA.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtgggatgttgtgatgactcagtctccactctccctgcccgtcacccgttggacaggccggcctccatcctcctgcacggtctacggtacaaacgtcctacgtataccactagtaactacggaaaacctaccttgacccgttaggtaatttcgggtactaccgaacccgaacgggcccgggacccgtaacgggacccctaaaacttcccgtaacccggaaacggggccgtaaccccttttaaaagttttaaacgttaaaccggggtttttaacccgtaaaacccggggttcccgttaccgggttaccgggggtaccccctaaggtaaccgtaacggttactttaaccgagggttacgggtaaccgtaggggttcggggtacccgaacggggttacctaaccggttagggtaaccggtttaccctaaacgtaacccgttaaaggtaaaaaaccgttccggtaaacgggtaccggggtaaagggggttacggggtaacggggtacggtaacggggaaggtttaccgggttttagggttttaacgggttaaacttttttaagttaaccgttacgggtacttaaacgggttaccgacgggttaaacgggtacctaacggttaccgttaacggtttaccggccccgggttttaaccggttacgtttacccggttttcggggtaaccccggtaaacggggggttaaccctaacgggtaccccggtaaggggtaacggtaaaccgtaacccggtaaaaacgggttaccggttaaccgggttacggtaccggttaacccgg

SEQ ID NO: 56141 - DNA, 692 bp, Homo sapiens
  misc_feature: GYAE6OF02IS95A.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttgacagcccggcctccatcctcctgcaggtctagtcaaacgcctacgtatacactgatacggaaacacctgcctggtattggtactcaccgaggccggcccgacggacctaacgtcctaccgaacgggccgtaccttaaattttaacgtaacggttttaccgtaaccgggtacttaccggtcggggtacccaagaccgagtacttacgacggtcggacgtaggtgggtcacgggacctaacgtggtacgttaccaacctaacgtaaggtaaactacgaacggacggaggggttggaagggcgtaggaggtagtttggtttaagttaatttacgttacgtgtacgtagttggacgtagggtcgtacgacgttacgttccggacccgttccgggttacctttacggtttaccgggaccggtaacggggtaaacctaccgggtcggttaacgggagtaacgtaaccggaaaccggtaaccggttgggtacggacgttacccgg

SEQ ID NO: 56142 - DNA, 761 bp, Homo sapiens
  misc_feature: GYAE6OF02JWDDT.46.34.D01.1.454.CMB.1.raw
  modified_base (291)..(291): a, c, t, g, unknown or other
  misc_feature (291)..(291): n is a, c, g, or t
tcagactagcagtacacgaccggtgctcgatttagatcgtctgtgttgggtttgggctgatcaggactcctcagttcaccttctcacaatgaggctcctgctcagctccgtggggctgctaatgctcgtgggtcccaggtattcaggtggggatgttgtgatgactcagtctccactcctccctcgcccgtctacccgttggaccacggcccggtccctcctactcctccgtgacctaggttctaacgtacaaacgtcccttacgtaataccacgtgaagtacggaaaccnccgtgaccgtggtacttggtactaccgaccgacggccggacccacgggaccctaactcccgtaccggaacgggtccttaacctttaaagttttaaccggttaacggtttaccggaaaccgggtcgttaccggtacggggtacccagaccgtacgtagttacgaaggtgacggtagggtcgggtacgacggtactaaggttcggtaacgttaccgaaccgtacgtaaacgtaaacgtacgacgggtagggtacggggtacggacgggtacgtagggtaaggttaggtttaggtttaaggttaacttttaagttacgtacgtacgtacgtagacggtaacgtacgtacgtaccgttaacgttccggtaccgttaccgttacgttacggttcggaccggtaacgggaacgttacgggtacgtaggaaccgtaacggtaaccggaaccgtttacggtacggtacggactaccgg

SEQ ID NO: 56143 - DNA, 580 bp, Homo sapiens
  misc_feature: GYAE6OF02G6757.46.34.D01.1.454.CMB.1.raw
  modified_base (442)..(442): a, c, t, g, unknown or other
  misc_feature (442)..(442): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactcctccctgccccgtcacccttggacagccggcctccatctcctgcaggtctagtcaaagcctcgtatacactgatggaaacacctgcctggattggtatcaccagccggccaggccaatcctaccgaaggccgtaccttaattttaactaacgggttttacctaacccggggtactcgtcggggtcccagacagtattcgagtgcgtaggtcgggtcaggcacgtgtacgttcacactagaaatcgagcgagggtggaggcgtgaggntgttaggtaatttatatgctatcgacgtaggtcgacacgtcgttcggtccgttccggtcttacgtttcggccggtaacggggtacccaaggtcgtaggtacgacgtaaccgaaaccgtacgtacggtcggactaccgg

SEQ ID NO: 56144 - DNA, 785 bp, Homo sapiens
  misc_feature: GYAE6OF02HEC7H.46.34.D01.1.454.CMB.1.raw
  modified_base (203)..(203): a, c, t, g, unknown or other
  misc_feature (203)..(203): n is a, c, g, or t
tcagactagcagtacacgaccggtgctcgatttagatcgtctgtgttggggtttgggctgactcaggactcctcagttcaccttctcacaatgacggctccctgctcaggctcctggggctgctaatggtctcgtcgggtaccaggattcagtggggatgtgtgatgactcagtctcactctcctgtcccgtcaccctggacngccggcctcatctcctgcgacggtctagacaagccttacgtatactctgagtaggaaacctcctgacctaggagttggtactcacctacgccggtccaggcctaactccgtaccgaagggtccctacctttaaagttttaacgttaaaccgggttttacccgtaaaccgggggtacctttaccgggttaccgggggtaccccaaaggtaacccgtaggttaacgttccgtagggttcgggaccgtagggttcggggtccaaggtcctacgtgaacgtttccaacgtacgtacgtaaaactcgtaacgtacggtagggtacggtaacggtacgttagggtaacggttagtttaggggttagttaaacgttttacgtttaacggtacggttacgtacggtttccgaccggttaaacggttcggtaccgttaacggtaccgggtttaccgggtacccgtttacccggttaccgttaccgggttttacggaacccgggtaacggggtaaccccgtaacggtaaccgttaccggaacgtaccgttaaccgtaaacggttaacccgtcggtaccggttcctaacccgg

SEQ ID NO: 56145 - DNA, 646 bp, Homo sapiens
  misc_feature: GYAE6OF02JBZ1N.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggcctccatcctcctgcaggtctagtcaagcctagtactacactgataggaaacacctgccgtggattggtatcaccagcgaccgaggcctaatccaccgaaggccgtaccttaaagtttagtaacggtttaccgtaaccgggtacttccggtacggggtcccaaggactagtattcgaggttcggactagggttacgggtacacggtactacgtggtacttcgaacgtacgtagaaaacttcgacgtacggagggtacggaacggtacgtaggacggtagttacggttaggtaaagtttacttacggtactacgtagtgtacgtaaggtcgactacgtacgttcggtaccgttaccggttacgttacgtttcgggaaccggtaccgggtacgaaggtcgacggtaagaacgttacgaaacgtacgtacggtacgcgtaaccgg

SEQ ID NO: 56146 - DNA, 558 bp, Homo sapiens
  misc_feature: GYAE6OF02FSDWU.46.34.D01.1.454.CMB.1.raw
  modified_base (225)..(225): a, c, t, g, unknown or other
  misc_feature (225)..(225): n is a, c, g, or t
  modified_base (360)..(360): a, c, t, g, unknown or other
  misc_feature (360)..(360): n is a, c, g, or t
  modified_base (396)..(396): a, c, t, g, unknown or other
  misc_feature (396)..(396): n is a, c, g, or t
tcagactagcagtacacgaccggtgctcgatttagatcgtctgtgttgggtttgggctgatcaggactcctcagttcaccttctcacaatgaggctccctgctcagctcctggggctcctgctactctggctccgaggtgccagatgtgacatcgagctgacccagtctccatcctccctgtcctgcaaccggtgggagacagtgtcaccatcacgttgccgggnaagtcggaactattgacacctattaaattggtaatcaacatagaccgagggaccggcccctaagcctactaatctatgctgcatccagtttgacgaaaggtcgggtcccagtcgagttcagtgcgagtggatcgngggacagtacttcactctaccacatacagtatcgtnactacgtagaattatttgactaattattactgtacaatagtaattacgtagttacgtttacggacgtaagggacacgtaactaactaaagttaacgtacgtagtacggtactacgtactaccgtattcgtacgttaccttactaccgttccttacccgtacc

SEQ ID NO: 56147 - DNA, 758 bp, Homo sapiens
  misc_feature: GYAE6OF02I1U7S.46.34.D01.1.454.CMB.1.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (744)..(744): a, c, t, g, unknown or other
  misc_feature (744)..(744): n is a, c, g, or t
tcagactagcagtacacgaccggtgctcgatttagatcgtctgtgttgggtttgggctgatcaggactcctcagttcaccttctcacaatgaggctccctgcgtcagctcctggggctgctaatgctcgtggtcccaggacttcgaggtgggatggttgtgatgactcagtctccactctccgtgcccgtcacccgttggacacgccgcctcatctcctgacaggtctagtacaagtcctagtatacnctgatacggaaaccnccgtcgacttggtactaggtactaccgaccgtaggccggccaaccggtccaaacgtccgtaccaggtccctaccttaattaaggtacgttacgtaccggacgttcgtcgggacccctgaaccgaagttcgtacgtacggtcggtacgtagggtaccgggtacacggggacctaacgttaccgggtaacgtttaccgaacccgtaccgtttaaggaaaacgtccgtaaggtaccggtaaggggtagtaccgggtacggtaagggtaaggttaccggttagtttaacggtttaacgtttaaactttccggtagtaaccgtgttacgaaccggtaggttaacgtaccgtaacgtttaacgggtcccgttaacccgggttcggtttaccgttaccggtttacggtaaaccgggtaccgggttaacccgaagggttaacccgagggtaaacgttaacgttaaccgggtaacgtaacgttaccgggnggtacccgtaccgg

SEQ ID NO: 56148 - DNA, 710 bp, Homo sapiens
  misc_feature: GYAE6OF02FRV8Q.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccgcctccatctcctgcaggtctagtcaaagcctcgtatacactgatggaaacacctgcctggattaggtatccaccgagccggaccgaggccaatccgtaccgaaggccgtaccttaaatttagttaaacggttttaccgtaaaccgggtacgttacgtcggggtacccaagacagtactttcgaggtcggacgtagggttcgggtacagggtcaaccgtggtacgttaccaaccgtacgtaacgtaaaactacgaaggaccggtaagggggttcggggaacggtacgtaggaagggttaagttacggtttaaggttaaacttttaagttacgtcggtacgtaagttacggtacgtaagggttacgtaccgtaacgtaacgttccggtacccgtttacccggttcgtttaccgttttgggaacccgggtaacggggtaaccctaacgggtacgtacggtaacggtacgtaaccggtaaaacggttacgtacgggtaccggcgttaaccgg

SEQ ID NO: 56149 - DNA, 666 bp, Homo sapiens
  misc_feature: GYAE6OF02JZJ3F.46.34.D01.1.454.CMB.1.raw
  modified_base (160)..(160): a, c, t, g, unknown or other
  misc_feature (160)..(160): n is a, c, g, or t
  modified_base (266)..(266): a, c, t, g, unknown or other
  misc_feature (266)..(266): n is a, c, g, or t
  modified_base (549)..(549): a, c, t, g, unknown or other
  misc_feature (549)..(549): n is a, c, g, or t
tcagactagcagtacacgaccggtgctcgatttagatcgtctgtgttgggtttggctgatcaggactcctcagttcacctctcacaatgagctccctgctcagctcctggggctgctaatgctcgtggtcccaggattcaggtgggatgttgtgatgctnagtctccactctcctgcccgtctacctggacacgcccgcctccatcctccgtagctaggtcctagtacaaacgccttacgtactacacgttgacgttaggaaaccnctcgccgtaggtattaggtacttaccgaccgagcccggccaggacctaagtctaccgacggtaccgacttaaatttacgtaaggttaccgtaaccggtacgtccgtacgggtacccagtactaggtataccgaggtacgcgtacggtacgggtcgaaggcctaacgtggtaccgttacgtaccgtaactaagtaaacgactaagggtaaccgaggggtaggtacggactagggagtaagtttacgggtacgtaatttaagtactaggtactatacgagttagngtacgttactaacgttccgaaccgtttcggaccgtttagtccgggttacggaacgggactacggttacggacgttaaggaccgttaacggtaaccgtaagttcggaagtcgtaacgg

SEQ ID NO: 56150 - DNA, 649 bp, Homo sapiens
  misc_feature: GYAE6OF02F6Q32.46.34.D01.1.454.CMB.1.raw
  modified_base (254)..(254): a, c, t, g, unknown or other
  misc_feature (254)..(254): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcaccttggacagccgctcatctcctgcaggtctagtcaaagcctacgtataccactgataggaaacncctgcctggattggtatccaccgagccgccaggtcaactccgtaccaaggccgtacttaaatttagtaacggtttcctaaccgggtcttcgtcggggtacccaggtaactagtacttacgaggtcggacgtaggttacgggacgacggctacgtgtagttaccacaacgtaacgaaactcgaggacggtagggtaggacggtcgtaggaggtagttagttaggtaatttagttacgtacgacgtagtacgacgtaaggtcgtacgtaacgttacgttccggtacccgttccggttaccgttacgttttaccgggaccggtaacgggtaccgaaggtccgttaagggtaacgtaacgtaaccgtaaaccggtacggttacggtacggtacgtaccg

SEQ ID NO: 56151 - DNA, 762 bp, Homo sapiens
  misc_feature: GYAE6OF02JMY4C.46.34.D01.1.454.CMB.1.raw
  modified_base (458)..(458): a, c, t, g, unknown or other
  misc_feature (458)..(458): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggattcgaggtgggggatgttgtgatgactcagtctccactcctccctcgcccgtcctacccgttggacacgcccggcctccatcctcctgcgtacggtctagtaccaacggtccttagtactaaccgacgtacggaaccggtaaaacctccgtcgtaccgtaggtacgtttaggtacctccgaaccgcggaccggaccgacggacctaactccgtaaccgaacggtcctaaccgtttaaagtttacgttaaacggttaccgtaaaccgggtcttaccgggtaccggggtacccaaggaaccgtaggtaaccttacggnggttcggaacgtagggtaccgggtactacgggtacctaggtacggtacgttaccaacgtaacgtaacgtaaaacgtcggaacggtacgggtacgggtaggaacggtgtaacggtacggtagttacggtaagttagttagttacgtagtacgtagtacgacggttagtacgtacgtaacgtggttccgtccggttacgtaccggttacgttccgggaaccggtaaccgggacggtaacggtacggtagtaaccggtacgtaaaccggtaacgttacggtacggtaccggtactaccggtaacccg

SEQ ID NO: 56152 - DNA, 854 bp, Homo sapiens
  misc_feature: GYAE6OF02GPP0F.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggattcgaggtgggggattgttgtgatgactcagtcctccactcctccctcgcccgtcctacccgttggacacggccggtccctccactcctcctgccgtaggtctacgtacaaacgtccttacgtactaccacgtagaacgttaacggaaacctaccgtcggtaccgttagggtaacgtttacggtaacctaccaacccggacgggcccggaaccggtaacgggttaccaaaccgttaccctaacccggaacgggccttaacccttttaaaagttttaacggttaaaccgggttttaaccggtaacccgggtacgttccgggttaccggggttaccccaaggtaaccgtaagttacgttacgtaacggggttcgggtacgtaggggttccggggtaactacggggtacctacggttacggtaacgttaccgtaaacgtaacgtaaaggtaaaactcggtaacggaccgggtagggggtagggaacggtcggtagggtaagggttaggttaacgggttttaggtttaaactttacgttaacggtgtaccgtaaggttacggtacggtaggttacctacgttaacgtaccgttcggttacccgtccgggtttacgttaccggtttccgggaacgggaaccgggtaaaccgacggttacggacgggaaccgttacgtaaaccggtaacgttacggtccgggttaggtaccgtaccgg

SEQ ID NO: 56153 - DNA, 675 bp, Homo sapiens
  misc_feature: GYAE6OF02F70TG.46.34.D01.1.454.CMB.1.raw
  modified_base (264)..(264): a, c, t, g, unknown or other
  misc_feature (264)..(264): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctccctgcccgtcacccgttggacacggccggcctccatcctcctgcaggtctagtacaaacgcctacgtatacactgatacggaaacncctgcctggattggatcaccagccggccaggccaatcctaccgaaggccgtaccttaaagtttacgtaacggttttaccgtaaccgggtacttccggtacggggtaccccaaggtaaccgtaggtacttcgaaggttcggactagggttcgggtacgaacgggtcctaacgtggtaacgttaccaacgtaactaagaaactcgacgacggtaggggtacggaggtcgtaggaaggtagttaggtttaaggttaatttacgttaacgtggtactagtagacgtaagggtcgtactaacgttacgtccggtccgttaccggttacgtttcgtttacgggaccggtaacgggtaacctaacgggtacgtacggtaacgtacgtaccgaaacggtacgtacggacgtacgtaccg

SEQ ID NO: 56154 - DNA, 754 bp, Homo sapiens
  misc_feature: GYAE6OF02FHE8Z.46.34.D01.1.454.CMB.1.raw
  modified_base (466)..(466): a, c, t, g, unknown or other
  misc_feature (466)..(466): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtgggatgttgtgatgactcagtctccactcctccctcgcccgtccaccttggacacgccgcctccactctcctgcaggtctagtcaaacgtcctcgtatacactgatacggaaacacctcgccgtaggtattcggtactaccgaccgacgccggacccacggaccctaattccgtaccgaacggtccgtacctttaaactttaacgttaaacgggttttaccgtaaccgggtacttccggtcggggtacccagactacgtacttcgagtcggtcgaggtcgggtacgacggtcacgtcgtacgtacacgtactaagaaacncgacggtagtaggggtgtaacggtcgtagggtaaggtgtttacggtttagggttaaacttttacgtttacgtacgtacgtacgtacggtaacggaagggttacgtaaccgtacgttaaccgttacgggtaccccgttaccgggtttaccctttaccgggttttaccgggaccccggggtaaacgggggtaaccccgtaaacgggtaccggttaacgggtaaaccgtaacggtaacccggtaaaaacccggttaacggtttaccggggtaccggtaccggttaacccgg

SEQ ID NO: 56155 - DNA, 593 bp, Homo sapiens
  misc_feature: GYAE6OF02IFRP0.46.34.D01.1.454.CMB.1.raw
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
  modified_base (482)..(482): a, c, t, g, unknown or other
  misc_feature (482)..(482): n is a, c, g, or t
  modified_base (589)..(589): a, c, t, g, unknown or other
  misc_feature (589)..(589): n is a, c, g, or t
tcagactagcagtacacgaccggtgctcgatttagatcgtctgtgttgggtttgggctgatcaggactcctcagttcaccttctcacaatgaggctcctgctcagctcctggggctgctaatgctctgggtcccaggattcaggtgggggatgttgtgatgactcagtctccactctccctgcccgtcacccttggacacgccggcctccatcctcctgctaggtctagtaccaaagcctacgtactacactgatacggaaacncctagccgtgtattaggtactcgaaccngccggaccgaggcctaaactccgtaccgaacggtccgtaccttaaagtttacgtaaacggtttcctaaaccgggctacggttcgggtacccagacagtacttcgaagtcgacgnggtgganagcatgatacacgatagaaacncagcggagggnggacgcgtagaggttacgtgttagtatttagttacngtactagtaggagtagtacacgtatcgttcggccgttaccgttacgtacgttacggacggaacgggtacaacggtgacggagtactaccgaaagtacgtggtaccgntacg

SEQ ID NO: 56156 - DNA, 754 bp, Homo sapiens
  misc_feature: GYAE6OF02IE735.46.34.D01.1.454.CMB.1.raw
  modified_base (268)..(268): a, c, t, g, unknown or other
  misc_feature (268)..(268): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggatgttgtgatgactcagtctccactcctccctcgcccgtcacccttggacacgccggcctccatcctcctgctaggtctagtacaaagtcctcgtatacactgagtacggaaaaccncctcgtccgtaggtattagggtactccgaaccgacggccgggacccacgggacctaaccgttcctaccgaacgggaccgttacctttaaacgttttaacgttaaacgggtttaccgttaaaccgggtacttccgggtacggggtacccaggtaacgtagtacttacggacggttacggacgtacgggttcgggtacacggtaccacgttggtacgttacgaactacgtaacggaaaatcgaagtacggaggggtagggacggtcgtaagggacggttagttaggttaaggtttaacttttaacgtttacgtcggtacctaaggttacggtaacgtaagggttacgaccgtaagttacggttaccggtcccgttaccggttacgttaccggttttaccggggacggtaaccggggtaaccctaagggtaccggtaggaaaccgttcggtaaaccgaaaccggttacgtacgggtacgtcgtaaccgg

SEQ ID NO: 56157 - DNA, 659 bp, Homo sapiens
  misc_feature: GYAE6OF02GVO95.46.34.D01.1.454.CMB.1.raw
  modified_base (263)..(263): a, c, t, g, unknown or other
  misc_feature (263)..(263): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggtcctccatcctcctgcaggtctagtacaaacgtcctacgtatacactgatacggaaacncctgccgtggtattggtatcaccgtaggccggccgaggcccaagtcctacccgaaggtccgtaccttaaagtttacgtaaacggttttaccgtaacccgggtaccgttccgtcggggtacccctaggaacacgtattcgaggtcggacgtaggtcgggtacaggacctacgtagtacgttacaccgtaacgtagaaaactcgaacgtacggtagggtacggagggtcgtaggaggtagtttggttaaggttaatttagtacgtgtctagtgacgtaggtgacgtacgtagttccgccgttaccggtcgtacgtttccggaccggtaacgggaaccgtacggtacgttacggaaggtaaccgtacgtaaaccggtacggttacggtacggccgtacg

SEQ ID NO: 56158 - DNA, 685 bp, Homo sapiens
  misc_feature: GYAE6OF02ILCEV.46.34.D01.1.454.CMB.1.raw
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatcctcctgcagtctagtcaaacgcctcgtatacactgataggaaacacctgcctggattgtatcacngcgccagccatcncagcactattataagttctacggactcgtcgggccagacagtatcgaggtggcaggtcgggtacaggcacgtagcgttacgactactaaggaaaactacgaacgcggtaaggggtaggacgggtacgtacggagggtaagtttacgggttaagggtttaagttttaaacgtttacgtggtaccgagtttaggacgtaacgggttacgaccgtaacgttacggtttaccggttacccggttcccgggtttaccgtttaccggttttttccggggaacccgggttaacgggggtaaccccgtaagggttacccggttaacgggtaaacggttaacccggttaaaccggtaaaaccgggttaaacccggtttacggggttacggtaccggttaacccgg

SEQ ID NO: 56159 - DNA, 761 bp, Homo sapiens
  misc_feature: GYAE6OF02HUKI1.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctcgcccgtccacccttggacacgcccggcctccatcctcctgcaggtctagtacaaacgcctcgtactacactgataggaaaccacctcgccgtggtattggtactcaccgaggccggacccgacggacctaactccgtaccgaacggccgtacctttaaattttaacgttaacggttttaccgtaaaccgggtacgttcggtacggggtacccaggaccgtaacgtacttacgaggtcggacgtaggtgggtaccgacggtaccgtacgttacggtacgtttaccaacgtaacgttaagaaaacgttccgaaggtacgggtaaggggggttaacgggacgggtccggttaaggaagggtacggttttaggtttacggtttaaattttacgttaaggttcgagttaaggtacggtacggtaaacgggtcgaactaacgttcggtttccggacccgtttcccgggttacgtttaccgggttttccgggaccgggtaacgggggtaacccgtaacggggtacgttacgggtaaagttaacggtaaccggaaaccggttacggtaacggttcggtacgtacccgg

SEQ ID NO: 56160 - DNA, 641 bp, Homo sapiens
  misc_feature: GYAE6OF02JNIY8.46.34.D01.1.454.CMB.1.raw
  modified_base (638)..(638): a, c, t, g, unknown or other
  misc_feature (638)..(638): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcagtggggatgttgtgatgactcgagtctccactctccctgtcccgtctacccttggaccagcccggcctccatcctcctagctaggtcctagtacaacgcctgactacactgactaggaaaccactcgccgtaggacgttcggtactaccgaccgtacggaccggtaccacggtacctaagtccgtaccgaacgggcctaccgttaaatttacgtacggtttacgaaccggtcttccgacggggtacccaagtacgtagttacgcgtaaggtcgacgtagggttcggtacagggactcggtagtaactcaacgtactaaggaaaactcggacgtacggtagggtacggcggtagtacggaaggttcggttagtttaaggttacttttaagtacctggaacgttacgtagtacggtaaggttcgactacgtagtccgtaccgtgttaccgtgttacgcggtaacggatcgcgtgagacgaacgagaacgtggacgngtc

SEQ ID NO: 56161 - DNA, 619 bp, Homo sapiens
  misc_feature: GYAE6OF02FJVQW.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggcctccatcctcctgcaggtctagtcaaagcctcgtatacactgatggaaacacctgcctggattggtatcaccgagcggccaggccaatctcagcgacctaattataaggtttctaaccgggactcgtcgggtccagacagacttcgagtggcagtgggtcaggcacgtagacgttcacctatacgaaaatcaggcgaggggtggacggcgtggaaggtagttggttagggtaacttttagttacttgtaactagtacgacgtaaggtgaccgtacgtaacgttcggtacccgttacccgggttactttaccggtttacgggtacccggtaacggggtaaccgtaaacggtccggttacgggaagtaaccgttaaccggtaaaaccgtaaccgttcgggtacggtcgttaaccgg

SEQ ID NO: 56162 - DNA, 775 bp, Homo sapiens
  misc_feature: GYAE6OF02ITCR6.46.34.D01.1.454.CMB.1.raw
  modified_base (273)..(273): a, c, t, g, unknown or other
  misc_feature (273)..(273): n is a, c, g, or t
tcagactagcagtacacgaccggtgctcgatttagatcgtctgtgttgggtttgggctgatcaggacttctcagttcaccttctcacaatgaggctccctgctcagcctcctggggctgctaatgctctcgggtcccaggattcagtgggggatgttgtgatgactcagtctccacttcctccctgcccgtcacccgttggaccagcccggcctccatcctcctgcgacggtctagtacaaacgtcctacgtactacatagatacggaaaccncctcgcctggtattacggtactccgaaccgacggccggaccgacggtaccctaacttcccgaccgaacggaccgtaacctttaaagttttaacgttaaacggttttaccgtaaaccgggtacttccggtacggggtacccaggtaacaagttacgttacgacggttacggacgtaacgggttcgggtacacgggtacctacgttggtaccgttaccgaaccgtaacgtaaaggtaaaacgtacgaacgggtacggtaaggggtcgggtaaggtcgtagggtaacgggttagtttagggtttaaggtttaacttttaagttacgtagtaccgtaagttcgaacgtaaggtacgaccgttactaacggttcccggttaccgttccgggttacgtttacggtttaccgggaaccgggtaacggggtaacccgtaagggttacggttaacgggaacgtaaaccggttaacggaaacggtaaccggtagggttaccgaccgttacgg

SEQ ID NO: 56163 - DNA, 684 bp, Homo sapiens
  misc_feature: GYAE6OF02JA8GD.46.34.D01.1.454.CMB.1.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (503)..(503): a, c, t, g, unknown or other
  misc_feature (503)..(503): n is a, c, g, or t
tcagactagcagtacacgaccggtgctcgatttagatcgtctgtgttgggtttgggctgatcaggactcctcgagttcaccttctcacaatgagctccctgctcagctcctggggctgctaatgctcgtgggtcccaggattcaggtggggatgttgtgatgactcagtctccactcctccctgcccgtcacccttggacncgccgcctccatctctgcaggtctagtcaacgcctacgtatacnctgatacggaaccncctgcctggtattggtatccacgacgccgaccgaaggcctaatccgtacgacggtccgaccttaatttacgttaacggtttccgtaaccgggtcttaccggtcggggtacccaaggtaccgaagtacgttcgaaggttcggactaggtggggtacacggactacgtggtactctaacagtaacgaaacgtcaggtacgaggggtggtaggcgtaggtaggtgttagttacgttaagtttatagnggtaactggtacgacggtagtacgacgtacgttacggttaccggtcccggttaccggtttacgttaccggttttaccgggaacccgggtaacggggtaaccgtaacgggtccgtaacgggtaacggttaaccgtaaaccggtaaaccggttaacggttaccggacgggttaccgtaacccg

SEQ ID NO: 56164 - DNA, 615 bp, Homo sapiens
  misc_feature: GYAE6OF02FSEZP.46.34.D01.1.454.CMB.1.raw
  modified_base (253)..(253): a, c, t, g, unknown or other
  misc_feature (253)..(253): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgatacactgatggaaacncctagcctggattggtatcaccagcggccaggccaatcctacccgaaaggccgacccttaaagtttactaaacggttttccgtaaaccgggtacgttctcgggggtacccctaaggaccaggtattcgagtggcaggtgggtcaggcactgacgttcacactagaaaactcgaagcgagggtggaacggtcgtagaagggattaggttaggtaattttattactcgtactaacgtgtacgaagggtcgacctacgtacttcggccttccgggtactcgttttggaccggtacggggtaaccaagggtccgtacgggaacgtacgtaccgtaaaaccggtaaccgttcggtacgaccgttacg

SEQ ID NO: 56165 - DNA, 757 bp, Homo sapiens
  misc_feature: GYAE6OF02IUJOI.46.34.D01.1.454.CMB.1.raw
  modified_base (259)..(259): a, c, t, g, unknown or other
  misc_feature (259)..(259): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactcctccctgcccgtcacctgacacgccgcctccatctcctgcaggtctagtacaaacgcctacgtatacactagagtaggaaaccnccgtgtccgtggtacttggtactccaccgaggcccggaccacggaccctaacttcccgaccgaacgggtcccgtacctttaaagttttaacgttaaacgggttttaccgtaaacccgggtacttcggttaccggggtacccaaggtaacctaacggtactttaccgaaggttacgggtacgtagggttacggggtccaacgggtcctaaccggtaggtacgttaccaaccgtaacgtaaacgtaaaacgtcgaacggtaccggtagggggtagggtaacggtcggtacgggtaaggttacggtttagggtttaggttaaacttttacgttactaggtacgtaacggtacgtaacgtagggtactaccgttaacgtacggttccgtacccgttccggttaccttaccggttttacggaacccggtacggggtaacctacgggtaccgtaggtaacgtaccgtaacgaaaccggttacgtacggtcggacgttaacccgg

SEQ ID NO: 56166 - DNA, 743 bp, Homo sapiens
  misc_feature: GYAE6OF02H9009.46.34.D01.1.454.CMB.1.raw
  modified_base (207)..(207): a, c, t, g, unknown or other
  misc_feature (207)..(207): n is a, c, g, or t
tcagactagcagtacacgaccggtgctcgatttagatcgtctgtgttggggtttgggctgatcaggactcctcagttcaccttctcacatgaggctccctgctcagctccgtgggctgctaatgctcgtgggtcccaggtattcgaggtgggatggttgtgatcgactcgtagtctccactcctccgtcgccgtcctaccttggacnccggccggcctcctatccgtccgtcgctaggttctaggtacaacgtcctagtactacactaggaacgttaggaaacctacgtcggtaccgttaggtacgttggtaaccaccacggtaacggtcgacccgtacggtacctaactcccgacgtaaacgggtccttaccgtttaaagttttaccggtaacggtttaccgtaaaccgggtcgtcggtaccgggtacaacggtactagtacgtcgaggttcgacgtaggtcggtacaggtcctaggtacgttacgtacacgaacgtaacgaaacgtcgaacggtacggtagggtcggtacgtcggttaagggacggttaagtttacgttaagttaacgtttacgtacggtacgtcgtacggtacggtagtaacggtctacgtacgtacggttccggtaccgtttaccggtagttaccggtttaccgggacggtaacgggtaaccgtaacggtccgtaacggtacgttaccgttaaccggaaccgttacggtaccggttcgtacgtacccgg

SEQ ID NO: 56167 - DNA, 792 bp, Homo sapiens
  misc_feature: GYAE6OF02I54TE.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtctccactctcctcgcccgtccaccgttggacacggccgcctccatcctcctgcaggtctacgtacaacgcctgtaatacactagatacggaaaccaccgtgacctggtaagttcggtactaccgaccgtaggcccggacccgacggtaccctaacgttcccgaccgtaaacggggccttaaccctttaaaagtttttaaacgttaaaccggggtttttacccgtaaaaccccggggtacgtttacccgggttaccggggggttaccccaaggtaaccccgtaaggtaaacctttccggtaaagggtttcggggtacgtaacggggtttcggggtaacccacgggtacccgtaacggttcggtacgtttaaccggaactaacgtaaagaaaacgttcgaacggtacgggaggggtacggacgggtaccggtaggtaagggttaacgtttacgggtttaaggttaacgttttaattacggtacgtacgtaggtaacggacgtaagggtcacgtacgtacggttcggtccgtaccggttcgttacggtttaccggaccggtaacgggacctaggtaccgtagggtaaccaaggttaccggaaacgtacggtacggtcgaccgttacg

SEQ ID NO: 56168 - DNA, 682 bp, Homo sapiens
  misc_feature: GYAE6OF02I4GD2.46.34.D01.1.454.CMB.1.raw
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
  modified_base (375)..(375): a, c, t, g, unknown or other
  misc_feature (375)..(375): n is a, c, g, or t
  modified_base (674)..(674): a, c, t, g, unknown or other
  misc_feature (674)..(674): n is a, c, g, or t
tcagactagcagtacacgaccggtgctcgatttagatcgtctgtgttgggtttgggctgatcaggactcctcagttcacccttctcacaatgaggctccctgctcagctccgtgggctgctaatgtctcgtgggtcccaggtattcgaggttggggatggttgtgatgactcgagtcctccactcctccctgcccgtcacctggacacgcccgcctccgatcctccgtgacncggtntacgtacaacgcctagtatacacgttgacgtagaaactccgtgccttaggtacgttgtacnccaccgaggcccgacgacggacctaacgtccctaccgaaggcctaactttaattacgtaacgtttccgaaaccgggntaccgggtcgggtaccagtaacgtggtacttcgaaggtgacgtggtgggtaccaggtccgacgtgggtaaccttccgaagttaacgtaacgaaatccggtaagaccggtgggtaaggtacggtacgtagggaggttaaccgttggttaaccggttatttaaccgttggtagtaacctggtactaaggacgtcgtacgtaacgtacgttcccgtaccgttaccggttatccggtttacggccggtaccgggaatcgggtcgaagtcgttaacgtacgtaaccggtacggtagttaccggnttacccgg

SEQ ID NO: 56169 - DNA, 690 bp, Homo sapiens
  misc_feature: GYAE6OF02HPK9C.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactcctccctgcccgtcacccttggacagccggcctccatctcctgcaggtctagtcaaagccctagtatacactgatggaaacacctgcctggattggtatccaccacggccggccacggaccaatccgtaccgaacggccgtacctttaaagtttaacgttaacggttttaccgtaaccgggtacgttccgtcggggtaccctaggacgtagtacgttacgaggtcggacgtacggtgggtacacgggctacgtggtacgttacacaacgtagaaaatcgagacgaggggtagggaggcgtaggaggttacgttaggttacgttaagtttaacttacgtacggacgtagttaggtacgtaaggggtcgtaacgtacgttacggtttccggtaccccgttccgggttaccgttacgggttttccgggaccgggtaaccggggtaccgtaacggtacgttacgggtaacgtaacgtaccggtaaaacggtacgttaccgggttacggaccgttaaccgg

SEQ ID NO: 56170 - DNA, 753 bp, Homo sapiens
  misc_feature: GYAE6OF02I7VK3.46.34.D01.1.454.CMB.1.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtgggtcccaggattcgaggtggggattgttgtgatgactcagtctccactcctcccgtcgcccgtactacccgttggaccacggcccggtcctccacttcctcctcgcgtacggtacgtacgacaaacgtcctacgtactacncgtagatacggaaaccncctacgcgtaggtagttcggtactaccgacgaggtccggacgaaaacggctaacgtccgtaccggaacggtccgtaacctttaaagtttaacgttaacgggttaccgtaaccgggtcgttacggtaccgggtaccaagtaacgtacgtacgtttacgacggttcgggtacgtagggttacgggtcgaaacggtccgtaccgtacggttaacgttaccaacgtaactaacggtaaaacgtcgaacgggacggtaggggtacggacggtacgtaggtagggttagttaggtttacgttaacttttagtacgcgaacgtagttacggactaaagggtcctaagtaaccgttacgttccgggtacccgttccgttacgttaccggtttccggaaccggacgggtaacacgggtacgtacggtaacgacgtaaccggtaaaccggttacgtcggtacgtccgtaaccgg

SEQ ID NO: 56171 - DNA, 757 bp, Homo sapiens
  misc_feature: GYAE6OF02H9SVJ.46.34.D01.1.454.CMB.1.raw
tcagactagcagtacacgaccggtgctcgatttagatcgtctgtgttgggttgggctgatcaggactcctcagttcaccttctcacaatgaggctccctgctcagctcctggggctgctaatgctctgggtcccaggattcagtggggatgttgtgatgactcagtctcactctccctgcccgtcacccttggaccagccggcctccatcctcctgccaggtctagtcaaacgcctacgtatacactgatggaaaccaccgtgcctggattggtatcgaccagcccggaccaggcccaatccgtacccgaaagggccgtaccgttaatttacgtaacggttttccgtaaacccggggtacttccgtcgggggtccccaaggtaccgtaacgtagttccgaaggttcgggacccgaggttacggggtacgaccgggtacgtaaccgttggtaacgttacccgtaaccgtacgttaacggtaaaaccgtacgtaacgggtacccgtaacgggggtacgggtaacgggtaccggtaggtaacgggttaacggtttaggttaacgggttaaacgttttaacgtttaaccggtacggtacgtaacgtagggtaccgtaaacgggttacgaccgttaacgtaacgttcgggtacccgttccgggttaccgtacgttttaccgggaccggtaacggggtaacctaacggtccgtaggtaacgtaacgtaccgaaaccggtacgtacggttcggtaccgtaccgg

SEQ ID NO: 56172 - DNA, 638 bp, Homo sapiens
  misc_feature: GYAE6OF02FSQV1.46.34.D01.1.454.CMB.1.raw
  modified_base (290)..(290): a, c, t, g, unknown or other
  misc_feature (290)..(290): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggcctccatctcctgcaggtctagtacaacgcctcgtatacactgataggaaacacctgcctgattggtatcaccagcgcaggcatcncaggcactaattataggttcaacggctcgtcgggtcccagacagtattcaggtcggacgtaggtgggtacaggtaccgactgacgttcactacgtagtaaactcacgtacggagggtcggaggtaccgtaggacggtagttggtttagggttaattttaagtacttacggacgttagtacggtacgtaagggttacgtaccgtaacgttacgttaccggtcccgttacccggttaccgttaccggttttaccgggacccggtaacggggtaaccgtaacggtacggtacggtaaacgtaccgtaaccggtaaaaccggttaacgtaccggtacggtacgttaacccgg

SEQ ID NO: 56173 - DNA, 747 bp, Homo sapiens
  misc_feature: GYAE6OF02IYUPX.46.34.D01.1.454.CMB.1.raw
  modified_base (200)..(200): a, c, t, g, unknown or other
  misc_feature (200)..(200): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtcctccactctccctcgcccgtccaccttgacncgccggcctccatctcctgcacggtctagtacaaacgcctagtatacactgagtaggaaaccaccgtgtccgtaggtagtttacggtactccgaccgaggccggccgaacggacctaaactcctaccgaacggtccgtaacctttaaacgttttaagtaaacgggttttaccgtaaacccggggtacgttccggttacgggggttaccccaaggtaaccgtaggttacttacgagggtcggtacgtagggtcggggtacagggtcctacgttagggtacgttaacaacctaacgtaagtaaaactcgaacgggtacgtaggggtacgggacggtacgtaggtaacggtaggttacggtttaaggtaagttttaacgtacgtagtacgtagttacggaacggtaacggttacgtactaacgttagggttccgtcccggtttaccggttaccgttacggtttcgggaccggtaagggggtaccctaacgggtacggtacggtaacgtacgttaaccggaaaccggtacgttcgggtacgtccgtaacgg

SEQ ID NO: 56174 - DNA, 665 bp, Homo sapiens
  misc_feature: GYAE6OF02HW03W.46.34.D01.1.454.CMB.1.raw
  modified_base (215)..(215): a, c, t, g, unknown or other
  misc_feature (215)..(215): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccatcccctcctgcccgtcacccttggacacgccgcctcatctccngcaggtctagtacaagcctcgtatacactgatcggaaaccaccgtgcctggattggtatccaccgaggccggaccaacggacctaatccgtaccgaaggccgaccttaaagtttaacgtaacggttttactaaacccgggtactaccggtacggggtaccctaagactaagtacttcgaggtcggcgtagggtgggtccaggacctacgtagtacgttacaactacgtaacgtaaaactcgaagtacgtaaggggtacggacgggtacgtaggacggtaagttggttaaggtaagttttaagtacgtagtactagtacgtacgtaacggtcgtacgtacgtacgttaccggtcccgttaccggttcgttacgtttcggaccggtacgggtaaccgtaacggtcgtaggaacgtacgtaaccgaaaccgtacggtacgtacggtctaccgg

SEQ ID NO: 56175 - DNA, 665 bp, Homo sapiens
  misc_feature: GYAE6OF02HDROK.46.34.D01.1.454.CMB.1.raw
  modified_base (207)..(207): a, c, t, g, unknown or other
  misc_feature (207)..(207): n is a, c, g, or t
  modified_base (285)..(285): a, c, t, g, unknown or other
  misc_feature (285)..(285): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggatgttgtgatgactcagtcctccactcctcccgtcgcccgtcctacccgttggacncggcccggcctccactcctcctgctacggtacttacgacaaacgtccttagtactacagttcggaatcggtaaaaccncctgcgtgtacgttgtacaccgacgcggccgaccgacgacctactccgaccgaaggccttaactttaagtttaacgtaacggttaccggtaaccgggtcgtcggtaccgggtaccgacgtacgtagtacgtcgaggtcggacgtagggtcggacgcggactcgtgtactacaacgtaacgtaagaacgtcgacggacgggtagggtaggcggtagtaggtaaggttgttaggtttaagttaagtttactacggtacgtacgtcgtacggacgtaacggctacgtacgttacgtccggtccgttacggttccttcggttacggaccgggaacggtactaggacgtaggtacgtaacgtaacgaacggtgtcggacgtcacg

SEQ ID NO: 56176 - DNA, 760 bp, Homo sapiens
  misc_feature: GYAE6OF02IOJYS.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctcctactcctccctgcccgtcctaccccgttggaccacggcccggcctccatcctccctagcaggtctagtacaaaacgtccttacgtacttaccacgttagactacggaaaccacctgccgtggtattggtaatcgaccaggtccggctaggaccaatcctaaccgaaaggtccgtaccttaattttaacgttaaaggttttaccgtaaacccggggtacttacgggtcggggttaccccagaaccgaagtaccttagaacggttggaccgtaaggttcgggacgaaggtaccaccgttagaaggttccgtaacgtaagtaacgtaaaacgtacgtaacggacgtaaagggtacgggtaaggtaccggtaagggtagggttaaagtttacggttaagggttaaattttaacgttaacgtacggtaactaaggttacgtacggtaagggtaccggtaacctaacgttacgtaccggttacccgtccggttacttacccggttttgggaacccggtcgggtaaccgaacggtacggtagggtaacgtacgttaaccggaaaacggttaacggtacggttacggacgttaccgg

SEQ ID NO: 56177 - DNA, 920 bp, Homo sapiens
  misc_feature: GYAE6OF02FFWDJ.46.34.D01.1.454.CMB.1.raw
  modified_base (779)..(779): a, c, t, g, unknown or other
  misc_feature (779)..(779): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactcctccctgccccgtcacccgttggacacgccggcctccattcctcctgctaggtcctagtacaaacgtcccttacggtaattaccacgttgaactacgggaaaacctacccttggcccgttagggtacttttcggggaacttcccgaaccccgtaggtacccggggtaccccgaacgggtaccccaaacgttacccgttacccgaaacggggtacccgttaacccgttttaaaacgtttttaacgtttaaaaacggggtttttacccggttaaaaaccccgggggttaaccgtttacccgggttaccgggggggttaacccccctaagggtaaacccgtaaacggggtttactttacccggtaacgggttacggggtacccgttaaggggttaccgggggttaacccgaacggggtacccgtacccggttagggtaaccggttttacccgtaaacccgtaaaccggtaaacgggttaaaaacgtaccggtaaccgggttaccccgggtaaagggggggtttaccggggaacggggttaccgtaggggtaaacggggttagtttaccggggttttaagggttaaacgtttttaacgttttaaccggnggttaacctagggtacacgggttaaacggtgtaccgtaaccgtagttccgggtcccgttccggttacgtttacgttccgggaccgtaacgggtaccacggtactcgggaagtactaccgaaacgtgacggttaggctacgg

SEQ ID NO: 56178 - DNA, 809 bp, Homo sapiens
  misc_feature: GYAE6OF02IGDIQ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcagtggggatgttgtgatgactcagtctccactcctccctcgcccgtctacccgttgacacgccgcctccatcctcctgctaggtctagtacaaagtcctacgtatactactgaacgtacggaaacctaccgtcgcctaggtacttaggtactaccgaccgacggtaccggacccgaacgggtaccctaaacttccgtaacccgaaacggggtcccgttaaccttttaaaagttttaaacgttaaaacgggttttcccgtaaaacccggggttaccttaccgggttaccggggtaacccaaggtaacgtaacgtaacttaccgtaaggtcgggtacgtagggtttcggggtaaccacgggtccgtaacgttcgggtaacgttaccaacgtaactaaacgtaaaagtaccgtaacggacggtaaggggtacgggtaacggtcggtaacgggaagggttaacgttagggttaaggttaaacttttacgttaaccacggttacgtaacgttacggtaacgttaaagggtctacgaacgttacggttacgttcccgttaacggttaccgtttagggttttaccggaccgggtaacggtaaccgacggttacggtacgggtaacgttaacgtaaccgtaaaccggtacggtaggtaccggtacgttacccgg

SEQ ID NO: 56179 - DNA, 864 bp, Homo sapiens
  misc_feature: GYAE6OF02GE84J.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtccaggattcagtgggatgttgtgatgactcagtctccactctccctcgcccgtccacccttggacagccggcctccatctcctgcaggtctacgtacaaacgcctacgtactacactgatacggaaacaccgtgccttggtattcggtatcctaccgacgccggcgacggcctaaactcctaccgaaacggaccgtaccttaaattttaacgttaaacgggttttaccgtaaaccggggtaccgttacggttaccgggggttaccccgaacgtaaccgtaacgtaactttaccggaaggtacgggtaccgtagggttacggggtaccgaaggaccctacggttaggtacggtttaccaacgtaacgtaacggtaaaaactcggtaaacggtaccggtaaaggggggtacgggtaacggggtccgtagggtaacggggttaacttaggggttttaaacggggttaaaattttttaacgtttaaccgggttacggtaccgtaaacgttacgggaacgggtttaaacgggttaccggtaccgtaaacccgttaggtttaccccgggtccctttaaccccggggttacgttttaccggtttacccgggggtaaacccgggtaacccgggggtaaccggtaaccgggttaaccggttaccggggtaaaccgtaaccggttaaaccggtaaaaacccggttaacggtttaccgggtacccgggtagtttaaccccggg

SEQ ID NO: 56180 - DNA, 845 bp, Homo sapiens
  misc_feature: GYAE6OF02H9DOT.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggatgttgtgatgactcagtctccactcctccctcgcccgtccacccttggacacggccgcctccatctcctgcacggtctagtacaaacgtcctagtactacactgaatggaaaccacgtgcctggtagttggtactccaaccgtaggccggaccgaacggtaccaaacgttcctaaccggaaacggtccgtaacctttaaagttttaagttaaacgggtttacccgtaaacccggggtaccttccgggtaccggggttacccaacggtaccgtaacggtacttaccggaaggttcgggacgtagggtcgggtacgaacggtctaacggtgtacgttaccaacgtaacgtaacgaaaacgttcagggtacggtaacggggttggaacggtcgttagggaaagggttacgtttaacgggttaaggtttaaagtttttaacgtaaacgttacggacgtttaacggtacggtaaccggtaaagggttaccggtaccgttaaacggtttaccggttttaccgggaccccgttttacccgggttaaccgttttacccgggttttaccggggaaaccccggggtaaccgggggttaaaacccgttacgggtaaccgggtttaacgggtaaccggttaaaccgttaaaccgggtaaaaacccggttacgggtttacggttaaccgggaccgtttaacccggg

SEQ ID NO: 56181 - DNA, 790 bp, Homo sapiens
  misc_feature: GYAE6OF02H5IJV.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggattcgaggtggggattggttgtgatgactcagtcctccactcctccctcgcccgtccacccttggacacgccggcctccactctcctgcgaggtactagacaaagtcctagtactacacgtgaacgtacggaaacctaccgtgtaccgtaggtagttacggtaactccgaccgaacggaccggacccgaacggaccctaacgtccgtaaccgaacggtacctaaccgtttaaattttacgttaaacggtttaccgtaaccgggtaccttcgggtaccggggttacccaacggtacgtaagtacgttcgtaagggtcggacggtaacgggtcggggtacaacgggtaccgtaacgttacggtaacgtttaccgaacgtaacgtaaacgaaaacgttcgaaggtacgggtaggggtacgggacggtacggtagggtaaggttaacggtttagggtttaacgttaagtttttaacgtacgtacgttacgtaggtacggtaggtaacggtcgtacgttaacgtacggttacggtacccgttaccgttacgttacggtttacgggaccggtaacggggtaacctaacgggtaccggttaggaaaccgttacgtaaaccggtaaaccgttacgggtacgttacggtacgtaccgg

SEQ ID NO: 56182 - DNA, 978 bp, Homo sapiens
  misc_feature: GYAE6OF02JKE9T.46.34.D01.1.454.CMB.1.raw
  modified_base (269)..(269): a, c, t, g, unknown or other
  misc_feature (269)..(269): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtccaggattcaggtggggatgttgtgatgactcacgtctccactcctccctcgcccgtcacccgttggacacgccggcctccagtcctcctgctaggtctagtcaaacgcctacgtactacactagagtacgaaaccncctgacctggtattggtactccgacgacggccggaccgacggacctaacgtccgtaaccgaacgggtaccgtaaccgtttaaagttttaacgttaaacgggttttaccgtaaaccggggtacgttaccggttcgggggtaaccctaagtaacgacgggtttaacttaccggtaagggtcggtaccggtaaggggttacgggggtaccgaaacggggtaccttaacggtttaggttaaccggtttactaaaccggtaaaccgtttaaaggaaaaacgtaccccgggtaaagggtacccggggttaaaggggggttaccggggtaaacgggttaccggttaacggggtaaacggggttacggtttttaaacggggtttttaaacgggtttaaaacgttttttaaacgggtttaaccggttacgggttaaacccggttaaaggtttaaccggggtaacgttaaaacggggtttccggttaaacccgttaaaccgggtttccgggtttaccccggggtttaaccccgtttaaccggggtttaccgttttaaccggggtttttacccggggaacccgggtttaaaaacggggggtaacccgtttaagggggttaacccggtttaaggggtaaacccggttaaaccggttaaacccgggttaaaaacccgggtaccgggtttaccggggttaccgggtacccgtttaaacccggg

SEQ ID NO: 56183 - DNA, 798 bp, Homo sapiens
  misc_feature: GYAE6OF02HFN0U.46.34.D01.1.454.CMB.1.raw
  modified_base (180)..(180): a, c, t, g, unknown or other
  misc_feature (180)..(180): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctcccngcccgtcacccttggacagccggcctccatctctgcaggtctagtcaaagcctgtactacactgattaggaaaccacctgcctaggtattggtataccaccgacggccggaccgaggacctaaacgtcctaccgaacgggaccgtaccttaaaagttttacgttaaacggtttaccgtaaacccgggtcctttacggtacgggggtaccccaaagggtacaacgtaacgtttcgaacggttcggacgtaagggttcgggtacgacggaccctaacgtcgggtacgtttaccgaacctaacgtaacgtaaaagtccgtaacggtaccgtaagggggtagggacggtaccggttaggaacgggtaagtttggggttaaggtttaaacgtttttaagttaccggttacgtaccgtaagttacggtaaccggtaaggggttaccgtacccgtaacggtaacgtttacccgggtcccgtttacccgggggtaccttaaccgggttttccgggaacccgggtaaccgggggtaacccttaaacggggtcgttaacggggtacgtaaacccgtttaacgggtaaaccggtaaccgttacgggttacccgggttcctaaacccggg

SEQ ID NO: 56184 - DNA, 616 bp, Homo sapiens
  misc_feature: GYAE6OF02FTV9K.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctaccaaggcgaccttaaatttacgtaaggttttacctaaaccggggtacttccgtaggggtacccaaggacagtacttcagtggactaggtgggtcaggcacgtgaagttcaacgtactagaaactcagacgagggtaggacggctggaggtattggttaggtaatttattacgtgtactagtacggtacaagggttcgactaacgttcgttacgggtcccgttaccggttccttacgttttacgggacccggtaaggggtaacccaacggtcgtaggaacggtacttaaccggaaaaccgtaccgtaggtacggtacgtaccgg

SEQ ID NO: 56185 - DNA, 653 bp, Homo sapiens
  misc_feature: GYAE6OF02HKJ2J.46.34.D01.1.454.CMB.1.raw
  modified_base (264)..(264): a, c, t, g, unknown or other
  misc_feature (264)..(264): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtggggatgttgtgatgactcagtcctccactctccctgcccgtcacccttggacagcccgcctccatctcctgctaggtctagtacaaagtcctacgtatacactagatacggaaaccnccgtgcctggtattggactccacgagccggacctaggaccaatccgtaccgaacggtaccgtacctttaaagtttacgttaaacggtttaccgtaaccgggtactacggttcgggacccaagtacagtacttacgaggtgactagggtggtacgaggtcacgtgtacggttacaacgtacgtaagaaactcgaaggtcgaagggtggacggtcgtaggtaggtagttagggttaagttaactttaatacgtagtactaagtacgtagtacggttagacgtacgttacggtcgtaacccgttccggttattaccggtttagggaccggtaacgggtacgaacgtcgtaaggaactaccggtaacaaacggttcgtacggtcgacgtaccg

SEQ ID NO: 56186 - DNA, 660 bp, Homo sapiens
  misc_feature: GYAE6OF02IYSEM.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcaccttggacagccgcctcatctcctgcacggtctagtaccaaagcctacgtatacacgtgataggaaacacctgcctggattggtactcaccagcggccacggaccaatccgtaccgaacgggccgtaccttaaattttaacgttaaacggttttaccgtaaccgggtacttcggtacggggtcccaagacaggtacttcgagtggactaggtcgggtacaggctacgtggtacgttcaacgactaagaaaactcgacggcgtaaggggtggagggtcgtagggaggtagtttacggttaaggttaacgttttaagttacgtaggtactagttacggaacgtaagggtcaacgtacgttagttcggtccgttaccgttcgttacggttttacgggaccggtaacgggtaaccgtaacggtcgtaacgggtagtaacgtacgtaaaaccggtagttcggtacggtactaaccgg

SEQ ID NO: 56187 - DNA, 701 bp, Homo sapiens
  misc_feature: GYAE6OF02FSMR3.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctgggctgctaatgctctggtccaggattcagtgggatgttgtgatgactcagtctcactctccctgcccgtcacccttggaccaggcccggcctccatcctcctgcaggtctagtacaaacgcctacgtataccatagatacggaaacacctgacctggtatttggtactaccacccgaggcccggaccgacggaccctaacgtccgtaccgaacggccgtacctttaaagttttaacgtttaacggtttaccgttaaacccgggtacgttccggttaccgggggtaccctaaggtaacgtacggtactttacgaggttacgggacgtaggtacgggtacgaacgggtccgtaacgttcggtaacgttcgaacctaacgtaacgtaaaacgtcgaacggtacgggagggttacgggaggtaccgtaggtaggttagttaggttaggttaagttttactacgtagtactacgttacgacgtagtcgtactacgttcgtcgtcccgttcgttacgttacgtttcgggaccggtacgggacgtacggtcgtacggtaacgtacgtacgtaaacgtagtacggtacgcgtaacgg

SEQ ID NO: 56188 - DNA, 651 bp, Homo sapiens
  misc_feature: GYAE6OF02F0ZQI.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacacgccggcctccatcctcctgcaggtctagtacaaacgccttcgtatacactgataggaaacacctgcctaggattggtatcaccagcggccaggccaactccaccgaaggccacttaatttagtaacggtttacgaaccgggtactcgtcgggtacccagacgagtactcgaggtggcgaggtgggtcgacggcactaggtacttcacctacgtaagaaaactacgacggtaacggtaggggacgggtacgggtcgtagggtacgggtaagttcggtttaaggttaaatttagttaccgttagtcgtaagttacgacggtaacggtgtaaccgtacgtaacggttcggtacccgtccggttacgttacggtttcggaccggtaacgggtaaccaaggtacgtacggaaggtacgttaaccggaaaaccgtacggtacggtacggtcgtaaccg

SEQ ID NO: 56189 - DNA, 821 bp, Homo sapiens
  misc_feature: GYAE6OF02HIBUT.46.34.D01.1.454.CMB.1.raw
tcagactagcagtacacgaccggtgctcgatttagatcgtctgtgttgggtttgggctgatcaggactcctcagttcaccttctcacaatgaggctcctgctcagctcctggggctgctaatgctcgtcgggtcccaggtattcgaggtgggggtattggttgtgtagtgactcgagtcctccactcctccctcgcccgtctacccttggacacggccggcctccacttctcctgcgtaggtctacgtacaacgccttcgtactacacgtagagtacggaaaccacctgtacctggtacgttcggtaactccgaacccggtcggacccggacccaacgggtaccctaaacgttcccgttaacccggaaacggggtacccgtaacccttttaaaagttttaacggtttaaaacccgggttttacccggtaaacccgggggttacctttacccggggttaccggggtaccccaacggtaacgtaaccggttacttaccgggtaggtacggggtacgtaaccgggttggggtaccgaacggggtactacggttacgtacggttacaacgtacgtaacgtaaacgtcgaacggtacggacggggttacgggacgggtacggtaggtaagggttacgttaggtttaacggtaattttaaggttacgtgtacgtaggtacgtacggagttacgactacgttcggttaccggcccgtttaccgggtgtttacccggtttacgggtacccgggaagggtaacccgtaggtaccggtacgggtaatacgttaacggaaccggttacggttacggtcggtacggtaaccgg

SEQ ID NO: 56190 - DNA, 881 bp, Homo sapiens
  misc_feature: GYAE6OF02HYYD3.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtctacccgttggacacgccggcctccatctcctgcaggtctacgtacaaacgtcctacgtactaacctacgtaggaattacgggaaaacctacccgtcggtaccccgttagggttacgtttacgggttaacttacccgaacccgtaacgggacccgggtaccccgaacgggtaccctaaaacgttacccgtaacccggaaaccgggtcccgttaacccgtttaaaacgttttaacgtttaaaaccgggttttaccggttaaaaccccggggtaccgttaccgggttaccgggggtaccccaaacggtaaccgtaacggttaacgttaccggaagggttacgggacggtaacggggttcggggtaaccgtaacggggtacctaaccggttagggtaacgtttaccgaaaccgttaaccgtaaacgtaaaaacgttacgaacgggtacggtaacgggggtagggtaacgggtccgtaagggtaacggttaaggtttagggttaaggtttaaacttttagtacgtaggtactagtacggacgtaaggtcgtacgtacgtacggttacggtccgttaccggttacttaccgtttacgggacccgggtaacggggtaacctacgggtaaccgttaggggtaaccgtaacgttaaacccggaaaaccgttaaccgggttacggtacggtaccgttaacccgg

SEQ ID NO: 56191 - DNA, 877 bp, Homo sapiens
  misc_feature: GYAE6OF02GXL5T.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggtattcgaggtgggggtattggttgtgatcgactcagtcctccactcctcccgtcgcccgtcctacccgttggaccacggcccggtccctacctacttcctccgtgacgtacggtccgtaacgtacaaacggtcccttacgtaactaaccgacgtaggtaacgtacggaaaaccctccgtggtaccgttagggtagtttcggtacctaccaaccggcgggcccgggaccaccggtaaccctaacgtacccgtacccggaacggtccttaacctttaaaagttttaacggtttaaacgggtttaacccggtaaacccgggtacggttaccgggtccggggtaaccccaaggtaaccgtacgtaacttccggtaaacgggtcgggtaaccggtaggggttcggggtaacgacgggtacaccggtttagggtactttaacccgaacgtaaccgttaaacggaaaacgtccgaagggacgggtaaggggtcggggaacgggtcgtaagggtacgggtaagttttacggggttagttaaacgttttacgtacgtacggtaacgtagggtacggtacggtaaagggttccgtaacgttaccggtacggttaccggtaccccggtttcggttaccggtttaccggtttaccgggacccgggttaacgggaaccggtaacgggtcgtaacgggtacgttaacggtaaccggtaaaccgggttacggtacggtcggaccctaccgg

SEQ ID NO: 56192 - DNA, 706 bp, Homo sapiens
  misc_feature: GYAE6OF02IFCK0.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtcacccttggacagccggcctccgatctcctgcaggtctagtcaaagcctagtatacactgatggaaacactgcctggacttggtatcacagcggaccaggcctaatcctaccgaacggccgtacctaatttagtaaggtttcgtaaaccgggccttcgtcggggtacccaggtacctaagtacgttacgaacggtttcggacgtaacgggttggggttaaccacggggtaccgtaacgttcgggtaacgtttaccgaacgtaccgttaaaggtaaaaacgttaccgaaagggtaccgtaagggggtacgggaacgggtacctagggtaaggtaggttaggttagggttaaacttttagttaccgtaggaccttagtacgtaccggtaaggtcgaccgtaacttacggttacggtcccgttaccggtacgtaccgttttaccggaccggtaacggggtaacctaacggtccgtaaggtacgtacgtaacgtaaaccggtacgtacggtaccggtataaccgg

SEQ ID NO: 56193 - DNA, 660 bp, Homo sapiens
  misc_feature: GYAE6OF02IAS0D.46.34.D01.1.454.CMB.1.raw
tcagactagcagtacacgaccggtgctcgatttagatcgtctgtgttgggtttgggctgatcaggactcctcagttcacttctcacaatgaggctccctgctcagctcctggggctgctaatgctctgggtcccaggattcaggtgggatgttgtgatgactcagtctccactctccctgcccgtcacccttggacacgccggcctccatctcctgcaggtctagtacaaagcctcgtatacactgaagtaggaaaccaccgtgccgtaggtattaggtatacaccgacgcggccacggaccaactccaccgtaacggcctaccttaaatttagttaacggtttccgtaaaccgggtcctcggttacggggcctagacctagtactcgacgtggacgtaggtggtacagggcctacgtgtacgttacaacgtacgtaagaaaactcgacgacggtaaggggacgggtaggcggtaaggacgggttagttacggtttagtaacttttacgtacgtacgtactaagtcggtactaagggtcgtactaacgttacggtcggtacccgttccggtactttacggttacgggtaccgaacggggtaaccacggtaggtacggtaacgaacgttaacaaaccggttagttcggtacggtctaccgg

SEQ ID NO: 56194 - DNA, 766 bp, Homo sapiens
  misc_feature: GYAE6OF02IRX7H.46.34.D01.1.454.CMB.1.raw
  modified_base (278)..(278): a, c, t, g, unknown or other
  misc_feature (278)..(278): n is a, c, g, or t
  modified_base (530)..(530): a, c, t, g, unknown or other
  misc_feature (530)..(530): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctcgtgggtcccaggattcagtgggggattgttgtgatgactcagtctccactcctccctgcccgtacctacccgttggacacggcccggccctccatcctccgtgcgacgtctacgacaaacgtcctacgtatacacgtgacgtacggaaaccncgtcgcgtggtaacttggtacttaccaccgtacggcccggacccgtacggacctaaacgtccgtacccggaagggtccctaacctttaaagttttaacgttaaccgggttttacccgtaaacgggttaccttccgggttacgggtaccccaaggtaaccgtagtacttccggaaggtcggtacgtcgggttaggtaccacgggactacgtcgtaacgttcctaacacgttaaacgaaacgtacgagtacggngggtacgggacggtacgtaggaggtagtttaggttagtttaaactttagtttacgagtacgttaggtacgtacgtaacggtgtaaccttacgttaggttacccggttcccgttaccggtttaccgttaccggttttaccgggaaccgggtaaccggtaaacccggtagtccggttaaggtaaccgtaaccggttaacgtaaaccggttaacggtcgggttacgtacccgtaaccgg

SEQ ID NO: 56195 - DNA, 587 bp, Homo sapiens
  misc_feature: GYAE6OF02HE0XF.46.34.D01.1.454.CMB.1.raw
  modified_base (254)..(254): a, c, t, g, unknown or other
  misc_feature (254)..(254): n is a, c, g, or t
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctctgggtcccaggattcagtggggatgttgtgatgactcagtctccactctccctgcccgtcacccttggacagcccgcctccatctcctgcaggtctagtcaaagcctcgtatacactgagtagaaacncctgcctagtattgtatcaccngcgcaggcaanctcagctactaatttanagttcacggntcgtcggccagacagntgagtgnaggtggcaggcacgtgattcacaacgtanaaagtnaggacgagggtaggaggtagtcggaaggtacgtttagtttagggttaaatttacgtttacgtagtactagtacggtacgtagggtacgtacgacgttacgttcggtaccgttacccggtagttaccggttttacgggaccggacggggtaaccacgggtacctacgggtaacgtacgttaaccgtaaaccgtagttaccggtaggtacgtaccgg

SEQ ID NO: 56196 - DNA, 832 bp, Homo sapiens
  misc_feature: GYAE6OF02IVFMP.46.34.D01.1.454.CMB.1.raw
  modified_base (165)..(165): a, c, t, g, unknown or other
  misc_feature (165)..(165): n is a, c, g, or t
tcagactagcagtacacgaccggtgctcgatttagatcgtctgtgttgggtttgggctgatcaggactcctcagttcaccttctcacaaatgaggctccctgctcagctcctggggctgctaatgctctgggtcccaggattcagtggggatgttgtgatgactnagtctccactctcctgcccgtcaccttggacagccggcctccatctcctgctaggtctagtaccaaagtcctcgtaatacacgtgaatacggaaaacctacctgtccctagggtacttggtaactccgtaacccgacggccggacccgaacggtaccctaaaacgttccctaaccggaacgggccgtaacctttaaaattttaaggttaaaacgggtttttaccgaaacccggggtactttaccgggtaccggggtacccaaggtaaaccgtaacggttacttacgaacggtgggacgtaaggggttacggtacgacgggtctaacgttggtacgttacaactaacgtaagaaaactcgaacggacggtaaggggtacgggaacggtcgtagggtaagggttaacgtttagggtttaaggtttaaagttttaacgttaacgtacgggtaccgtaagttacggtaacgtaaacgggttacgtaaccgtaacgttacggttaccggttacccgtttacccgggttaaccggtttaccgtttttaccggggaacccgggttaaaccgggggtaacccgtaaaacgggttccgggtaacgggttaaccgtaaacggttaaaccggtaaaacggtaaccggtttaccgggttaccgggtaccgttaaccggg

SEQ ID NO: 56197 - DNA, 718 bp, Homo sapiens
  misc_feature: GYAE6OF02JQRCF.46.34.D01.1.454.CMB.1.raw
  modified_base (712)..(712): a, c, t, g, unknown or other
  misc_feature (712)..(712): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctctgggtcccaggattcagtgggatgtgtgatgactcagtctccactctccctgcccgtctaccgtggacagccgcctcatcctcctgacaggtctagtacaacgtcctacgtataccacgtagagtaccggaaactccgtgtaccgtaggtaattggtaaactccgaccgacggaccggacccgaaggccctaagttacccgccggaaaggtcctaacctttaaagtttaacgtaacggttttcccgtaaaccgggttcttaccggtcggggtaccccaaggtaaccgtaggttaacttcggaaggttcgggacggtacggtttacgggaccgaacgggtaccttaacggtacggtaacgttaccgaaccgtaaccgtaaaggtaaaaacttcggaacggtaccggtaggggtacgggtaacggtcgtaaggtacggtagtttaggtttaagttaacgtttaaagttcgtagactaggtaggaagtacgtagacttacggttactcggtacctacgggttcttacggttcggaacggtacgggaacctggtactacggtagtaacgtacgaacgtacggtgttacgnggtacg

SEQ ID NO: 56198 - DNA, 628 bp, Homo sapiens
  misc_feature: GYAE6OF02IOITV.46.34.D01.1.454.CMB.1.raw
  modified_base (282)..(282): a, c, t, g, unknown or other
  misc_feature (282)..(282): n is a, c, g, or t
  modified_base (391)..(391): a, c, t, g, unknown or other
  misc_feature (391)..(391): n is a, c, g, or t
tcagactagcagtacacgaccggtgctcgatttagatcgtctgtgttggggtttgggctgatcaggactcctcagttcaccttctcacaatgaggctccctgctcagcctccgtggggctgctaatgctcgtcgggtcccaggtattcaggtggggatgttgtgatgactcagtcctccactcctccctgccccgtcacccgttggaccacggcccgtcctccatcctctgcgtacggtctacgtacaaacgtcctacgtactacactagatacggaaaccncctgccttggacgttggtcacacaggccgccgaggccaatccacgaacggcctacttaattataacggttcaacggtctcgtcggaccagtaacagtactcgagtcggntaggttggactacggctacgtgacttacactactaaagaaactcgacgacggtagggtggaaggtcgtaggaagttagttaggttacgttaagtttactagacgtacgagttacgtacgtaaggtactactacgtcgttccgtaccgttcgtcgttacgttacggaccggtacggtaaccgaaggtcgtaacggacgtaacgtaaccgtaaacgtacgtacgggtcgtacgtacccg

SEQ ID NO: 56199 - DNA, 860 bp, Homo sapiens
  misc_feature: GYAE6OF02FY66R.46.34.D01.1.454.CMB.1.raw
tcagactagcagtacacgaccggtgctcgatttagatcgtctgtgttgggtttgggctgatcaggactcctcagttcaccttctcacaatggacggctccctgctcagcctcctggggctgctaatgctcgtcgggtcccaggattcaggtgggggatggttgtgactgacctcagtcctccacgtcctcccgtcgcccgtaccaccccgtttggaccgacggtcccggtccttaccacttcctccgtggccgtaggtcctaacggtacaaaacgtccgttacgtaataccacgtacggaattacgggaaaacctaccgtcggaccgttaggtacgtttacgggttaactacccgaaccgaacggtccggaacccgaacgggacctaaactccgtaacccgaacggggtcctaaccgtttaaaggttttaacgttaaaccggggttttaccgtaaacccggggtaccttcggttaccgggggtaccccaaggaaccgtagttacgttaccgaggtacggacggtacgggttcggggaccgtacgggtctacggtcggtaacgttaccgtaacgtaaacctaagtaaaaaccgttcggaacgggtacgggttaacggggttacgggtacgggtaccgtaggggttaagggttacggtttagggtttaacggttaaacgttttaacgttacgtacggtaacgttaggtacggtacggtaagggtccgtaacgtacgttaacggtccggttcccgtacgggttacgttaccggtttcgggaacccgggtaacggggtaaccgtaacgggtccggtaggtaacgaccgtaacgtaaacccggtacgtcgggttaccgcgtaccg

SEQ ID NO: 56200 - DNA, 692 bp, Homo sapiens
  misc_feature: GYAE6OF02HVFYB.46.34.D01.1.454.CMB.1.raw
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttgacagccgcctccatctcctgcatgtctagtnaaaacgcctacgtanacactgatagaaacnctgctaggattgatcacgagcgaccaggtacaacgtctaccgaaggccgtaccttaaatttaagtaacgtttacgtaaaccgggtacttacggacggggtacccagaacgtagtaactttcgaggtacgacgtaggtcggtacgaacgggtcaacgtgtacgttacgacctaacgttaaagtaaaactcgtaaggacggtaagggggtaggtacgggtacgtaagggaagggttaagtttaagggtttaacggttaaaagttttacgtttaacgtcgtaacgtaagtacggtaacgtaaaggttcgaacttaacgtacggttaccggtccgttaccggttacgttaaccggtttacgggaacccggtaacgggtaacctaaacggcgtaagggaacgtaacgtaaaccggtaaaaccgtacggtagttacggtaacg

SEQ ID NO: 56201 - DNA, 944 bp, Homo sapiens
  misc_feature: GYAE6OF02H7PD4.46.34.D01.1.454.CMB.1.raw
  modified_base (311)..(311): a, c, t, g, unknown or other
  misc_feature (311)..(311): n is a, c, g, or t
tcagactagcagtacacgaccggtgctcgatttagatcgtctgtgttgggtttgggctgatcaggactcctcagttcaccttctcacaatgaggcctccctgctcagctcctggggctgctaatgctcgtgggtcccaggtacttcaggtgggggattggttagtgatgactcgagtcctcccacttcctcccgtcgccccgtcctacccgttggaccaccggcccggccctccactccgtcctcgcgtaggtcctacggacctaaacgcccttagtaaccttacgactacgtaacgtaacggtaaacccnccgttcggacccgttaggtagttacgggtaactccgaaccgacggaccggtacccgaacgggaccctaacgtccgtaacccgaacgggtaccgttaacccgtttaaattttaaccggttaacgggtttaacccggtaaccccgggttacttccgggtaccggggtacccaaacggtacttaaacggtaccgttactacggggtacgggtccgtaaaggggttccgggtacgtaacgggtacccgtacggtttagggtaccggttacccttaacgaaccttaaacgggtaaaaccgttcggaaaccggtccggggttaaagggggtacggggtaacggtacgggttagggaaccgggttaaaggtttacgggtttaaggttaaaccgtttttacgtaaagtcggttaacgtaccggtttaagaccggttaaagtaccggtaccgttaaacgttccgggtttacccggtaacccgttttccgggttaaccgttttacccgggtttacgggggtacccccgtaaaacgggggttacccggttaaaccggtagggttaacccggttaaacgggtaaccctaaccgggttaaaaccggtttaccgggttcggttaaaccggggtcccttaaacccggg

SEQ ID NO: 56202 - DNA, 674 bp, Homo sapiens
  misc_feature: GYAE6OF02FZ625.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtacaaagcctcgtatacactgatacggaaacacctgcctggattggtatcaccaggccggaccacggccaatcctaccgaaggtccgtaccttaatttacgttaacggtttaccgtaaccgggtacttcgtcggggtacccagactagtattaccgaggtggcgtaggtcgggtacgaggtccgacgttcggagttaccactaacgtaagaaactcgaaggacgtaggggtgggacggtacgtagggaaggtagttacggtttaggttaagttttaacgttacgtgtacgtagtacggtacgtaaggtcgtacgtacgtacgtttccggtacccgttccggttaccgttaccggttttacggacccgggtaacggggtaaccgtacggtaccggtacgggtacgtacgtaaccggtaaaccgtaccggtacggttacggaccgtaccgg

SEQ ID NO: 56203 - DNA, 766 bp, Homo sapiens
  misc_feature: GYAE6OF02H7I91.46.34.D01.1.454.CMB.1.raw
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtgggtcccaggattcgaggtgggggattgttgtgatgactcagtcctccactcctccctcgcccgtccacccgttggacacggccggcctccatctcctgctaggtctagtacaagtcctagtactacactgatacggaaaccnccgtgaccgtggtattaggtacnccaacgacggccgaccgacggacctaacgtcctacgaacggtcctaacctttaaagttttacggttaacggttaccgtaaaccgggtcttaccgggtacgggtacccaaaggtactaaacggtcgttacgaagggttcggacggtaagggttcggggtaacccaggggtacctaacgttagggtaccgttaacccgaacgtaacgtaaacgtaaaacgtcggaacggacggttagggggtaggacggttggtaacggtaggttacgttttaggttaaacggtttaatttttaacgtacggtacgtacgttaagtacggtacgtaaaggggtctaaccgttacgtaccggtttaccggacccgttttaccggtaccgtttaaccgggttccgggaccgggtaacgggtaacccgtagtccgggtaacggtagtaaccgtaaccggtaacgtacggttggtacggacctcgg

SEQ ID NO: 56204 - DNA, 774 bp, Homo sapiens
  misc_feature: GYAE6OF02IY6ZL.46.34.D01.1.454.CMB.1.raw
  modified_base (278)..(278): a, c, t, g, unknown or other
  misc_feature (278)..(278): n is a, c, g, or t
  modified_base (435)..(435): a, c, t, g, unknown or other
  misc_feature (435)..(435): n is a, c, g, or t
tcagactagcagtacacgaccggtgctcgatttagatcgtctgtgttggggtttgggctgatcaggactcctcgagttcaccttctcacaatgaggcgtcccctggcctacagctccgtggggctgctaatgctcgtgggtcccaggtattcgaggtggggatgttgtgatgactcacgtctccactctccgtgccgtcacccgttggacaggccgcctccatcctcctgctacggtcctacgtacaaacgtcctacgtactacactgataggaaacncctcgtccgtaggattcgtactccgaaccgcggccgcgacggcctaatcctaccgaggccgtacctttaagtttacgtaacggtttaccgtaaccgggtactcggtacggggtacccaaggtacctagtacttcgaaggtcggacgtggtcgggtanaacggtctacgtcggtacgttaccaacgtacgtaacgtaaaacgtcgaacggtcggtaacggggtacgggtacggtaccggtagggaacgggttaacgtttacggtttaacggtttaaacttttaaccgtttacgtacggtaacgttaacggttacggtaaccgtaagggttaccgttacgtaaccgttcgggttaccggttaacccgggttacccgggtttaccgttaccgggtttaccgggaaccgggtaacggggtaacccttaagggtaacccgtaacgggtacggtaacgttaacggtaaaccggtaacgttcggtaccggtaccgttaaccgg

SEQ ID NO: 56205 - DNA, 695 bp, Homo sapiens
  misc_feature: GYAE6OF02FP6RK.46.34.D01.1.454.CMB.1.raw
  modified_base (273)..(273): a, c, t, g, unknown or other
  misc_feature (273)..(273): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctcgcccgtccacccgttggacacgccggcctccatcctcctgcgtaggttctagtaccaaacgtcctacgttaataccactgagtacggaaacncctgcctggtattggtatccaccgagcggaccacggccaactccaccgaaggccgtaccttaattagttaacgtttccgaaccgggtactccggtcggggtaccctagaacgtagtacttacgaggtcggacgtagggttcggggtacgacggtaccgtacgttacggtaccgttacaaccgtaactaacggtaaaactcggaaggtaccggtaggggtacgggacgggtaccgtagggaacgggttattacgggtttagttaaacgttttacgttaacgtacggtactacgtacgtaggtacggtagaccgtagttacgtcggtacccgttacggttacttacgggtttcggacccgggtaacgggtacgtaacggtaggtaggtaacgactaaccggaaagtacgtggtaccgtgtaccg

SEQ ID NO: 56206 - DNA, 673 bp, Homo sapiens
  misc_feature: GYAE6OF02GQMAY.46.34.D01.1.454.CMB.1.raw
  modified_base (258)..(258): a, c, t, g, unknown or other
  misc_feature (258)..(258): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagcccgcctccatctcctgcaggtctagtacaaacgcctacgtatacactgataggaaacncctgcctggattggtactcaccgaggccggccgaggacccaaactccgtacccgaaagggtccgtacccttaaattttacgttaaacgggttttccgtaaacccggggtacttccggttcggggtaccccaaggtacctaagtacttcgaggtggcgtaggtcgggtcaggcacgtgtacgttcactactagaaaatcgaagacggtagggtaggacggcgtaggaaggtagttaggtttaggttaattttagttactagactacggttagacgtaagggtcgtaacgtacgtaacgttccggtacccgttcccgggttacgttaccggttttacgggacccggtaaggggtaaacccgtaggtacggtacggaacgtacgtaccgaaacgtacggtacggtacggcgttaaccg

SEQ ID NO: 56207 - DNA, 741 bp, Homo sapiens
  misc_feature: GYAE6OF02IFFNN.46.34.D01.1.454.CMB.1.raw
  modified_base (167)..(167): a, c, t, g, unknown or other
  misc_feature (167)..(167): n is a, c, g, or t
  modified_base (171)..(171): a, c, t, g, unknown or other
  misc_feature (171)..(171): n is a, c, g, or t
  modified_base (466)..(466): a, c, t, g, unknown or other
  misc_feature (466)..(466): n is a, c, g, or t
  modified_base (506)..(506): a, c, t, g, unknown or other
  misc_feature (506)..(506): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtgggatgttgtgatgactcgngtcnccactctccctcgccgtacctacccgttggactacggcccgtcctccatcctcctgactagtctagtcaaagccctgtactacacgttgactacggaaacctcctcgtcctggacgtttggtaaccttccaccggacggccggaccgtacggtacctaacgttcctaaccgaacggccgtaacttaaacgttttaacggttaacggtttacccgtaaaccgggtcctacggggttaccgggtacccaaggactacgtacgttacgacggtacggtacgtaacgggtcggttaacncgggtactacgttgacgtttacacgtacgtaaacgaaacncgtaagtacggagggtacgggagtcggtaggtacgggttaagttaggttacggttaacgttttagtacgtcggaattaggtaacgtaccggtaaggttcgaccggttaatccgggttacggtcccgttaccgggttaccttacggtttaccggaccggttaacgggaaccgtagggtcgtaacggtaggtaaccgtacggtaaaaccttcgggaccgtttcgggaaccgttacgg

SEQ ID NO: 56208 - DNA, 754 bp, Homo sapiens
  misc_feature: GYAE6OF02IJCDP.46.34.D01.1.454.CMB.1.raw
tcagactagcagtacacgaccggtgctcgatttagatcgtctgtgttgggtttgggctgatcaggactccccagttcaccttctcacaatgaggctccctgctcagctcctggggctgctaatgctctgggtcccaggattcaggtggggatgttgtgatgactcagtcctccactctcctgcccgtcacccttggacacgccggcctccatctcctgctaggtctagtacaaacgtcctagtatacactgactacggaaacctccgtcgccgtaggtacttggtaactcaaccgaggccggtaccgacgggtaccctaagtccgtacccgaagggtcctaccttaaaagttttacgttaaacgggttttaccgaaaccggggtacttaccggttacggggtaccccaaggtactaaggtactttacgaacgggttcgggtttaaggtcggggtacctaacggggtacctaacgttcgggtacgtttaccgaacgtaacgttaacgtaaaacgttacgacggtacggtaaggggtacgggtaagggtcggtaggtaagggtaggttaggtttaaggttaaatttaacgttacgttaggtactagtcggtaacgtaacgggtcgtacgacgttacgtaccggtaccgttaccggttacgttaccgttttcgggaccgtacgggtaaccgacggtacggtacggtaacgtaacgtaaccgtaacggaccggttagtcggtacgtaccgacctaccg

SEQ ID NO: 56209 - DNA, 869 bp, Homo sapiens
  misc_feature: GYAE6OF02JJAQZ.46.34.D01.1.454.CMB.1.raw
  modified_base (105)..(105): a, c, t, g, unknown or other
  misc_feature (105)..(105): n is a, c, g, or t
tcagactagcagtacacgaccggtgctcgatttagatcgtctgtgttgggtttgggctgatcaggactcctcagttcaccttctcacaatgaggctccctgctcngctcctggggctgctaatgctcgtcggtccaggtattcgaggtggggtattggttgtgatgactctagtcctaccactcctccctcgtcccgtactacccgttggactaccggcccggtcctcctactccttccgtacgccgtaacggttctacgtaccgtaaacggtcccgttacggtaattaccgagttacgaagttaacggaaacctccgtacggtaccgttagggttactttacggtaactaccgaccggacggtaccgggtacccgtacggaacccgttaaccttccggttaacccggaacggtacccttaaaccgtttaaacgttttaacggtttaaaacccggggttttaccgttaaaccccggggttacggtttcccgggttaccggggtacccgtaaggtaaccggtacggttaacgttcgaaacgggtttcggtacggtaacgggttccgggtaacgtacggtaaccgtacggtcgtaaccgttcgaacgtaacgtaactaaacgcgacggtacggtacgggtacggtacggtacgttaggaaggttcgttaacggttagtttaacgttacgtttactaacgttcgtaagtacgtacggtacgggtaacttccggagtttacggtacccggttaccgttaccgggttaacccgttggtttaacccgggtaccggttaacggtaacggtaccggtacggttacggtaacgtaccggttaacctaacgggtacgttccggttacggtacgttccgg

SEQ ID NO: 56210 - DNA, 853 bp, Homo sapiens
  misc_feature: GYAE6OF02HJ7XA.46.34.D01.1.454.CMB.1.raw
  modified_base (156)..(156): a, c, t, g, unknown or other
  misc_feature (156)..(156): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatagctctgggtcccaggatcagtggggatgttgngatgactcagtctccactctccctgcccgtcacccgttggacacgccggcctccatctcctgcaggtctaagtacaaacgtcctacgtactactacgtaggtaatacggaaaacctaccgttcggaccgttgggtaactttcgggtaactcccgaaccgaaggtccggaccccgaacgggaccctaaacgttacccgtacccggaaacgggcccgttaacctttaaaacgtttttaacggttaaaacgggtttttacccggtaaacccgggtaccgttaccgggttcgggggttaaccccaaggtacccgtaaggtacttacgtacgggttacggcgttaacgggttcgggtaacgtaacggggccttaacggtagggtttaaccgttaccaaaccgttaactaagtaaaacttaccggaagggtaccggtagggggttacgggaacgggtaccgttaggggtaagggttaacgttttagggttaaacgggtttaaacttttaacggttactacgtacgtaacggttacggacgttaaggtcggtaactaacgtttaccggttcggtaacccgtttcgggttacccgttttagggttaccgggtaccggtaacggggtaacccgtaagggtccaaggggtaacgttaaccggtaaacccgtaaaggttacccggttagggtacccgggtctaacggg

SEQ ID NO: 56211 - DNA, 560 bp, Homo sapiens
  misc_feature: GYAE6OF02IN77Y.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactctccctgcccgtcacccttggacacgccggcctccatctcctgcagtctagtcaaagcctcgtatacactgatggaaacacctgcctggattggtatcaccagcggccaggccaatcctcaacggcgtacctaatttataaggtttctaaccgggactcgtcgggtccagacagacttcgagtggcgaggtggtcaggcacgtagagttcacatagaaatcgagcgagggtgaggctggaggtattgtagtaatttatatgactagtgacgtaggtgacacgtagttcggccgtccgttactaccggtttgccgggtaacgggtaccctaaggtccgtacggaagtactaaccgtaaaccgtacggttacggtcgtacgtaccgg

SEQ ID NO: 56212 - DNA, 746 bp, Homo sapiens
  misc_feature: GYAE6OF02JY96K.46.34.D01.1.454.CMB.1.raw
  modified_base (126)..(126): a, c, t, g, unknown or other
  misc_feature (126)..(126): n is a, c, g, or t
  modified_base (200)..(200): a, c, t, g, unknown or other
  misc_feature (200)..(200): n is a, c, g, or t
  modified_base (614)..(614): a, c, t, g, unknown or other
  misc_feature (614)..(614): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctntgggtccaggattcaggtggggatgttgtgatgactcagtcctccactctccctgcccgtctacccgttggacncgccggtcctacatcctcctgcagtctagtacaaacgtcctacgtatacacgttagagtacggaaaacctctgtacccgttaggtacgtttacgggtaacgttccaccgtacggccggtacccgaacggggacccctaaaggttccccaaccggaacggggtacccttaaccgttttaaaagttttaacgtttaaacgggttttaccgggtaaacccgggtaaccggttccggttacgggggtacccaacgggtacctaaggttaacgttcgtaggtacggtacgtaagggttcgggtacaagggcctaagttcggtacttaccgaactaacgttaacgaaagttccgaaaggtccgtagggggtagtaacggtacgtaggaagggtcttaagggttacggttaattagttacncgtacgtatcggtaaggtacgtagctaacgttgtcggttaccgtcgttaaccttcgttacggaccgggaacgggtacttacggacgttagggacttaacgaacggtaacgtacgttacgggtccaggtaccg

SEQ ID NO: 56213 - DNA, 737 bp, Homo sapiens
  misc_feature: GYAE6OF02H2JM4.46.34.D01.1.454.CMB.1.raw
  modified_base (201)..(201): a, c, t, g, unknown or other
  misc_feature (201)..(201): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggatgttgtgatgactcagtctcactctccctcgcccgtctacccttggacncggccgtcctccatctcctgcacggtctagtcaaacgcctcgtatacactgatacggaaacctacctcgaccgtggtagtttggtactaccaccgaacggccggacccacgggacctaaactccgtacccgaacgggccgtacctttaaacgttttaagttaaacgggttttacctaaaccggggtaccttaccggtcggggttacccaaggtaaccgtaagtaacgtttaccgtagggttcggacggtacggttacggggtcgtacgggtactacggttacggtaacgtttaccaacgtaacgttaacgaaaaacgttcgaaacgggtacgggtaagggggttagggacgggacggttaagggtaagggttacgtttacgggtttaagggttaaactttttagttaacgtcgtacgtaagtacggtaggtacggtgactagtacgttcgccgttcgtacgttacgttcggtaccggacgggaaccgacggtcgtacggacgtaacgtacgaaccggtagtacggtcggtctaccg

SEQ ID NO: 56214 - DNA, 698 bp, Homo sapiens
  misc_feature: GYAE6OF02IRHII.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggggatgttgtgatgactcagtctccactcctccctcgcccgtcacccttggacacgccgcctcattcctcctgcgtaggtctaagtacaaacgcctacgtatacacgtgatacggaaacacctgccgtggtattggtactcaccacgccggcaggtcaacttccgaccgaggcctaccttaaagttttacgtaacggtttacgtaaaccgggtcttccggttcgggtaccaggaccagtacttacgagtcggcgtagggtggtacgacggactaacggtggtacgttacaacctacgtaacgtaaaagtacgaacggtggaagggggtacggtagggtacgtagggaagggttagttagggtttaaggttaacttttaacgttaactgtacgtagtacgtacggtaaggttacgaacgtactaacggttcggtaacccgttccggttacgtttaccggttttcgggacccggtaacggggtaacccgtaaggtacggttacggtaacgtacgtaaaccggaacgttaaccggtacggtacggtacgtacgg

SEQ ID NO: 56215 - DNA, 780 bp, Homo sapiens
  misc_feature: GYAE6OF02FS2LQ.46.34.D01.1.454.CMB.1.raw
  modified_base (201)..(201): a, c, t, g, unknown or other
  misc_feature (201)..(201): n is a, c, g, or t
  modified_base (274)..(274): a, c, t, g, unknown or other
  misc_feature (274)..(274): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtcgggtcccaggattcaggtgggggatgttgtgatgactcagtctccactctccctgcccgtctacctggacncgccggtcctccactcctctcgcacggttctagtacaaacgtccttacgtataccacgtagatacggaaaccnccgtagccgtaggtagttaggtactaccgaccgacggccggaccgacggaccaacttccgtaaccgaacggccgttaaccttaagttttaacgtaacggttttaccgaaccgggtactcggttaccggggtaccacggtaacgagttacttaccgtagggtacggtacgtagggtcgggtacgagggaccttacgtacgggtacgttacgtaacgtaacgtaacgtaaaacgtcgacgggtacggtaaggggtacggtaacggtcggtaagggtaaggttagggttacggttttaacgggttaaacttttaagttaccggtacgttaacgtagtacggtacgtaagggtacggaaccgttacgttaacgtccgggttacccgtttacccgggttacggtttaccggtttccgggaacccggtaaccggggtaacccgtaacggtcgttaagggaacgtaaccgttaaccgtaaaacgggttcgttagggtaccgtacggtaacccg

SEQ ID NO: 56216 - DNA, 779 bp, Homo sapiens
  misc_feature: GYAE6OF02GJA0A.46.34.D01.1.454.CMB.1.raw
  modified_base (269)..(269): a, c, t, g, unknown or other
  misc_feature (269)..(269): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtgggtcccaggattcaggtggggatgttgtgatgactcagtcctccactcctccctgtcccgtcacccttggacacggcccgcctccatctcctgcagtctagtacaaacgcctacgtataccatgaacgtacggaaacnccgtgtccgtaggtattggactccgaccgtaggcccggaccacggacctaacgtccgtaccggaacggcctaacctttaaagttttaacgttaacgggttttaccgtaacccgggtaccgttccgggtaccggggttaccccaagtaacgtacggtacttcgaaggtcgggacgtagggttcgggtaccaggtacctaacggtaggtaaccgttaccgtaacgtaaacgtaaacgaaaacgttccgaaacgggttacgggtaaacgggggtacgggaacgggtacgtacggggtaaaggttaggtttaacgggtttaaggtttaaactttttacggtacgtacgttacgtaaggtacggtacggtaaggttcgtacgtaacgttacgttaccggttcccgttaccggtaccgtttacggtttccggaaccgggtaacgggtaacctaacgggtccgtaacggaacgtaacgtaaccgtaaaccggttaacgtcggttacggacctaccgg

SEQ ID NO: 56217 - DNA, 753 bp, Homo sapiens
  misc_feature: GYAE6OF02GZOAN.46.34.D01.1.454.CMB.1.raw
  modified_base (249)..(249): a, c, t, g, unknown or other
  misc_feature (249)..(249): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcgagtggggatgttgtgatgactcagtctccactcctccctgcccgtcacccttggacagcccggcctccactctcctgcaggtctagtcaaacgcctacgtactacnctgataggaaaccactgcctggtagttggtactcaccgaggccggtaccaggcctaatccgtaccgaacgggcctaccttaaattttaacgtaacgggttttaccgtaacccgggtacttccggtacggggtaccccaaggtaccgagtacgttccgaagggttcggcgtaagggttcgggtaccaacgggtcctaacgtaggtacgtttacgaaccgtacgtaaaggtaaaactacggaacggtacggtagggggtaggacgggtgtacggtaaggttacgtttagggttaaggtttaaacgtttaagtttacgtacggtacgtaacgtacgtaacggtaagggtaacgtaccgtaggttaaccggttccggttacccgtttacccgggttccgtttaccggttttacgggaccgggttaacggggaacccgtaacggtacggttacgggtaacgtaacgtaaccggtaaacggttaacggttacggttacggaccgttaccg

SEQ ID NO: 56218 - DNA, 862 bp, Homo sapiens
  misc_feature: GYAE6OF02F3HCA.46.34.D01.1.454.CMB.1.raw
  modified_base (258)..(258): a, c, t, g, unknown or other
  misc_feature (258)..(258): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcgagtgggatgttgtgatgactcagtctccactctccctgcccgtcaccttggacagccggcctcgatcctctgcctaggtctagtcaaagcctcgtactacatgagtaggaaaccncctagccttaggtattggtactccgaaccctaggccggaccacgggaccaaacgttccgttacccgaaggtcccgtacctttaaagtttaacgttaaaacgggttttaccctaaaaccggggtcctttccggttacggggtaccctaaggaacctacggtactttcgaaggttcgggacgtcggtagggtaccgacgggtacctacttacgggtacgtttacctaacgttaaccgtaaacggtaaaagttaccgtaacgggaccggtacggggttaacggggaacgggttaaccggtagggtaacgggttaaggtttaccgggtttttaaagggtttaaacgttttttaaacggtttaaacggttttcggtaccgttaaaggtttaccggtaaacggttaaacgggtttacgaccgtttaacgtaacggtttaaccggggttcccccgtttaccgggttacccgtttaaggtttttcccggggtaaccggtaaacccggggggtacttaaaaccgggttccggtaaaccggttaagggtaaacccttttaaccgggaaaaacccggtaacgggtttcccggttaccgggtagtttaaccccggg

SEQ ID NO: 56219 - DNA, 679 bp, Homo sapiens
  misc_feature: GYAE6OF02G3AA1.46.34.D01.1.454.CMB.1.raw
  modified_base (270)..(270): a, c, t, g, unknown or other
  misc_feature (270)..(270): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggtattcagtgggggatgttgtgatgactcagtcctccactcctccctgccccgtcacccttggacagccggtcctccatcctcctgacaggtctagtacaaacgtcctacgtatacactgaatacggaaaccncctgcctaggtattgggtactccaaccgaggccggcccaaggcccaatcctaccgaacggccgtaaccttaagttttagtaaacggtttccgtaaccgggcttacggtcggggtcccaagactacgtacttcgagggttggcgtagggtcgggacgaggcctacgtggtacttcgactaacgtagaaactcgaacggcggagggtaggacggtcgtagggtaaggtagttagtttaaggttaatttacgttacgttggacttaagtcggacgtaggttcgaacgtacgttacggttccggtacccgttcggtacctttaccgggtttacggaccggtaaccggggacctaacggtcgttagggtaacgtaacgtaacggtaaaccgttacggtagggtcgtacgtaccg

SEQ ID NO: 56220 - DNA, 605 bp, Homo sapiens
  misc_feature: GYAE6OF02F371S.46.34.D01.1.454.CMB.1.raw
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgccctcacccttggacagccggcctccatctcctgcaggtctagtacaaagcctacgtataccactgatacggaaacctaccgtagcccgttggtactttggtataccacctaggcccggccgaacggcccaaagtcctaccgaaggccgtaccttaatttaagttaacgttttaccgaaccgggtactcgtcgggtaccagacagtattcgagtggcnggtggcagcagtgtatcacacgtaanaaancgagcgagggtggaggngtagagtagtaggttagtaatttattagtcgcgagtgtagtaggtgactactaggtcgtcgttccgtctacggtttcggaccggtaacgggtaccgtaacggtcgtacggtacggtacgttaacgtaaaccggtaacgttacgggtacgtacgtaccgg

SEQ ID NO: 56221 - DNA, 785 bp, Homo sapiens
  misc_feature: GYAE6OF02GRPRA.46.34.D01.1.454.CMB.1.raw
tcagactagcagtacacgaccggtgctcgatttagatcgtctgtgttgggtttgggctgatcaggacctcctcagttcaccttctcacaatgaggctccctgctcagctcctggggctgctaatgctctgggtcccaggattcagtggggatgttgtgatcgactcagtcctaccgactcctcccgtggccccgtacacccgttggaccacggcccggtcctccattcctacctgcctaaggtctaggtcaaacgccttcgatactactgtaatcggaaacacctgacctagggattggtaactcctacccgaaggccggacccaaggccctaaaacgtccgttacccgaaacgggaccgtaaccccttaaaagtttttaccggtaaacgggttttacccgtaaaaccccgggggtaccgttaacccgttacggggggtttacccccaaagggtacctaacggttacctttaccggacggttagggtacccgtaaggggttccgggttaccgaacgggtaccgtaacgttccgggtaagtttacccaaccgtaacgtaacgtaaaacgttcgacgggtacgtaacggggtgggtaacgggcgttaggaacggtaagtttggttaagttagttttagttaccgttggacctagtacgacggtaacgtgtacacgtacgttacggcccgttccggtaccgttacgtttcggtaccggacgggtaacccgacggtccggtacggaggtacgtaaccgtaaccggaacgttggtacggtccgttaccgg

SEQ ID NO: 56222 - DNA, 869 bp, Homo sapiens
  misc_feature: GYAE6OF02HTJJJ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtgggctgactaatgctcggtcggtcccgaggtacttcgagggtggggtattggttggtagagtgtacctctacgttccctaccctaccttccctcccgtcggtccccgtacctaccccggttaggaaccgacggtccccgtcccttacctacttcctcccgttggaccgtaacggttacgtaaccgtaaccgaaaacgtccccgttaggttaaccaactacgtaggtaagttaaccggaaaacctaccgtcggtccgtaggttagttaggtactaccaccgaacggcccggtaccgaccggtacctaaacctaccgtaaccggaacggtacccgtaacgtttaaacgttttaacgttaaaccggttttacccggtaaccgggttaaccgttccgggttaccgggggtaccctaaacggtacgtaacgtaagttccgagggtttacggaccggtagggttcggtacgacggtctacgtaggtacgtttacccaacgtaacgttaacgtaaactcgaacggtaggtaggggtacggggtaggtaccgggtagggaacggttagggtttaggttaaggtttaacgttttaacgttacgtaggtacgttaagtaccggtaacggtaaggggtcctaacgtaagttacggttacggtaccccgtttccgttaaccgtttacgttttaccggaacgggtaacggtaaccggtaaggtacgtacggataacggtaacgaaaccgttacggtcgttacggactacg

SEQ ID NO: 56223 - DNA, 753 bp, Homo sapiens
  misc_feature: GYAE6OF02GLLIG.46.34.D01.1.454.CMB.1.raw
  modified_base (166)..(166): a, c, t, g, unknown or other
  misc_feature (166)..(166): n is a, c, g, or t
  modified_base (269)..(269): a, c, t, g, unknown or other
  misc_feature (269)..(269): n is a, c, g, or t
tcagactagcagtacacgaccggtgctcgatttagatcgtctgtgttgggtttgggctgatcaggactcctcagttcaccttctcacaatgaggctcctgctcagctcctggggctgctaatgctcgtgggtcccaggattcgaggtggggatgttgtgatgactnagtctccactcctccctgcccgtcaccgttggacacggccgcctccattcctcgtgcgtaggtctagtacaaacgtcctacgtatacactgtatacggaaacnccgtacgccgtaggtagttaggtactaccgaccgtacggccggaccacggacctaacgtccgtaccgaacgggtcctaaccgtttaaatttttaacgttaacgggttttaccgtaaaccggggtacgttaccggtacggggttacccaaaggtaaccgtaagttacgtttccggaaggtttcgggacggttaacgggttacgggtacgaacgggtaccttaacggtcgtaacggttaccaacgtaaccgttaagaaaacttcggaagggtcgtaacggggtggtacgggtctagggtaaggttgttaggtttaaggttaaattttacgttacgtagaacgttatacgggacgttaacggtcgtaacgacgttagttacccggtccgttaccgttcgttacggtttaccgggacggtaacgggaaccgttagtaccggttacggaactacggtaaccgaagttaccggtaggttccgtagtaccg

SEQ ID NO: 56224 - DNA, 825 bp, Homo sapiens
  misc_feature: GYAE6OF02HCZK9.46.34.D01.1.454.CMB.1.raw
  modified_base (817)..(817): a, c, t, g, unknown or other
  misc_feature (817)..(817): n is a, c, g, or t
tcagactagcagtacacgaccggtgctcgatttagatcgtctgtgttgggtttgggctgatcaggactcctcagttcaccttctcacaatgaggcctccctgctcagctccgtggggctgctaatgctcgtgggtcccaggtattcgaggtgggattggttgtcgatgactcgacgtcctaccacttcctcccgtccggtccctcctacccgtggaccacggcccgtcctcctagtccgttccgtagctacggtctaacggtaccaaacgtcccgttacgtaactaccgtactagtaacgtaaccggaaaccaccgtacgaccgttaggtacgttacggtacgtcgtaaccgacggaccggtacccgaacggtaccctaacgtaccctaaccggaacggtacctaccgtttaaaaggtttaacgtttaaccgggtttaaccggtaaccgggtaaccgttacggtaccgggggtaaccctaagggtaacctaaggtttacgttaccggacggttacggacgtacggttacgggtacgtaacggccgtaaacggtcgtaacggttaccaaccgtaaagtaacgtaaaacgggtcgtaacggacgggttaacgggacgggtaacgtacggttagggaaggttacggtttaaggtttaacggttaacgtttaaccgttagtaccgtacgttacggtacggtaccggtagtacgtacgtaagtcgtacccggtcgttaccggtatttaccggttacggaccggttaacgggccttacgggacgtacggaagttacgtaaccggaaaccgttaggtccggtanccggtacg

SEQ ID NO: 56225 - DNA, 758 bp, Homo sapiens
  misc_feature: GYAE6OF02JZSKD.46.34.D01.1.454.CMB.1.raw
  modified_base (161)..(161): a, c, t, g, unknown or other
  misc_feature (161)..(161): n is a, c, g, or t
  modified_base (207)..(207): a, c, t, g, unknown or other
  misc_feature (207)..(207): n is a, c, g, or t
tcagactagcagtacacgaccggtgctcgatttagatcgtctgtgttggggtttgggctgatcaggactcctcagttcaccttctcacaatgaggctccctgctcagctccgtggggctgctaatgctcgtcgggtcccaggattcaggtggggatgttgngatgactcacgtctccactcctccctgtcccgtacaccttggaccngcccgcctaccatccgtcctgctaggtactagtacgaacgcctacgtatacacgtgaacgtaacggaaccaccgtgacccgttagggtattacgggtactaccgaccgacgggccggaccgaacggcctaaacgtccgaccgtaacggtccgttacttaaagtttaacgttaacggttaccgtaaccgggcttcggtacgggaccagactagtacttcgaacgggttcgacggttacgggtacgggtacgacgggtctaacgttcgggtaactacggaacgtacgtaagtaaacgtcgtaaggtacggtacgggtaaggtacggtacggtacggtagggtatttaggggttaacgttatttacggtaccgtaaggtacgtaggtaggtaaccgttaagggcgtaaccgttacgggtacgttacccgggttaaccttcccgggttaacgtttccggtacgggtaccggtaaacgggacccggttaaggtccggtacggtaaccgtaacggtaacccggtaaaccgtcggtttaacgggcggttacctaaccg

SEQ ID NO: 56226 - DNA, 671 bp, Homo sapiens
  misc_feature: GYAE6OF02H5JHU.46.34.D01.1.454.CMB.1.raw
  modified_base (207)..(207): a, c, t, g, unknown or other
  misc_feature (207)..(207): n is a, c, g, or t
  modified_base (586)..(586): a, c, t, g, unknown or other
  misc_feature (586)..(586): n is a, c, g, or t
tcagactagcagtacacgaccggtgctcgatttagatcgtctgtgttgggtttgggctgatcaggactcctcagttcaccttctcacaatgaggctccctgctcagcctccgtggggctgctaatgctctgggtcccaggtattcgagtgggggattggttgtgatgactcagtcctccactctccctgcccgtctacccttggacngccggcctcatcctcctgctaggtctagtcaaagtcctgtaatacactgatacggaaactcctgcctggtattggtactccacgacggcggacccgtacggcctaacttccgaccgaacggtccgtaccttttaaagttttacgttaaacgggtttacccgtaaccgggtaccttccggttccggggtacccaacggtaaccgtagttaacttacggacggttagggtacgtagggttcggggtacacgggtctacgttagtaacgttacacctaacgtaagaaaactacgaggtacgggagggtacgggtaggcgtagggacggtagtttaggtttaacggttaattttacgtacgtgtacagttgacgtagtcgacncgtagtcgtaccgttcgtaccttcgtttcggaccggacgggacacgtgtacggcgtacgacgtaaacgtcgtcggtcgacgtacg

SEQ ID NO: 56227 - DNA, 818 bp, Homo sapiens
  misc_feature: GYAE6OF02HT91M.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggtacttcgaggtggggattggttgtgatgactctacgtcctcctactcctccctcgcccgtacctacccgttggaccaccggcccgtccttccactcctccgtgacgtacggtctaacgtaccgaacgtccttacgtactaccacgttagaacgtaaccggaaacctccgtcggtcgtaggttacttaggaactccaaccgacggccgaaccgacgacctactccgaaccggacggtaccttaaccttttaaagtttaaggttaacccggtttacgtaaaccgggtcgttacgggtaccgggaaccaagtacgtaacgttcgttaggaacgggtcgtaacggttacggggtacggtaaccgacggtaccgtaccggtttagtaacccgtttacgaaccgtaaccggtaaacgaaaacgtcgaacggggtacggtaagggggtacggacgggtacggtaacggtaaggttagtttaacggtttaagttaaacgttttacgtagtacgttagtaacgtaggtaacgtaagtaccgacgttaacggttccggttacggtacccgttttaaccggtccgtttaccgggttacgggtaccgggaaaccgggtaacgtacgggtacggtaacggtaaccgtaacggtaaaccgaacccggttagtacggtacggtacctaccgg

SEQ ID NO: 56228 - DNA, 788 bp, Homo sapiens
  misc_feature: GYAE6OF02JA4ZQ.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctcctcgcccgtcacccttggacacgccgcctccatcctcctgactaggtctagtacaaacgcctacgtactacactgaatcggaaacaccgtgccgtaggtatttacggtactccaaccgtacggccggacccgaacgggcccctaacgttcccgaccgaaacgggtaccctaaccgtttaaaacgttttaacggttaacggttttacccggtaacccggggttaaccgttcccgggttccgggggttaacccaaggtaaccgtaacggtaagttcgacggttacggacgacgggttacgggtacgacggtacctacggttcggtaacgttcctaaccgaaccgtaagtaaaacgtacgacggtacggtaggggtagggtacggtacggtagggtaggtagtttagggttaacgttaagtttaacgttacggtagtagtaagtacgacgttaacgggtgtaaccgtaacgttaggtttacccggtccggtttaccggtaccgttaaccggttttaccggaaccgggtaaccggggtaaacctaacgggtacggttacggtaaccggttaactaaccggtaaaccggttaacgtcgggttacgtccgtaaccgg

SEQ ID NO: 56229 - DNA, 816 bp, Homo sapiens
  misc_feature: GYAE6OF02G7ZHD.46.34.D01.1.454.CMB.1.raw
  modified_base (249)..(249): a, c, t, g, unknown or other
  misc_feature (249)..(249): n is a, c, g, or t
tcagactagcagtacacgaccggtgctcgatttagatcgtctgtgttgggtttgggctgatcaggactcctcagttcaccttctcacaatgagctccctgctcagctccgtggggctgctaatgctcgtgggtcccaggtattcgaggtggggatgttgtgatgactcagtctccactcctccctcgcccgtcaccctggacagcccgcctcactctcctgacacggtctagtacaacgtcctacgtanaccactgaagtacggaaacctcctacggtccgtaggttattacggttactaccgaacccgaacggcccggaccgcggaaccctaacgtccctaaccgtaaccgggtaaccgtacctttaaaagttttaacgttaaaccggttttaccggaaaccggtaccgtaccgtccggggtaccccaaggtaaccctaacggttacttaccgagggttaaccggcgggtaacggttacgggtacgacgggtaccacggtttcgtaacgttacgtaaccgtaacgtaacgtaaaacgtacgtaaccggtacggtaggggtacgggtagggtaccgttaggtaacggttagtttagggttaacgtttaatttaacgtttacggtcgtacgtagtaccggttaaggtaacggttacgtaccgtaacgttacgtacccggttaccggttacccgggtttacgtttacccgggtttcgggtaacccggtaccggggtaaaccgtaccggtacggttacggtaaacggttaaccggtaaaccgtaaccgtaacgggttccggtacgggttccctaaccgg

SEQ ID NO: 56230 - DNA, 725 bp, Homo sapiens
  misc_feature: GYAE6OF02JOG3G.46.34.D01.1.454.CMB.1.raw
  modified_base (226)..(226): a, c, t, g, unknown or other
  misc_feature (226)..(226): n is a, c, g, or t
  modified_base (520)..(520): a, c, t, g, unknown or other
  misc_feature (520)..(520): n is a, c, g, or t
  modified_base (579)..(579): a, c, t, g, unknown or other
  misc_feature (579)..(579): n is a, c, g, or t
tcagactagcagtacacgaccggtgctcgatttagatcgtctgtgttgggtttgggctgatcaggactcctcagttcaccttctcacaatgaggctccctgctcagctccgtgggctgctaatgctcgtgggtcccaggattcgaggtgggtatgttgtgaatgtactcgagttcctcctactcctccctcgcccgtcctacccgttggacacggccgtccctccnctctccgtagcgtaggtctacgtacctaacgtccttacgtacttaaccgacgtagtaacgtacggtaaaacctaccgtcgtaccgtaggttagttcggtacttccgaaccgacggtccggacccgacggaccctaacgtccgtaccgacggtactacccgttaagtttaacgttaacggtttacgtaaccggtaccgttcggtaccggtaccgtacgacgtaggtaccttgaacggtgtccgtaaggttcggtacgaacggtcgtacgtcgtagtaccacgtacgtaaggaacncgagacggtaacgggtcggagtcggtaggaggtaagttaggttaagttattacgttagngtacgtaagcggtaaagtaccggtatacgttaacggtcgttccggtaaccgtccggttaaccgttcgttaccgggaaccggtaaccggaacgtaggtacgtacgacgtaacgtaccgtaaacgtcggttacggccgtaggtacccg

SEQ ID NO: 56231 - DNA, 708 bp, Homo sapiens
  misc_feature: GYAE6OF02F0RJ6.46.34.D01.1.454.CMB.1.raw
  modified_base (164)..(164): a, c, t, g, unknown or other
  misc_feature (164)..(164): n is a, c, g, or t
tcagactagcagtacacgaccggtgctcgatttagatcgtctgtgttgggtttgggctgatcaggactcctcagttcaccttctcacaatgaggctcctgctcagctcctggggctgctaatgctctgggtcccaggattcaggtggggatgttgtgatgactnagtctcactctccctgcccgtcaccttgacacgccgcctcatctcctgctaggtctagtacaacgtcctcgtatacactgataggaaacacctgctggtattggtatcaccgagccggaccgtaggtacaactccgtaccgaaagggcgtaccgtttaaattttaacgttaacgggttttaccgtaaaccgggtacgttccggtacggggtacccaggaacgtacgtacgttacgtaggtacgggactagggttcggggtaccgagggacctacggtacgtagttaccaacgtaacgtaaacggtaaaactccgaaggtcggaaggggtcgggtaaggtcggtagacgggtagttaggtttacggtaaattttacgtacggtatacgtaagttggacgtaaggtgtactacgttacgtccgggtaccgtttaccggttacgtttacgttttaccgggacccggtaacggggtaacccttaacgggtcgtagggttaacgtaacgtaaccggtaaaggtaccgtttacgggtacgtaccggtacg

SEQ ID NO: 56232 - DNA, 632 bp, Homo sapiens
  misc_feature: GYAE6OF02IBPTQ.46.34.D01.1.454.CMB.1.raw
  modified_base (85)..(85): a, c, t, g, unknown or other
  misc_feature (85)..(85): n is a, c, g, or t
  modified_base (125)..(125): a, c, t, g, unknown or other
  misc_feature (125)..(125): n is a, c, g, or t
  modified_base (142)..(142): a, c, t, g, unknown or other
  misc_feature (142)..(142): n is a, c, g, or t
  modified_base (171)..(171): a, c, t, g, unknown or other
  misc_feature (171)..(171): n is a, c, g, or t
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (269)..(269): a, c, t, g, unknown or other
  misc_feature (269)..(269): n is a, c, g, or t
  modified_base (572)..(572): a, c, t, g, unknown or other
  misc_feature (572)..(572): n is a, c, g, or t
  modified_base (574)..(575): a, c, t, g, unknown or other
  misc_feature (574)..(575): n is a, c, g, or t
  modified_base (577)..(577): a, c, t, g, unknown or other
  misc_feature (577)..(577): n is a, c, g, or t
  modified_base (579)..(584): a, c, t, g, unknown or other
  misc_feature (579)..(584): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (609)..(609): a, c, t, g, unknown or other
  misc_feature (609)..(609): n is a, c, g, or t
  modified_base (611)..(612): a, c, t, g, unknown or other
  misc_feature (611)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (626)..(627): a, c, t, g, unknown or other
  misc_feature (626)..(627): n is a, c, g, or t
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
tcagactagcagtacacgaccggtgctcgatttagatcgtctgtgttgggttttgggctgatcaggactcctcagttcaccttcncacaatgaggctccctgctcagcctcctggggctgctaangctcgtcggtcccaggnttgagggttgggattggtgtgatcgactnacgtcctccacctctcctcgcctcacctgacncgtccgactcatctcgngnaggttacacganaacgtcctagatacacgtgactacgaaacctccgngtaccctggtagtttacggtactaccaacccgaggtaccggacccgtaacgggaaccttaacttaccccgaaccggaacggacccgttaacctttttaaaaggtttttaaaccgtttaaacgggtttacccgtaaacccggggtaccgttccgggttaccggggtacccaaagaacggaagttacttacgaagggttcggacggtagggtttacgggacgagggacccttagtacgtaacctttacgaactaaccggtaaataaacacggtacgggacggtaaggggtagggcggtacgggtnannanannnnnngananannananancanananacanannanananangnanannanann

SEQ ID NO: 56233 - DNA, 895 bp, Homo sapiens
  misc_feature: GYAE6OF02FTQZR.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtcacccttggacaggccggcctccatctcctgacctaggtctagtcaaagccttacgtatacactagatacggaaactcctagcctaggactttaggtatccaccaaggtccggccaacgggacccaaatccgtaccaaggccgtacctaaattattaaacggtttacgtaaccggggtaaccttcgtacgggggtcccctaaggaaccgtaacggtacgtttaccgtaaaccggtgggtacccgtaaacggggttcgggggtttaacccgaaacggggtacccgttaacgttacggggtaaacgttttaccccgaacccgttaaacgttaaaccggtaaaaaccgtttaaccgggaaacgtacccggtaaagggggggttacggaaacgggggtacccggtaagggttaaaccggggtaaacgtaggggttttaacgggttaaacggtttttaaacgtttaaacccggttttaacgggaacgtttaacggtaacgttaccgggtaaaacggggttaggggtaaccctaccgggtttaaaggtttcccgggtaacccggtttacccggggttaccgtttaaacccgggttttcgggaaccgggttaaccggggggtaaccctaaaccgggttaacggtacggggtttaaacggaacggttttaacccgaaaacgggtaaaccgtttacgggttaccggtaacgttaccggg

SEQ ID NO: 56234 - DNA, 794 bp, Homo sapiens
  misc_feature: GYAE6OF02J1WPH.46.34.D01.1.454.CMB.1.raw
  modified_base (139)..(139): a, c, t, g, unknown or other
  misc_feature (139)..(139): n is a, c, g, or t
  modified_base (192)..(192): a, c, t, g, unknown or other
  misc_feature (192)..(192): n is a, c, g, or t
tcagactagcagtacacgaccggtgctcgatttagatcgtctgtgttgggtttgggctgatcaggactcctcagttcaccttctcacaatgaggctccctgctcagctcgtggggctgctaatgctcgtgggtccaggnttcaggtgggtattgttgtgatgactgagtcctccactcctcctcgcccgtcnccgttggacacgccgcctcacttcctccgtcgcgtagtacgtacgtacgtaaacgtccgttaccgttaatacctagttacgtaacgtaacggaaacctcgtcgtaccgtaggttaagttcggtactaccgaccgcgggaccggtcccgaacggtaaccctacgtaccgtaaccggtacggtaccttaaccgttaaagttttaccggtaacggtttaccggtaaaccccgggttcgtacgggtaaccggtaacccgacggtaacgagtttacgtacggtcggtaacggtacggtggtacggtagtacgtcgacgttacgggtacttaaccgagaacgtagtaaaacgtcggtaaacggtacggtaggggtacgtcggtacggttaagggtacggttaacgttagtttaaggtacgttttaaacgtacggtagtagtacgtacggtaacgtacggttaacgtacgtaacggttacgtacccggttccgtttaccgggtttaccgttacgggttaccgggaaccgggtaacggtaccggacggttaccggtaacgtaacgtaacgttaaccggaacgttaggtacccggttacgtacggtaaccg

SEQ ID NO: 56235 - DNA, 731 bp, Homo sapiens
  misc_feature: GYAE6OF02G7BJH.46.34.D01.1.454.CMB.1.raw
  modified_base (268)..(268): a, c, t, g, unknown or other
  misc_feature (268)..(268): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcaggtgggggattgttgtgatgactcagtctccactcctccctgcccgtcacccttggacagccggcctccatcctcctgcgtaggtctagtacaaacgcctacgtatacactgatacggaaaaccnccgtgccgttaggtattaggtactaccaccgaaggccggtaccgacggaccctaaatccgtacccgaaggtaccgtaaccttaaagttttaacgtaacgggttttaccgtaaaccggggtacttccggtcggggtacccaaggtaaccgtagtacttcgaggttcggacgtagggtgggtaccaggtactacgtgtaacgttactaacgtacgtaagtaaaacgtcgaacggtacgaggggtacgggaagggtacgtaggtaagggtagttaggttaaggttaagtttaacgttaacgtcgaacgtgtaacgtacggtaacggtcgtacgtacgtacgttaccggtccgttaccggttaccgttaccggtttccggaccggtaaacggggtaaccctaagggtaccgtaacgggtacgtaacgttaaccgaaccggttaacgttacggtacggtacgtaccgg

SEQ ID NO: 56236 - DNA, 677 bp, Homo sapiens
  misc_feature: GYAE6OF02IEVAR.46.34.D01.1.454.CMB.1.raw
  modified_base (197)..(197): a, c, t, g, unknown or other
  misc_feature (197)..(197): n is a, c, g, or t
  modified_base (454)..(454): a, c, t, g, unknown or other
  misc_feature (454)..(454): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcgagtgggatgttgtgatgactcagtctccactctcctgccgtcacccttggacngccgctccatcctctgcaggtctagtacaaagcctacgtactacacttgatacggaaaccacctggtcctaggacttaggtatccgaccgacgccggaccaacggacctaacttcgaacctaacggacgtacctttaaaattttaacgtaaacggtttaccctaaaccgggtaccttacggtccgggtacccaacggactagacgttcgagtggtacaggttagggcaggctacgtgtacgtactacagtagtaaancgacgacggagggtggaacggcgtagacggttaagtgttaggttaactttagttactcgtagtacgtagtacgaaacgggtgacgtacgtaacgttccggtccgttaacccggttcgttacccgttttccgggaaccgggtaccgggtaaaccgtaacggtaccggtaacggtaagtacgttaaccgaaaacgttaacccggtacggtacggtacgttaccgg

SEQ ID NO: 56237 - DNA, 809 bp, Homo sapiens
  misc_feature: GYAE6OF02JLI8U.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggattcaggtggggattgttgtgattcgactcagtcctccactccgtccctcgtcccgtcctaccgttcggacacgcccggcctctactcctctcgactacggtcctaggtaccaacgtcctacgtaactacgtacgtagacgtaacgaaacctaccgtcgtaccgtggttacgttacggtactaccgtaccgacggcccgggaccgaccggacctaacctacccggtaccgaacggtacccggtaaccttaaagtttttaacgttaaccgggtttacccggtaaccccgggtaccgtttaccgggtacggggtacccgaaggacgtacgttacgttcggtaagggttcgtacggtacgggtacggtacggacgggtacctaaggtcgtaacgttccgaacgtaaacgtaacgtaaactcggaacggtcgggtaacgggtagggacggttacgggtaaggtaacgggttaggttacggtttaaagtttagtttaactcggtacggtagtacggttaggaaccgtagttacggtacctaacgttcgttaccggttacccggttccgtaaccgtttcccggttacgggaccggtaaaccgggtacctaagggtaccggtacggtaaaggtaaccgtaacgtaaccggttacggtccggtacggttcgtaccg

SEQ ID NO: 56238 - DNA, 781 bp, Homo sapiens
  misc_feature: GYAE6OF02G0JFW.46.34.D01.1.454.CMB.1.raw
  modified_base (463)..(463): a, c, t, g, unknown or other
  misc_feature (463)..(463): n is a, c, g, or t
tcagactagcagtacacgaccggtgctcgatttagatcgtctgtgttgggtttgggctgatcaggactcctcagttcaccttctcacaatggaggctccctgctcagctccgtggggctgactaatgctcgtcgggtcccaggattcgaggtggggatggttgtagatgactcgagtcctacctacctccgttccctcgtaccccggtctaccccgttgggaaccacggtccccggcccttaccacgttcctacccgtggctaacgggttcctaaggtaccaaacgtccgtacgtaacgtaccacgtaggtaacgtacggaaacctaccgtcgaccgttagggtattacggtacctaacgaccgaagggcccgaaccgtcgggaacctaacgtcctaaccgaggtacctactttaaagttacgttaacggttcgaaaccggtcttccgggtacgtcccggaanaccgattaacttccgaaggtcgtacgtaagggtcggtccgaaggtcccaaggttcctagttaaccaacgtaacgtaacgaaacgttacgagtacgggaagggtacggacggtacgtagggaagttggttacggttaggttaaagtttagttaccgtagtacgtacgtacgtacgtaggtccgtacgtacgttacgttccgggtaccttccggttaacgttacccggttacggtaccgggaacggttaaccggaggtttaacgaacgttacggaacgttaaccgggtaaacgtacggtacggtaccggtctaacccggg

SEQ ID NO: 56239 - DNA, 668 bp, Homo sapiens
  misc_feature: GYAE6OF02F5BO4.46.34.D01.1.454.CMB.1.raw
  modified_base (288)..(288): a, c, t, g, unknown or other
  misc_feature (288)..(288): n is a, c, g, or t
  modified_base (453)..(453): a, c, t, g, unknown or other
  misc_feature (453)..(453): n is a, c, g, or t
  modified_base (523)..(523): a, c, t, g, unknown or other
  misc_feature (523)..(523): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctcgggtcccaggtacttcaggtgggggatgttgtgatgactcagtcctccactctccctcgcccgtcacccttggacacgccggcctcactctcctgcgtacggtctagtacaaacgtcctacgtatacactgagtacgaacacctgcctggagttggtanccaccgagcggaccgacggaccaactacctaccggaaggtcctaccttaagtttaacgtaacggttttaccaaccgggtcttcggtcgggtacccaggtaacagtacttcaggtgacgtaggtcggtacaggtcctagtacgtgtaccaactacgtaagtaaacncgtaggtacgaagggtggacggtcgtcggaaggttagttacgttaggttaacttttatacgtgacgttanacggacgtacgggtctacgtacgttacgtaccggtccgtaccggttacgttacgggtttacgggaccgtaacggggtaaccctaagggtccgtacgggtaacgtaacgttaacccggaaaccggttacgcggtacgtcgtaaccg

SEQ ID NO: 56240 - DNA, 845 bp, Homo sapiens
  misc_feature: GYAE6OF02FW6JQ.46.34.D01.1.454.CMB.1.raw
tcagactagcagtacacgaccggtgctcgatttagatcgtctgtgttgggtttgggctgatcaggactcctcagttcaccttctcacaatgaggctcctgctcagctccgtgggctgctaatgctcgtgggtccaggattcagtggggatgttgtgatgactcagtctcactctcctgccgtcaccgtgacacgccgctcactctctgcagtcactacaacgcctacgtatacactagatacggaaactccgtgaaccgttggtaacgtttagggtacttaccgaaccgaggtccggtaccgacgggtacctaacgttcctaaccgaacgggtcctaacctttaaagttttaaccggttaaaaccggttttccgtaaaccgggtaactttcccggttaccgggggtaccctaaggtacccggtaaacgttacgttacggtaacgttcgggtaaccgtacggggttaggggtaccctacggggtaccctaaggttaccggtaacgtttacccgaaccgttaaacggttaaacggtaaaaaccggttaacggtacggggttaacggggtaacggggttaaccggggtagttaacggggtaacgggttaaggttttacggggtttaagggtttaaacgtttttacggttaacggttacctacgggtaagttaccgaacgggtttaagggtcctaaccggttaccgtaacggtttaccggtcccgtttagggttaccctttaaccgggtttacgggaacccggtagggtaacccgtaaggacggttaaccgggtaataacgttaacccggtaaacggtaccgttcgggttacggaccgttacggacccg

SEQ ID NO: 56241 - DNA, 722 bp, Homo sapiens
  misc_feature: GYAE6OF02HU3NW.46.34.D01.1.454.CMB.1.raw
  modified_base (264)..(264): a, c, t, g, unknown or other
  misc_feature (264)..(264): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtctaccctggacacgccggcctccatcctcctgcaggtctagtacaaacgcctacgtaatacactgaagtacggaaacncctgccgtaggtattggactccaccgacgccggaccacggcctaactccgtaaccgaacggccgtaccctttaaattttaacgttaacgggttttaccgtaaccgggtacgtcggtacgggtacccaggtaccaagtacttcgagtggacgtaggtcggtacacggcacgttgtaacgtttcaaccgtaacgtaagaaaactcgacggtacggtaaggggtagggacgggtacgtagggtaaggttaggtttacggtttaaggttaacgttttaacgttaaccgttggacttacgtacggtacgtaacggttacgtaccgtaagttacggttccggtacccgttccggttacgtttaccggtttaccgggaccgtaacgggggtaaacccgtaacgggtcggttaacggtacgtaaaccgtaacggtaaaccgtacggttacggtcggacgttaccgg

SEQ ID NO: 56242 - DNA, 584 bp, Homo sapiens
  misc_feature: GYAE6OF02GW7UA.46.34.D01.1.454.CMB.1.raw
  modified_base (437)..(437): a, c, t, g, unknown or other
  misc_feature (437)..(437): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacaggcccgctccatctcctgcaggtctagtcaaagcctcgtatacactgataggaaacacctgcctggattggtatccaccagccggccaggccaatcctaccgaaggcgacttaatttagtaaggtttcaaccgggactcgtgggtcccagacagtattcagtggcaggtggcagcacgtgatcacatagaaatgacgacgagggtggaggtctaggagtgtgttagtatttagtatagntaagtcgacgtaaggtcgtacgtacgttagttcggtccgttccggttaccgttacgttttacgggaccggtaacggggtaaccctaagggtccgtaagggtaacgtacgtaaccgtaaaacgtacgtacgggtacggtacgtaacgg

SEQ ID NO: 56243 - DNA, 802 bp, Homo sapiens
  misc_feature: GYAE6OF02JHQBD.46.34.D01.1.454.CMB.1.raw
  modified_base (794)..(794): a, c, t, g, unknown or other
  misc_feature (794)..(794): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcgaggtggggatgttgtgatgactcagtcctccactcctccctcgcccgtcacccgttaggacacggcccggtccctccactcctccgtgaccgtacggtactaacgtacaaacgtcctacgtaataaccacgtgtagtacggaaacctccgtcgaccgttgggtaacttggtaactaccgaacccggacggccggaccgacgggtaccctaaacgttccggtaaccgaaacgggtccttaaacctttaagttttaaacgtttaacgggtttaacccgttaaccgggggtaccttaccgggttaccgggtaccccgaagtaccgaagttaccgttcgtaggtcgggtacgtagggtcgggtcgaacggtccgtagttacgttacgttaccgaaccgtaacgtaaacggaaacttacggacggacgggtacgggggtacggtacgggagggttacgggaggttacggttagggtttaacgttaacgtttacgttaacgtcggtactagtacggtaacggtaacgggtcgtaacgtaccgttacggttccggtcccgtttacggtacccgttaggtttccggaacgggtaaccgggtaccgaggtccggtaggtacctaacgtaacgtaaacccggtaggttcggtaccgggtntaacccgg

SEQ ID NO: 56244 - DNA, 925 bp, Homo sapiens
  misc_feature: GYAE6OF02HN24L.46.34.D01.1.454.CMB.1.raw
tcagactagcagtacacgaccggtgctcgatttagatcgtctgtgttgggtttgggctgatcaggactcctcagttcaccttctcacaatgaggcctccctgctcagctccgtggggctgctaatgctctcgggtcccaggattcaggtgggggtattggttgtacgatcgactcgtacgttcctccctaccttccctcccgttcggaccccgttcctaaccccgtttgggaccacggtcccggtccctacctacttccttacccgtgaccggtaggttacctaacggttaccaaacggtcccgttactaacgttacacgttagaagttacgggaaaccttaccgtcgggtaccgttagggtaatttacgggtaccttaccgaacccggtaggccccgggtaacccggaaccggtccctaaaccgtccggttaacccgaaaccggggttcctttaaaaccccgttttaaattttttaaccgggttaaaacccggggttttacccggtaaaaccccgggggttaccttaccggggttacccgggggttaaccaaggtaaccgttaaacggacggttttccgaaaggggtttcggggtaagttaaccggggttacggggtaccggtaacggtaccgttacgggttaacggtttaccgtaccgtaaaccgttaaccggtaaacgtaaaccgtaacggtacgggtacggttacgggggtacgggtaccgggtacggttagggttaaggttacggttttacggttaagttttaaaccgttagttacggtacgtacgtacgtacggtacgtacggtacgtaccgttacgttccgttcgtacccgttcgttccgttacgttccgggtacggaacggtaccggtagtcggtacgtacggtacgaacgtaacggtcgttacggacggtctaccg

SEQ ID NO: 56245 - DNA, 795 bp, Homo sapiens
  misc_feature: GYAE6OF02IHJGO.46.34.D01.1.454.CMB.1.raw
  modified_base (315)..(315): a, c, t, g, unknown or other
  misc_feature (315)..(315): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctcgtgggtcccaggattcaggtggggtatggttgtgatgactcagtctccactctccctcgcccgtcctacccgttggactcggccgcctcctatcctcctgacgtacggtctacgtacgaaacgtccctagtactacactaggagtaacggaaacctccgtggtacctggtacgttggactccgaaccncggtccggcccaacggtacctaacgttccgtaacgaacggtccgtaacctttaaagttttacgttaacggtttaccggtaaacccgggtaccgttccgggttaccggggaaccgtacgaaccgtacggttaactttcgggaggttacggtacggtacggggttcgggtacaacgggtcccgaagtttcggtaacgtttacccgaacgtaacgttaaacggtaaaacgttaccgaagggtacccgggtaaaggggtacgggtaacgggtcggtaacggtagggtacggttttacgggtttaaaggttaagtttacggttacgtacgtagtaggtacgtacggtacgtacggccttacgtaacgttcggtacccgttaccggttacgtaccggtttcggaccggtaacgggaacctacggtacggtacggtaacgtacggttaaacccggtaacggttaacggtaggtacgtacgttaccgg

SEQ ID NO: 56246 - DNA, 722 bp, Homo sapiens
  misc_feature: GYAE6OF02I7Q87.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgatcagtctccactcctccctcgcccgtccacccgttggacacgcccggcctccatcctcctcgcacggtactagtccaaagtcccttcgtagtaccactgagtacggaactaccgtcgcctggtagttggactaccgaccgtaacgccggcccgaacggcctaacgtcctaccgaacgggccgtaccttaaagtttacgttaacggtttacgtaaccggtacctcggtacgggtacccagacgtagtacttacgaggtcgcgtacggtgggtacgaggtccgacgtggtacgttaccacgtaacgtagaaacgttcgaacggacggtacggggtacgggacggtcgtagggtaacggttagtttacggttaggtttaagtttacgttaaccgtgtaaccgtagtacggtaccggtaaggtagaccgttacgtacgttccggtacccgttccggttacgttacggtttacggtaccgggtaaccgggtaaccggtaacggtcggttaacggaaccgtacgaaaccggttaaccggaacggttacggtacggtccgtaacccgg

SEQ ID NO: 56247 - DNA, 713 bp, Homo sapiens
  misc_feature: GYAE6OF02FRT3T.46.34.D01.1.454.CMB.1.raw
  modified_base (616)..(616): a, c, t, g, unknown or other
  misc_feature (616)..(616): n is a, c, g, or t
  modified_base (703)..(703): a, c, t, g, unknown or other
  misc_feature (703)..(703): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtgggatgttgtgatgactcagtctccactctccctgcccgtccaccttggaccacggcccgcctcatctcctgcaggtctagtcaaacgcctacgtatacactagagtacggaaccacctgaccgtggtagttaggtactccgtaccgacggtccggaccctagggaccctaacttccgtacccgaacggtccgtaaccgtttaaatttaacgttaaacggtttaccgtaaaccgggtaacttccggttacgggggtacccaagtaacgtacgtaacgttaccgtaaagggtcggtacgtaggttggggttaccgacgggtacctacgttcgtaacggttaccacgtaaaccgtaaggtaaactacgaacggtaccggtaggggtacggtacgggtacgttacggggaaggtttaacgttggtttaaggttaacttttaagttaccgtcgtactagttacgcgggttaacgngtacgtacgtagttcccggccgttaccgtcgttacttccggaccggtaacggtaacctgtacgacggtaataccgactacgtaacgngtagacgtcg

SEQ ID NO: 56248 - DNA, 856 bp, Homo sapiens
  misc_feature: GYAE6OF02FW51E.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactcctccctgcccgtcacccttggacagcccggcctccattcctcctgcgtacggtctagtacaaacgcctacgtatacactgtatagaaaccacctgccttgggactttggtactaccgaccctaggccggacccgaggacccaagtaccttaacccgaaacggccgaccttttaaaacttttaagttaaacgggttttaaccgtaaaccccggggtacttaccgttacgggggtacccctacggaaactacggttaacttccgtaagggttcggtacggtacgtaggggtacgaggtccgtattacggtaacgtttaccgtaaccttaaaccgtaacggtaaaaacgtcgaaacggtacggtaaacgggggttacggggtaacgggtacggttagggtaacgggttagggtttaacgggttttaagggttaaacgtttttaaacggttaacgtttacgggtaacggttaacgtagggtaaccggtaaacggggtacggtaccggtaaccgttaacgtttccggggttacccgtttaccgggttacccggtttaccggtttttaccgggaacccgggtaaacgggggtaaacccggtaaacggtaccgggttaacggtaacggttaaccgttaaaccgggaaaaccggttaacggtacgggttacggttacccgtaacccggg

SEQ ID NO: 56249 - DNA, 756 bp, Homo sapiens
  misc_feature: GYAE6OF02GPEV6.46.34.D01.1.454.CMB.1.raw
  modified_base (167)..(167): a, c, t, g, unknown or other
  misc_feature (167)..(167): n is a, c, g, or t
  modified_base (217)..(217): a, c, t, g, unknown or other
  misc_feature (217)..(217): n is a, c, g, or t
  modified_base (260)..(260): a, c, t, g, unknown or other
  misc_feature (260)..(260): n is a, c, g, or t
tcagactagcagtacacgaccggtgctcgatttagatcgtctgtgttgggtttgggctgatcaggactcctcagttcacctttctcacaatgaggctccctgctcagctcctggggctgctaatgctcgtgggtcccaggattcagtggggatgttgtgatgactcngtctccactctcctgcccgtcaccgttggacagccggcctccatcgtccngcaggtactagtacaacgcctgtactacactgagtacgaaacnccgtgtccgtggtatttcggtactaccgtaccgacggccggaacccgacggtacctaaacgtccgttaaccggaaggtacccggttacctttaaaaggtttttaacgtttaaacggggttttacccgtaaaacccgggttacgtttccggggttaaccggggtaccccaaggaacgtaacgttactttaccgaagggttacgggacgttacgggttcgggtacgacggtacgtactacgtacgttcaacgtaagtaacgtaaaactcgtacgtacgggagggtacggtaggcttaggggaacggttagttacgggtttaagtttaacgtttaagtttaccgaagttcgtaagtagtacgtacgggttcaacggttacgttagttaccgggtccttacgggtacccgtttacggttacgggacccggtaacgggtaaccgtaggtcggtaaggaaccgtaacgtaaccggtaacccggtgttcggtcggacgtaccg

SEQ ID NO: 56250 - DNA, 742 bp, Homo sapiens
  misc_feature: GYAE6OF02F3YH6.46.34.D01.1.454.CMB.1.raw
  modified_base (257)..(257): a, c, t, g, unknown or other
  misc_feature (257)..(257): n is a, c, g, or t
tcagactagcagtacacgaccggtgctcgatttagatcgtctgtgttgggtttgggctgagtcaggactcctcagttcaccttctcacaatgagctccctgctcagctcctgggctgctaatgctctgggtcccaggattcaggtggggatgttgtgatgactcagtctccactctccctgcccgtcaccttggacagccggctccatctccgtgcaggtctagtcaacgcctacgtatacactgatacggaaaccncctgcctggtattggtactcacctaggccgaccgaacggaccaacgttccctaccggaaaggtccgtaacctttaaagtttaacgttaacgggttttaccgaaacccgggtcttcggtacgggtacccaagtcaagtattccgaaggtcggatacggggttcggtaccgtaaggggtcctaacggttacgtaacggtttacccaaccgtaacgtaacgtaaaacgtcgtaaacgggacggtaacggggtaggacgggtaggtagggtaaggttaaggttacgggtttaaggttaacttttaaggtaccgttagtaccgttaggtacgtacggttaacgggtcgaaccgtaagttacgttcggttcccgttaccggttaaccgttacggttttccggaaccgggtaacgggtaacccgtacggtaacggtacggtacgtaacggtaaccgtaaaccggttaacggtcgttacggtccgttaaccgg

SEQ ID NO: 56251 - DNA, 642 bp, Homo sapiens
  misc_feature: GYAE6OF02F64P6.46.34.D01.1.454.CMB.1.raw
  modified_base (250)..(250): a, c, t, g, unknown or other
  misc_feature (250)..(250): n is a, c, g, or t
  modified_base (545)..(545): a, c, t, g, unknown or other
  misc_feature (545)..(545): n is a, c, g, or t
tcagactagcagtacacgaccggtgctcgatttagatcgtctgtgttgggtttgggctgatcaggactcctcagttcaccttctcacaatgaggctccctgctcagctcctgggctgctaatgctctgggtcccaggattcaggtgggatgttgtgatgactcagtctccactctccctgcccgtctacccttggacacgccggccctccatctcctgcaggtctagtcaaacgtcctgtatacactganaggaacaccgtgcctggattggtatcaccagccggacgacggccaatccgtaccgaggccgtaccttaatttacgttaacggtttaccgtaaccgggtacgtcgtacggggtacccagaccgagtattccgtaaggtcggacgtaggtcgggtacgacggtcgaccgttagggacgtttaccacgtaactagtaaactcgtacgggacggtaggggttaggacggtacggtagggacggttaagtttacggtttaagttaacttttaagttacgtgactagtgaacggtaggttnaacgtatcggttacgtccgtcgttaccgttagttccggacggtacgggaactagggcgttaggacgtacgtaacgtaacgtaccgtgtacgctacgg

SEQ ID NO: 56252 - DNA, 819 bp, Homo sapiens
  misc_feature: GYAE6OF02FT8RI.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaggtattcgaggtgggggattgttgtgatgactctacgtctccacgtcctccctcgcccgtcaccgttggacacggccgtccctcactcctccgtgcgtacggttctacgtacaaacgtccttacgtactacctacgtagtacgtaacggaaaccccgttacggccttagggtagtttcggttaactaccgaaccggacggacccgggtaccgaacgggacctaaacgttccgaacccggtaacgggttacccgtaaccttttaaagttttaaccgttaacgggttttaaccccggtaaaccgggtaccggtttccgggttaccgggggaacccctaaggaaccgtacgtttaccgttacggaacgggttcggaacgttacgggttcgggggtaccaacgggtcctacggtttaggtaccgttaccgaaaccgttaacgtaaacggtaaactaccgggaagggtaaccgggtagggggttacgggacgggtacggtacgggaaggttacggtttagggtttaggttaaaccgtttgtacgttgacgtaaggaggtaacggtacgtcgaaccgtagttacgttaccggtaccgttcgttaccgttacgggttcggaacggtacgggtaccgaggtcggtacggacggtaacgtacgtaaacggtacgttggcggtacgtccg

SEQ ID NO: 56253 - DNA, 801 bp, Homo sapiens
  misc_feature: GYAE6OF02H1ZXS.46.34.D01.1.454.CMB.1.raw
tcagactagcagtacacgaccggtgctcgatttagatcgtctgtgttgggtttgggctgatcaggactcctcagttcacttctcacaatgaggctccctgctcagctccgtgggctgctaatgtctcgtcgggtacccaggtacttcgaggtggggtattgttggtgtagtcgtaccttcgcgttcctcctctccgtccctcgtcccgtacctacccgttggacaccggcccgtaccctcctactccttaccgcgtcgtcggtacgttaacgacgtaaacgtccgtagttacctaacgtacggttacgagtaaccggaaacccgtcgtcggtaccgtaggttacgttacggtaacctccgaaccggacggtccggtacccgaacggtccctaaacgttcggtaaccaaccggttcctaacgtttaaacgtttaaaggttacccgggttacccgttaaaccgggccgttaccgggtaccggggtaccaaggtacctagtacgttggtaccggtggactacgggttcgaatacgcgtaacggtgtaacctctaagacgtaagtaaactcgacggtacggtagggtcggaacggttggaaggtaggtaggtttacggtaggttaacgtttacgtacggtagcttaaacgggtctacggtaaggtccgtaacgttacgtacgggttaccggtaccccgttagggttacgtttacccggttaggggaccggtaccgggtaacgtcggtaaccggtacggagttaaccggtaaccgaagtaccgggtttcgacccggtgtaacccgg

SEQ ID NO: 56254 - DNA, 854 bp, Homo sapiens
  misc_feature: GYAE6OF02HVZJU.46.34.D01.1.454.CMB.1.raw
  modified_base (144)..(144): a, c, t, g, unknown or other
  misc_feature (144)..(144): n is a, c, g, or t
tcagactagcagtacacgaccggtgctcgatttagatcgtctgtgttgggtttgggctgatcaggactcctcagttcaccttctcacaatgaggctccctgctcagctccgtggggctgctaatgctcgtcgggtcccaaggtnttcgaggtggggtatgttagtggtatagtacctcgtacgttcctaccctaccttccgtcccttccgcccccgttaccctaccccggttaacgggaccgaccgggtcccccgggtacccttacccctaccttccgttcccgtacggtaccgtacggttacgttaaacggtaccgtaaaaccgttccccttacgttaaccgtaacgtaccgttaacgaacgttaacggtaaaacctccggtcggttaccgtacggttagttaccggtactacccgaacgacggacccggacccgtaacggtacctaaccgtaccgtaaccgtaacccgggtaccgttaacctttaaaacgttttaaacggttaaaccggttttaccggtaacccgggttacgtccgggtaccgggtaccgacgtacgtagtaacgtcgtacggtcgggtacgttacgggtacggtacggtacggtacctacgtgtaactacgtaaaccgaacgtaaaggtaaacgtacgaaggtacggtaacggggtaggacgggtcgtaggtaaggttacggtttaggttaacgtttaattaacgttgacgttacgtaagttacgacgtacgtcgtaactagttacgtccggttacgtccgttagttcggttacggtacggggtaacgtacggagacggttgaacgttacaaccggtaacgtacgtcggtacgtcgtaccg

SEQ ID NO: 56255 - DNA, 747 bp, Homo sapiens
  misc_feature: GYAE6OF02HE2N4.46.34.D01.1.454.CMB.1.raw
  modified_base (252)..(252): a, c, t, g, unknown or other
  misc_feature (252)..(252): n is a, c, g, or t
tcagactagcagtacacgaccggtgctcgatttagatcgtctgtgttgggtttgggctgatcaggactcctcagttcaccttctcacaatgaggctccctgctcagctcctggggctgctaatgctctggtcccaggattcagtggggatgttgtgatgactcagtctccactcctccgtgccctcacccgttggacacgccggtcctccatctcctgcgaggttctaggtacaaacgccttacgtataccncgtgatacggaactaccgtgccgttacggtatttacgggtacttacgaccgaaggtcccggaccgtacgggaccctaagtccgtacccgaagggtccgtaaccctttaaagttttacgttaaacggttttaccggtaaacccgggtcgtaccggttcgggtaccctaaggacgtagtagttccgaggtcggtcggtaggtcgggtacgacggtccgtaacgtcggtaacgttccgtaactaccgtaagtaaacgtcgtaacggtcggtaaggggttaccgggaggtacggtacgggtaggttacggttaggttttaagggttaacgttttactacgtacggttatacggttagaacgtagggtacgacgtaaccgttacggttcggtcccggtaccgttacgttacgggtttaccgggaccgggttagggaaccttaacggtacggtacgtaaggaccgttaacgtaaccggtaacggtcggtacgtcgtaaccg

SEQ ID NO: 56256 - DNA, 727 bp, Homo sapiens
  misc_feature: GYAE6OF02JUYNY.46.34.D01.1.454.CMB.1.raw
  modified_base (148)..(148): a, c, t, g, unknown or other
  misc_feature (148)..(148): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (528)..(528): a, c, t, g, unknown or other
  misc_feature (528)..(528): n is a, c, g, or t
  modified_base (545)..(545): a, c, t, g, unknown or other
  misc_feature (545)..(545): n is a, c, g, or t
tcagactagcagtacacgaccggtgctcgatttagatcgtctgtgttgggtttgggctgatcaggactcctcagttcaccttctcacaatgaggctccctgctcagcctccgtggggtctgactaatgctcgtacgggtcccgaggtnttgaggttgggattgtaggtgtagtcgtactcgtacgtcctcctacctccctcccgtccggtacccgtccgtaccgtaggaccnccggcccggtaccctaccncgttcctcctcgtacgttacgttaccttacgaaccgtaaccgtccgttaactacaccttatagtaacgaacggacctacctcgtaccggtgttacgttacggtactacggaccgtcgggaccgtaccgacgtaacctacccgtaccgtaaccggtaccggtaccgtttaactttaaacgttttaaccggttaacggttaacccggtaccggtaccgtcggacgggttaccacgtacgtagtactgagtacggcggtggacggtactggactacggtntagtacctagaacgtanacgacgtaggtaggacggtagcgtcgtaggtagtagttaggtaacgttaattcgtagtcggatcggtagaggtacgtatcgtactacgtcgtccgttacgacgtacgttaccggcgggttaacggacgtacggtagtacggttacgacgttaacggtagtacgtcggtacgtacgtaaccgg

SEQ ID NO: 56257 - DNA, 765 bp, Homo sapiens
  misc_feature: GYAE6OF02HYPJL.46.34.D01.1.454.CMB.1.raw
tcagactagcagtacacgaccggtgctcgatttagatcgtctgtgttgggtttgggctgatcaggactcctcagttcaccttctcacaatgaggctccctgctcagctccgtgggctgctaatgctcgtcgggtcccaggtattcgaggtggggattggttgtagatgactcagtctccactcctcccgtcgcccgtacacccgttgacgacgccggtcctccactctcctcgctacggtctaacgtaccgaaacgtcctacgtactactacgtgtaagtacggaaaacctccgtgtaccgtggtagtttggtacggtaccaaccgacggccggtacccaggacctaaacgtccgtaccgaacggtcgtaacctttaaagtttagttaaccggtttacgtaaccgggtactcggtacgggtaccaggtacgagtacttcgaggtacggactacgggttgggtaacagggacctaacgttaggtacgttaaccgaacgtaacgtaagtaaacgtacggaacgtacgggtagggttaacgggacggttacgttaagggtaagggttaacgtttaggttaacggttaagttttaacgtacgttacggtactaaggttcggaacggttaacgggacgtacgttaacgtaccggttcggtacccgtttcggttacgtttacggtttccggaaccgggtaacgggacctaacggtcggttaggaacgttaacgtaaccggtaaacgtaaccgtcggttacgacggtaaccg

SEQ ID NO: 56258 - DNA, 507 bp, Homo sapiens
  misc_feature: GYAE6OF01CI0Z0.10.65.F10.1.454.CMB.1.raw
  modified_base (271)..(271): a, c, t, g, unknown or other
  misc_feature (271)..(271): n is a, c, g, or t
  modified_base (315)..(315): a, c, t, g, unknown or other
  misc_feature (315)..(315): n is a, c, g, or t
tcagcatagtagtgcacgaccggtgctcgatttagctacgctctaaggggagtcagtctcagtcaggacacagcatggacatgagggtccccgctcagctcctgggctcctgctactctggctccgaggtgccagatgtgacatccagatgacccagtctccaccgtccctgtctgcatttgtggagacagagtcaccatctcttgccggacaagtcagaacattgacactatttgaattggtatcaacaaaaactggggaaagcccctanactcctgatcaatgcagcgtccagtttacagagtcgggtccctnaaggttcagtggcagtggatctggacagactttactctcaccatcagcgatctgcagcctgacgtattttgcgtactttacactgtacaacagtacgtttccggaaccccgtttacttcggacggtagggaccaagggtgacgatacgaaacgaactgtggctgacacatctcgtcttcattcctccgctac

SEQ ID NO: 56259 - DNA, 522 bp, Homo sapiens
  misc_feature: GYAE6OF01BPJFB.10.65.F10.1.454.CMB.1.raw
  modified_base (320)..(320): a, c, t, g, unknown or other
  misc_feature (320)..(320): n is a, c, g, or t
  modified_base (355)..(355): a, c, t, g, unknown or other
  misc_feature (355)..(355): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaaacaaaaactggggaaagcccctacactcctgatcaatgcagcgtccagtttacagagtgggtcccctnaaggttcagtgcagtggatctggacagactttacnctcaccatcagcgatctgcagcctgacgtattttgcgtacttactactgtacaactagtacgtttcccggaaccccgtttacgtttccgggcgggtaacgggaccaagggtggagatacgaaacgacgtgtggctgcacgatctcgtcttcattccttcccgctacg

SEQ ID NO: 56260 - DNA, 512 bp, Homo sapiens
  misc_feature: GYAE6OF01BCY8A.10.65.F10.1.454.CMB.1.raw
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgtattttgcgtacttactatgtcaacagtacgtttaccggtaaccccgtttactttcggacggtagggaccaagggtggagagtcaaacgaactgtggctgcaccatctgtcttcatcttcccgctac

SEQ ID NO: 56261 - DNA, 721 bp, Homo sapiens
  misc_feature: GYAE6OF01DH64Z.10.65.F10.1.454.CMB.1.raw
  modified_base (286)..(286): a, c, t, g, unknown or other
  misc_feature (286)..(286): n is a, c, g, or t
tcagcatagtagtgcacgaccggtgctcgatttagctacgctctaagggggagtcagtctcagtcaggacacagcatggacatggagggtccccgctcagctccgtggggctcctgctactctggctccggaggtgccagatgtgacatccagatcgacccagtcctccaccgtccctgtctgctatttgtggagacagagtcaccatctcttcggccggtaacaagtcaagaacattcgactacttatttagaattggtatacaaaacaaaaacgtggggaaacncccctacactcctagactacaatgacagtcgtacctagtttacgagtacggtcgggtacccctagaacgttcgaggtggacagtggatcggtaggaactaggtactttactcgtaccacctataccgaggtaccgacttcgacgtacaacgtccctaggtacgttatttggaccctaccgtttactacgttcgtaacctaacgtaacgtttacccgggttttaccccggtaaaccccgttttcggtttaccggggaccggggtaaacgggtaacccggtaaagggtcgggtaacgtaaaccgttaaccggaaaaaccgggtacgttaggggtacgggtacccttaacggtacccggtaaaccgtttacgttccgttaaccggtttcccgtttaaccctaacgttttccccccgttaccccgaccgtttaacccgg

SEQ ID NO: 56262 - DNA, 527 bp, Homo sapiens
  misc_feature: GYAE6OF01BL6IU.10.65.F10.1.454.CMB.1.raw
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacatagtcaccatctcttgccggacaagtcagaacattgacacctattgaattggtatcaacaaaaactggggaaagccctacactcctgatcaatgcagcgtccagtttacagagtgggtccctcaaggttcagtggcagtggatctgggacagtactttactctcaccatcagcgatctgcagcctgacgtatttgcgtacttactactgtacaactagtagtttctcggtaaccccgttactttcgggacggaggtaccgtaaggtcggaagactacgaaacgtaactggtcggctaggccaccgtatcctgttacttcacttcctttcccgcc

SEQ ID NO: 56263 - DNA, 620 bp, Homo sapiens
  misc_feature: GYAE6OF01DWWGK.10.65.F10.1.454.CMB.1.raw
  modified_base (214)..(214): a, c, t, g, unknown or other
  misc_feature (214)..(214): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (360)..(360): a, c, t, g, unknown or other
  misc_feature (360)..(360): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgtggagacagagtcaccatctcttgccgganaagtcagaacattgacactattgaattggtatacaaacaaaaactggggaaacncccctanactcctgatcaatgcagcgtccagtttacagagtcgggtcccctagaaggttcagtggcaggtgatcgtgggacagtactttacnctcaccatacagcgatctgcacgtccgtagtaacgtattttcggacgtactttactacgtgtacctaaacgtcgttaacggttttaccccggaaacccccgttttacggttaccgggaccgggtaacggggtaacccgtaaggggttacggtagtaacgtaaccgtaaaacggtaaccgttgggtcgggacttacggacctacccgtaagttccgttcggtttacctttacaccgttttccccttccccggccttaaccg

SEQ ID NO: 56264 - DNA, 593 bp, Homo sapiens
  misc_feature: GYAE6OF01BW4CU.10.65.F10.1.454.CMB.1.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (394)..(394): a, c, t, g, unknown or other
  misc_feature (394)..(394): n is a, c, g, or t
tcagcatagtagtgcacgaccggtgctcgatttagctacgctctaagggggagtcagtctcagtcaggacacagcatggacatgagggtccccgctcagctccgtggggctcctgctactctggctccgaggtgccagatgtgacatccagatgacccagtcctccaccgtccctgtctgctatttgtggagacagatcacatctcttgccgganaagtcagaacattgacactatttgaattggtatacaaacaaaacgtaggggaaacncccctanactcctagatcaatgacagtcgtcctagtttacgagtacggtcgggtacccctagtaacggttcaggtggcgaaggtggactcgtgggactagtactttactctacaacatacgancgatcgtagctacgacctgacgttatttgactacttactactcgtacaacgtgttaccgtttacccggtaaccccgtttacgttacgggacggtacgggaacgtagggtacggataacggtacaaaccggtacgtggtaccggtactacggacctaccgtatccgttacgtccttacacctttcccttcccgtctaacg

SEQ ID NO: 56265 - DNA, 649 bp, Homo sapiens
  misc_feature: GYAE6OF01AN8AK.10.65.F10.1.454.CMB.1.raw
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgctatttgtggagacagagtcaccatctcttgccgganaagtcagaacattgactacctatttgaattggtatacaaacaaaacgtggggaaacncccctacactctgatcaatgcagcgtacctagttacaggtagtcggggtacccctagtaaggttcaggtcggactaggtggatcgtgggacagtactttactctaccaccatcagcgtatctgcagctgacgtatttcgacgtacttacgtactgtacctaacgacgttaccggttttacccggtaacccccgttttacggtttaccggggaccgggtaacggggtaacccgtaaggggttacgggtaacgtaaaccgttaaccggaaaaccgtaaccgttcgggtacgggtcctaccgggtacctaaccccgtagtttcccggttaccgtttaccgtttaccctaaccgtttccccgtttcccccgaccttaaccg

SEQ ID NO: 56266 - DNA, 665 bp, Homo sapiens
  misc_feature: GYAE6OF01BQA4H.10.65.F10.1.454.CMB.1.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccacccgtccctgtctgctatttgtgganacagatcacatctctgccganagtcagaacnttgactactattgaattggtatacaaacaaaacgtggggaaacacccctacacctcctagatacaagtgacagtcgtacctaagtttacgagtaggtccgggtacccctacgtaacggttcaggtcggacgtaggtaggacttacggtacgggactaacggttacctttaccgtccttaccgacctaattccgaaggtctaacgttcctggaccctacgggtccctaggtaacgttgttttaccggacgttaaccttttaacgtaccgttacgtacctaacgttaccggttaaccggtttaaccccggttaaccccgtttacggtttaccggggaccgggtaaacgggaacccgttagggtacggagtaacgtacgaaacgtacgtggtacggtctacgcctactacttcgttcgtccttactaccgttcctcccgctaccg

SEQ ID NO: 56267 - DNA, 630 bp, Homo sapiens
  misc_feature: GYAE6OF01D2RBH.10.65.F10.1.454.CMB.1.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
tcagcatagtagtgcacgaccggtgctcgatttagctacgctctaagggggagtcagtctcagtcaggacacagcatggacatgagggtccccgctcagctcctgggctcctgctactctggctccgaggtgccagatgtgacatccagatgacccagtcctccaccgtccctgtctgctatttgtgganacagagtcaccatctcttgccgacaagtcagaacattcgactaccttattgaattggtatacaaacaaaacgtgggaaacncccctaacactcctgactacaatgcagccgtactagtttacaggtacggtcgggtcccctagtaacggttcgaggtggcgtaggtcggtatcgtaggactacgtactttactctacaacctatacgagtactatcgtgtacacggtccctaggaaccgtttagtttcgaccgtactttactacgttacgtaccaacgtacggttacccgtttacccggaaccccgttttacggttccgggaccgggtaacgggtaacctaagggttaggacgtaacgtaaccgaaaacggtcctagggtacgccgtacgacctacgtacttccgttagttccttacctagttcccttccccgctaaccg

SEQ ID NO: 56268 - DNA, 589 bp, Homo sapiens
  misc_feature: GYAE6OF01DYV0E.10.65.F10.1.454.CMB.1.raw
  modified_base (95)..(95): a, c, t, g, unknown or other
  misc_feature (95)..(95): n is a, c, g, or t
  modified_base (276)..(276): a, c, t, g, unknown or other
  misc_feature (276)..(276): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
tcagcatagtagtgcacgaccggtgctcgatttagctacgctctaagggggagtcagtctcagtcaggacacagcatggacatgagggtccccgntcagctcctggggctcctgctactctggctccgaggtgccagatgtgacatccagatgacccagtcctccaccgtccctgtctgctatttgtggagacagagtcaccatctcttgccggacaagtcagaacattgacacttatttgaattggtaatacaaaacaaaaacgtggggaaaacncccctacactcctgatcaatgcagccgtctagtttacagtacggtcggggtcccctagtaacggttcagtggctagtggatcgtgggacagtactttacgctcaccatcagcgatcngcacgtcctagaacgttntttagcctaactttacctacgtgtaaccaacgtacgttaccggtttcccggtaaaccccgttttcgtttaccggggacgggtaacgggtaaccgtaagggttacggaagtaacgtacgaaaacggtcgtggtacggctaggacacctagtctcgttcttctacttccgtcccgctacg

SEQ ID NO: 56269 - DNA, 600 bp, Homo sapiens
  misc_feature: GYAE6OF01DA54E.10.65.F10.1.454.CMB.1.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (264)..(264): a, c, t, g, unknown or other
  misc_feature (264)..(264): n is a, c, g, or t
  modified_base (362)..(362): a, c, t, g, unknown or other
  misc_feature (362)..(362): n is a, c, g, or t
  modified_base (591)..(591): a, c, t, g, unknown or other
  misc_feature (591)..(591): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgctatttgtgganacagagtcacatctctgccganagtcagaacattgacactattgaattgtatacaaacaaaacgtggggaaacncccctacactcctagatcaatgcagccgtactagttacagtacgtcgggtccctagtaaggtcaggtcgactagtgatcgtaggactagtactttacnctacactatcgagcgaactcgcgacacgtcctagtacgttatttggacctacttatacgtcgtaacaacgtacgtaccgtttacccgggtaacccctttaggtttacccgggacgggtaaccgggaacgtaagggtacgggaagacttaacggaaacgtacgtggtacggcttacggacctaacccgtacgttccgttacgttcccttactacttccccgtttccccgngttaacccg

SEQ ID NO: 56270 - DNA, 637 bp, Homo sapiens
  misc_feature: GYAE6OF01C9JDI.10.65.F10.1.454.CMB.1.raw
  modified_base (215)..(215): a, c, t, g, unknown or other
  misc_feature (215)..(215): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
tcagcatagtagtgcacgaccggtgctcgatttagctacgctctaagggggagtcagtctcagtcaggacacagcatggacatgagggtccccgctcagctcctgggctcctgctactctggctccgaggtgccagatgtgacatccagatgaccccagtcctccaccgtccctgtctgctatttgtggagacagagtcaccatctctgccgganaagtcaagacattcgacacttatttgaattggtaatacaaacgaaaaacgtggggaaacncccctaanacctcctgatcaatcgcacgcgtacctagtttacgagtacggtcgggtcccctagtaacggttcagtcggacaggtgactcgtggacagttacttctacctcacctatccgagcgtactcgtagaccacgtcccgtaggtaacgtttacgtttcggaccgttaactttaccctaagtacgttaacctaacgtacgttaccggtttaccccggtaacccggtttacgttccggggacgggtacgggaccgtaagggtcggaacgtaacgtaacgtaaaccggtacgtggtacggacgttacgacccgtacctacgttcgtacgttccttaaccgttctcccgtcccgtcctaccg

SEQ ID NO: 56271 - DNA, 703 bp, Homo sapiens
  misc_feature: GYAE6OF01CF6UT.10.65.F10.1.454.CMB.1.raw
  modified_base (269)..(269): a, c, t, g, unknown or other
  misc_feature (269)..(269): n is a, c, g, or t
  modified_base (395)..(395): a, c, t, g, unknown or other
  misc_feature (395)..(395): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtcctgtctgctatttgtgagacatagtcacatctctgaccggacaagtcagacattgactactattgaattggtaatacaaacaaaacgtacggggaaacncccctacactccgtgatcaatgccgagccgtacctagtttaacaggtacggtacggggtcccctagtaacggttcaaggtcggacgtaggtggaacttcgtgggaactagtacttactctacaacntacagtcgtatcgtcgacacgtcctaggaacgttatttcggccgtaaacgtttactacgttacgtaacctaacgtacggtttaaccgtttaccccgggtaaacccccgttttacgggtttacccggggaaccggggtaaacggggttaaccccgtaagggggttacgggaacgttaaccgtaaccgtaaaaccgggtaaccgttagggtcccgggtaacgttacggacccgtaaaccccgtatttacccgttacgtttccctttaccgttaaccgtttaccccccgtttccggaaccctttaacccgg

SEQ ID NO: 56272 - DNA, 773 bp, Homo sapiens
  misc_feature: GYAE6OF01EB5GN.10.65.F10.1.454.CMB.1.raw
tcagcatagtagtgcacgaccggtgctcgatttagctacgctctaaaggggggagtcagtctcagtcaggacacagcatggacatgacgggtccccgctcagctcctggggctcctgctactctggctccgaggtgccagatgtgacatccagatcgacccagtcctcccacccgtccctgtctgctatttggtggagacagacgtcaccatctcttcggacccggaacaagtcaagtaactagttcgaacctaccttatttagaaatttaggtaactaaccaaaaacgtaaaaacggtacggggaaaacctccccctaacacctcctagtactacaatcgcagtcctcgtagtttacgaggtacggtccgggtcccctagtaacggttcgaggtcggacgtaggtggtacgtcggtacgggaactacgttaactttacctcctaccacctactcgacgcgtacttccgcgacgacgtccgtagtacgtttacgtttacgaccgttaacctttactacgttacgtaacctaacggttacgtttacccgggtttaaccccggtaaccccggttttacggttacccggggtaaccggggtaacgggtaacccggtaagggtaccgggtaaacgtaaccgtaaaccggtaaaaccgggttaccggttagggtaccggtaccgttaccgggtaaccccgtaaccgttacgtttaccgtttacggtttaccctttaccgtaacccgtttccccccggtttccccgacctttaacccgg

SEQ ID NO: 56273 - DNA, 620 bp, Homo sapiens
  misc_feature: GYAE6OF01BDNE2.10.65.F10.1.454.CMB.1.raw
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccaccgtccctgtctgctatttgtggagacagatcaccatctctgccganaagtcagacattnactactattgaattgtatacaaacaaaacgtgggaacnccctacactccngatcaatgcagcgtactagttacgagtaggtcgggtccctagtaaggttcaggtcgacgtagtgatcgtagggactagtactttactctacacctatcgacgtcgtactctcgactacgtactacgtaacgttacttttacggacgttaacctttacgtacgttacgtaaccaaacgttacggttaccgtttaccccgggtaaacccgttttacggttacccggggacggggtaacgggtaaccgtaagggttcggaacgtaacgtacgaaaacgtacgtggtacgccgtagacctacgtacttcgtacttccgttactaccgttcccttccccgcttaaccg

SEQ ID NO: 56274 - DNA, 639 bp, Homo sapiens
  misc_feature: GYAE6OF01E11NW.10.65.F10.1.454.CMB.1.raw
  modified_base (193)..(193): a, c, t, g, unknown or other
  misc_feature (193)..(193): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
tcagcatagtagtgcacgaccggtgctcgatttagctacgctctaagggggagtcagtctcagtcaggacacagcatggacatgagggtcccccgctcagctcctggggcctcctgctactctggctccgaggtgccagatgtgacatccagatgacccagtcctccaccgtccctgtctgctatttgtgganacagagtcaccatctcttgccgacaagtcagaacattgactaccttattgaattggtaatacaaaacgaaaaacgtggggaaacacccctaacactcctagactacaatgacagtaccgttacctaacggtttacgaggtacggtccggggtaccccttacgtaacggttcgaggtggcgtaggtggatcggtagggaactacgtaacttttacnccgtacacctatacgagcatccncgactacgtcctaggacttagtttcgaccgtaactttactactacgtacaacgtacggttaccgtttacccggtaacccccgtttacggttacgggaccgggaacgggtaccgtaagggtaggtaacacgtaacgaaacgtaccggtggtacgtccgtagacccactacttcgttacgtccttactaaccttcccgttacccgcttac

SEQ ID NO: 56275 - DNA, 598 bp, Homo sapiens
  misc_feature: GYAE6OF01BCAG2.10.65.F10.1.454.CMB.1.raw
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
  modified_base (396)..(396): a, c, t, g, unknown or other
  misc_feature (396)..(396): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgctatttgttggagacagagtcaccatctcttgccgganagtcagaacattgacactatttgaattggtatacaaacaaaaacgtggggaaacncccctacactcctgatcaatgcagcgtaccagttttacaggtaggtcggggtcccctagtaaggttcaggtcggcaggtggatcgtagggacagtactttactctcacctatcagcgtatctgcngcctagacgtatttcgctacttactactgtactaacgtagtacgttttacccggaacccgttttacgttccggggacgggtaacgggtaaccgtaaggggtcggaacgtaacgtacgaaaacggtaccgtggttacggcgttacgaccctaaccgtacttccgttacgttccttacctaacttcccgtttccccgacttacg

SEQ ID NO: 56276 - DNA, 674 bp, Homo sapiens
  misc_feature: GYAE6OF01AXIOK.10.65.F10.1.454.CMB.1.raw
  modified_base (276)..(276): a, c, t, g, unknown or other
  misc_feature (276)..(276): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgctatttgttggagacagagtcaccatctcttgccggacaagtcagaactattgactacctatttagaattggtatacaaacaaaaacgtggggaaacncccctacactcctgactcaatgcagcgtacagtttacagacggtcgggtcccctagaaggtcaggtgcgagtggatcgtaggactagtacctttactctaccactatcgagacgtacgttctcgacctacgtccgttaggtacgttacgttttacgaccgttaacgtttaaccttacgttacgtaacctaacgttacggttaacccggttttaacccccgggttaacccccggttttaacggtttccggggaaccggggtaacgggtaaccgttaaggggtacggaacgttaacgtaaccgaaaaccggttacgtaacggtcggtaccgtagaccctaactaccgttaccgttccggttacctttaaccctacgttccccttccccggccttaaaccg

SEQ ID NO: 56277 - DNA, 604 bp, Homo sapiens
  misc_feature: GYAE6OF01D2J56.10.65.F10.1.454.CMB.1.raw
  modified_base (96)..(96): a, c, t, g, unknown or other
  misc_feature (96)..(96): n is a, c, g, or t
  modified_base (215)..(215): a, c, t, g, unknown or other
  misc_feature (215)..(215): n is a, c, g, or t
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
  modified_base (375)..(375): a, c, t, g, unknown or other
  misc_feature (375)..(375): n is a, c, g, or t
tcagcatagtagtgcacgaccggtgctcgatttagctacgctctaaggggggagtcagtctcagtcaggacacagcatggacatgagggtccccgntcagctcctggggctcctgctactctggctccgaggtgccagatgtgacatccagatgacccagtctccaccgtccctgtctgctatttgtggagacagatcaccatctcttgaccganaagtcaagaacattgactacttatttgaattggtaatacaaaacaaaaacgtggggaaaacncccctaanactcctgatacaatgacagcgtacctagtttacagtacggtcgggtccctagaaggttcaggtgcagtgatcgtaggactagtacttacnctacacatcagcgatctgcagtcctagacgtatttgacgtaactttactacgtgtaaccaaacgtacggttaaccggtttacccggtaaaccccgttttacggtttaccgggacggggtaaccgggaaccgtaagggtacggaaggtaactaaccgaaaacgtcgttaggcggtactacgacctaaccgtattctacgttcctttacacgtttcccttcccgcttaacg

SEQ ID NO: 56278 - DNA, 735 bp, Homo sapiens
  misc_feature: GYAE6OF01DTQW2.10.65.F10.1.454.CMB.1.raw
tcagcatagtagtgcacgaccggtgctcgatttagctacgctctaagggggagtcagtctcagtcaggacacagcatggacatgagggtccccgctcagctccgtggggcctcctgctactctggctccggaggtgcctgatgtgacatccagatcgacccagtcctcccaccgtccctgtctgctatttggtggagacagagtcaccatctctcgccggataagtcaagaactattcgacctaaccttagtttagaagtttggtaaactaaccgaaaaaccgtaaaaacggtcgggggaaaacctccccctaactaaccgtccgtagaactacaaagtcgacgtacgtccgtacgtaggtttacgaaggtcggtcgggtcccctagtaacggttcaggtcggacgtaggtggtactcggtacggaactacgttacttactcctacgaacctatacgagacgtactcgtagcgtacgtccgtacgtaacgttacgtttaccggacctttaaactttaccgtacgtacgtaaccgtaacggttacggttaccccggtttaaccccggaaaccccggttttacggttacggggaaccggggtaacggtaacgtaaggggtcgaaacgtaccgtaaaaccggtaaaccgtacggtggtacgtccgtacggaccttaccgtacgttcgttaccggtttacccttaccgtacccgtttacccctccccgtaattaacccg

SEQ ID NO: 56279 - DNA, 731 bp, Homo sapiens
  misc_feature: GYAE6OF01EZ7W7.10.65.F10.1.454.CMB.1.raw
  modified_base (227)..(227): a, c, t, g, unknown or other
  misc_feature (227)..(227): n is a, c, g, or t
tcagcatagtagtgcacgaccggtgctcgatttagctacgctctaagggggagtcagtctcagtcaggacacagcatggacatgagggtccccgctcagctcctggggcctcctgctactctggctccgaggtgccagatgtgacatccagatcgacccagtcctccaccgtccctgtctgctatttgtggagacagagtcacatctcttgccgacaagtcagaacnttcgactacttattgtaattggtatacaaacaaaacgtggggaaacgtcccctacacctcctagatacaatgacacgtccgtacctagtttacgagtacgggttccggggttacccctagtaacggttacgaggttcggacgtaggtggtacgttacgtaggggtaactaacggttaccttttaccgtacctacctaaccctagtaccgtacggtacgtacgttcctacggacctaacgtcccgttaaggtaaccgtttagttttacggaccgttaacctttaaccgtacgttaccgttaaccgtaaaccgtacggtttaaccccggttttaaccccgggttaaaccccggttttaccggttacccggggtaccgggggtaaacgggtaaccgttaaggggtacggaacgtaacgtaacccgaaacggtacgtcggtacggcctacggaccctaccgtagttcccgttacgttcctttacaccgtttcccttcccgacttaccg

SEQ ID NO: 56280 - DNA, 659 bp, Homo sapiens
  misc_feature: GYAE6OF01B52G9.10.65.F10.1.454.CMB.1.raw
  modified_base (231)..(231): a, c, t, g, unknown or other
  misc_feature (231)..(231): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (625)..(625): a, c, t, g, unknown or other
  misc_feature (625)..(625): n is a, c, g, or t
tcagcatagtagtgcacgaccggtgctcgatttagctacgctctaagggggagtcagtctcagtcaggacacagcatggacatgagggtcccccgctcagctccgtggggctcctgctactctggctccgaggtgccagatgtgacatccagatcgacccagtcctcccacccgtccctgtcctgtctagttttgtggagacagagtcacatctctgcgacagtcagaacntagactacttattagattgatacaaagaaaacgtggaacnccctanactcagtancatcgacacgtctactagttacgaggtacggtccggtacctagtaggtcgaggtggcaggtgagtcgtacggactacgttactttacactacacgtactacgacgtacgacgtcgtcgaccagttacctaggtacgtttactttcggacccttaacgttacctacgtacgtacaaaccggttgtttaaaccccgggtttaccccgttaacccggtttacgggtaccgggacggggttaaaccggaccgtaaggggttacgaacgttaaccgtaaccgtaaacggtaccgttgggacgtacgtacgacccttaccgtagttcccgtttgttaaccccttnttaaccccgtttccccgttacccgccgttaaccg

SEQ ID NO: 56281 - DNA, 785 bp, Homo sapiens
  misc_feature: GYAE6OF01B9JQ8.10.65.F10.1.454.CMB.1.raw
  modified_base (95)..(95): a, c, t, g, unknown or other
  misc_feature (95)..(95): n is a, c, g, or t
  modified_base (221)..(221): a, c, t, g, unknown or other
  misc_feature (221)..(221): n is a, c, g, or t
tcagcatagtagtgcacgaccggtgctcgatttagctacgctctaagggggagtcagtctcagtcaggacacagcatggacatgagggtccccgntcagctccgtgggctcctgctactctggctccgaggtgccagatgtgacactccagatcgacccagtctccaccgtccctgtctgctagtttgtggagacagagtcaccatcctcttggaccgganaagtcaagaactattgaacctacttagttagtaattggtaactaacaaaacgtaaaaacggtcggggaaacctccccctaacaccgttcctagtactacaatcgactagtccgttactaacgtttacgacggtacgggttccgggttacccctagtaacggttcaacggtcggtaccgtagggtcgacgttcggtagggtaacctagttacctttacctcctacctaacccgatacgtacggtaccgtagttccgtagtaccgtacggtcccgttaaggtaaccggtttattttaccggggaacctttacccgttttaaaccgactttaccggtacctaaaccggttaacgtttacccgggttttaacccccgtaacccgggttttaccggttaccggggaccggggttaaacgggtaaccgttaaggggtacgtaacgtaccgttaaaccggtaaaccgttacggttacgggtaccggtcccgtacggtaaccctaccgttaccgttacgttaccgtttaccttacccggttaccgtttacccccgttcccgtccttaaacgg

SEQ ID NO: 56282 - DNA, 810 bp, Homo sapiens
  misc_feature: GYAE6OF01DSNRG.10.65.F10.1.454.CMB.1.raw
  modified_base (804)..(804): a, c, t, g, unknown or other
  misc_feature (804)..(804): n is a, c, g, or t
tcagcatagtagtgcacgaccggtgctcgatttagctacgctctaagggggagtcagtctcagtcaggacacagcatggacatgagggtccccgctcagctccgtggggcctcctgctactctggctccgaggtgccagatgtgacatccagatcgacccagtcctcccgaccgtccctgtctgctagtttgtggagacagacgtccacctatcctcgtcggaccgaacaagtcaagaactattacgacctaacttatttagaatttggtaataaccgaaaaacgtaaaaccggtaggggaaacctccccctaactacctccgtagtactacaagtcgactacgtccgtactagttacgaggtacggtccgggtaccctacgtacggttcgaggtcggacgtagggttaggtacgttacggtagggtaacctaacggttaaccctttccgtaccgtacccacctacgtacggtacgtaccgttatccgtagaccgtaccggtcccgtaggttaacccgtttagtttacccggtaaccgttaacgttttaacctaaccggttacgttaacccgtaacccggtttaaacgggttacccgggtttttaaccccccgggtaaaccccggtttttccggggttaacccgggggaaccggggttaaacccggggttaaccggtaaacgggggttaaccggaggtaaaccccgttaaccggaaaaacggttcgtaaccgggtcggtacgtacccgtcgtaaacccttgtccgtttcggttaccttacccgtccctttacccggtccccgtnttaccg

SEQ ID NO: 56283 - DNA, 724 bp, Homo sapiens
  misc_feature: GYAE6OF01CNP67.10.65.F10.1.454.CMB.1.raw
  modified_base (659)..(659): a, c, t, g, unknown or other
  misc_feature (659)..(659): n is a, c, g, or t
  modified_base (671)..(671): a, c, t, g, unknown or other
  misc_feature (671)..(671): n is a, c, g, or t
tcagcatagtagtgcacgaccggtgctcgatttagctacgctctaagggggagtcagtctcagtcaggacacagcatggacatggacgggtccccgctcagctccgtggggctcctgctactctggctcgaggtcgcagatgtgacatccagactcgaccagtcctccaccgtcctgtctgctagttgtagagacagactacaccattctacgttcggaccgaataacgtcaagaactagttacgactaccttagttagtaagttggtaaactaacgaaaacgtaaaaccggtaggggaaacctacctaaccacttaccgatacctaataacgtcgactacgtacctaacgtacgttacgacggtacggttccgggtacctagtacgtgtacgaggcgtaggtggacgttcggaacgggtaactacgttaacgttttaccacttacaacctatacgacggttacacgttcacggtaaccctacggtacctaggtttaacgtattttcgggaaccttaacgtttacaactcgtaaaccaacggttaacggtacccggtttaaccggttaacccggttaggttacccgggaacggggtaacgtacgggtaaggtacggacgttaaacggaacccgtaaagtccgggtatacggtaccgtanaccggttaaacncggtttaaccttcgttaacccgtacttaccgttacccctaccggaattaccgg

SEQ ID NO: 56284 - DNA, 756 bp, Homo sapiens
  misc_feature: GYAE6OF01B0A07.10.65.F10.1.454.CMB.1.raw
  modified_base (474)..(474): a, c, t, g, unknown or other
  misc_feature (474)..(474): n is a, c, g, or t
tcagcatagtagtgcacgaccggtgctcgatttagctacgctctaagggggagtcagtctcagtcaggacacagcatggacatggagggtccccgctcagctccgtgggctcctgctactctggctccgaggtgccagatgtgacatccgagatcgacccagtcctcccacccgtccctgtctgctagtttgtggagacagtagtcaccatctcgttcggaccgaacaagtcaagaactatacgaacctacctttatttagtaagtttaggtaactaaccgaaaaacgtaaaaacggtaggggaaaccctaccccgtactacgtcctagactacgtaagtcgacctacgtccgttacgtaacgttacgacggtacggtcccgggttaccctacgtaaggttcgaggtcgtacgtagtcggtattcggaggactaacgtacctttacgctacctaactacgtacgacggtacgtntccgtacgtacgacgtcccgttaggtaaccgtttgtttaccgaccctttaaccgtttacgacgttaccgtaacgtaaccggttaccggtttaacccgggttttacccccggttaaaccggttttcccgggtaccggggtaccgggtaacgggtaaccgtagggttaacggacgtaacgtaaaccgtaaacggtacggttcggtaccggtccttagaccccgttaacgtacttccggttacgttaccctttccgtacccgtttccccgttaccgacccttacg

SEQ ID NO: 56285 - DNA, 758 bp, Homo sapiens
  misc_feature: GYAE6OF01CTPQD.10.65.F10.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
tcagcatagtagtgcacgaccggtgctcgatttagctacgctctaagggggagtcagtctcagtcaggacacagcatggacatgagggtccccgctcagctccgtggggctcctgctactctggctccgaggtgccagatgtgacatccagatcgacccagtcctccaccgtccctgtctgctattgtgganacagactcacatctctcgccganagtcaagacattgacctacttatttagtaattggtaactaacaaaacgtaaaaacgtacgggggaaacctaccccgtaactacctccgtanaacgtacaagtcgacgtacggtaccgttaaccgttacgtttaacgtagtaccgggtttaccgggttacccccgtaacggttaacgggttcgtaagggtcggtaccgtaaggtacgggtaacgttccggtaagggtaacctaacggttacccttttaccgtaccttaccgtaccgtaacgtaccgtacgtaccgattccggtacgactacggtccttaggtaacgtttacgtttcggtaacttaacctttacgtaaccgttctaacgtaaaccggttacgttaacccggtttaccccggttaaaccccggtttaggttcccggggaaccgggtacggaaccggtaggttaaccggattaaaccgtactaaacggtagttcggacggtacccgtagacccttactacgtttgttaccgttccgttcctaccgtttccccgtacccgtcttaacg

SEQ ID NO: 56286 - DNA, 668 bp, Homo sapiens
  misc_feature: GYAE6OF01DKUWG.10.65.F10.1.454.CMB.1.raw
  modified_base (195)..(195): a, c, t, g, unknown or other
  misc_feature (195)..(195): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (402)..(402): a, c, t, g, unknown or other
  misc_feature (402)..(402): n is a, c, g, or t
  modified_base (659)..(659): a, c, t, g, unknown or other
  misc_feature (659)..(659): n is a, c, g, or t
tcagcatagtagtgcacgaccggtgctcgatttagctacgctctaagggggagtcagtctcagtcaggacacagcatggacatgagggtccccgctcagctccgtgggctcctgctactctggctccggaggtgccagatgtgacatccagatcgacccagtcctcccaccgtccctgtctgctagtttgtgganacagagtcacctatctctgaccggacagtcaagactattcgactacttattgaatttggaatacaaaacgaaaacgtacggggaaacctacccctacaccgtcctagactacaagtgacgtacgtccgtacctagttacgaggtacggtccggtccctagtacgtgagtgcngtgngtcgtaggactacgtacttcgtcacgactanacgagctactcgtcgactacgtcctaggtacgtttacgtttcgacgttaacctttacctacgttacgtaccgtaagtaccggtttacccgggtttaccccggttaaccccggtttacggttccgggaaccggggttaacgggaaccggtaagggtacggacgtaacgtaaccgtaaacgtacggttggtaccggtactcggtaaccctacccgttattcgttacgtttaccttacctaccgtttccccctcccggtnttaaacccg

SEQ ID NO: 56287 - DNA, 648 bp, Homo sapiens
  misc_feature: GYAE6OF01CXBTR.10.65.F10.1.454.CMB.1.raw
  modified_base (231)..(231): a, c, t, g, unknown or other
  misc_feature (231)..(231): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
  modified_base (633)..(633): a, c, t, g, unknown or other
  misc_feature (633)..(633): n is a, c, g, or t
  modified_base (644)..(644): a, c, t, g, unknown or other
  misc_feature (644)..(644): n is a, c, g, or t
tcagcatagtagtgcacgaccggtgctcgatttagctacgctctaagggggagtcagtctcagtcaggacacagcatggacatgacgggtccccgctcagctccgtgggctcctgctactctggcctccgaggtcgaccagatgtgacactccagactcgacccagtcctcccaccgtccctgtctgctagtttgtaggagacagacgtcacctatctcgttcgaccgaanaacgtcaagtactatcgacctaacttatttagaattacggaactaacaaaacgtaaaacgtcggggaaaccncccctaancgtccagtactacgaancgacacgtactacgtagttacgacgtacggtcggtccctaggtaacgtnggtcgactaggtgactcggtacggaactacgttaccttcgactacgacctagacctaggactactcgtacgacgacgtaccgtgtaacttagtttcgaaccgttaactaccgtactacgtaactaaccggacgttttacccggttaccccggtaaccggtttacgtaccggggtacgggtacggtaacgtacgggtacagtaaccgaaccgtaagtacccgtgtacgcgacgtactacgtgttactcgtctacctntcccgtcccgntacg

SEQ ID NO: 56288 - DNA, 887 bp, Homo sapiens
  misc_feature: GYAE6OF01ANQ5R.10.65.F10.1.454.CMB.1.raw
  modified_base (147)..(147): a, c, t, g, unknown or other
  misc_feature (147)..(147): n is a, c, g, or t
  modified_base (161)..(161): a, c, t, g, unknown or other
  misc_feature (161)..(161): n is a, c, g, or t
  modified_base (185)..(185): a, c, t, g, unknown or other
  misc_feature (185)..(185): n is a, c, g, or t
tcagcatagtagtgcacgaccggtgctcgatttagctacgctctaagggggagtcagtctcagtcaggacacagcatggacatgacgggtccccgctcagctccgtgggctcctgctactctggctccggaggtgccagatgtgacntccagatcgacccngtcctccaccgtcctgtctgcgtntttggtaggagacgagactccacctattccgtcgtcgaccggacaacgtacaagaactagtacgaactaccgttagtttagtaagttggtaactaccgaaaacgtaaaaacggtcgggaaacccgtcccctaacgtacccgttctagtaacctacgtacgtcgaccgtacggtcccgttaccgtaaggtttacgacggttacgggtacccgggttccccgttaagtaaccgggtttaccgtagggtcggtaccgttagggtacgggtacttcgggtacgggtaacttacgtttaccttttacctacgtacccctaacgtacgtaccgaacggttcgtacgtacgtacggacgtaccggtttacgaacgtttacggtttaaccgtttacggtaaccgttttaaccccgtttaagtaacccggtttaaaccttacccgggttaaaccgtttacccgggggttaaaccccgtttttaacccccgggtttaacccggtttaaccgggttaaccgggttaaccgggggtaaccccgggtaaaccggttaaacggggttcggaaaaccttaaccgggttaaaccggtaaaccgtttaccgggtcggttacccggtaacggtcccctaaccggttccctaaggtttcccggttttacctaccgtttacccggttaacccttccccggtttcgaacccgttttaccccgg

SEQ ID NO: 56289 - DNA, 580 bp, Homo sapiens
  misc_feature: GYAE6OF01CXU5E.10.65.F10.1.454.CMB.1.raw
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgtggagacagagtcaccatctcttgccggacaagtcagaacattgacactatttgaattggtatacaaacaaaaactggggaaacgcccctaacactcctgactcaatgcacgcgtacctaagttttacgaggtaacggttcgggggtccccttacgaacggttcgaggtcggcacggttgggaacttcgtagggacaggtacctttacgtctaccaccatcagcgtatccgtgcagtccctagaccgttagtttcgacgtaccttactactcgtacaacgagttacgtttcccgtaacccgtttcgttacggacggtacgggaccaagggtcgacgatacgaaacgtactggcgtctagacctctacttctcgttctactatttccctccgcttac

SEQ ID NO: 56290 - DNA, 587 bp, Homo sapiens
  misc_feature: GYAE6OF02GYBK0.10.65.F10.1.454.CMB.1.raw
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgtggagacagagtcaccatctcttgccggacaagtcagaacattgacacctatttgaattggtatcaaacaaaaactggggaaagcccctacactcctgatcaatgcagcgtccagtttacagagtgggtcccctgaaggttcagtggcagtggatcgtgggacagactttactctcacatcagcgatctgcagcctgacgtatttgcctattactactgtaccaacagtacgtttcccggaacccgtttacgtttccgggacggtaacgggaccgtaagggtcgggagaacgttaccgaaaaccggtacgttacggtacgggtccttacggaccctaacccgtaacgttccgttacgtttaccgtttaccaacgtttccccgtttacccccggaccttaaccg

SEQ ID NO: 56291 - DNA, 507 bp, Homo sapiens
  misc_feature: GYAE6OF02G6C6Z.10.65.F10.1.454.CMB.1.raw
  modified_base (274)..(274): a, c, t, g, unknown or other
  misc_feature (274)..(274): n is a, c, g, or t
  modified_base (503)..(503): a, c, t, g, unknown or other
  misc_feature (503)..(503): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactgggaaagcccctanactcctgatcaatgcagcgtcagtttacagagtgggtccctcaaggttcagtggcagtggatcgtggacagactttactctcaccatcagcgatctgcagcctgacgtattttgcgtacttactactgtcaactagtacgtttaccggaacccgttacgtttcggcggtagggaccgaaggtggagaactacgaaacgactgtagctgcacatctgtcttcatcttccnctac

SEQ ID NO: 56292 - DNA, 554 bp, Homo sapiens
  misc_feature: GYAE6OF02GO07E.10.65.F10.1.454.CMB.1.raw
  modified_base (320)..(320): a, c, t, g, unknown or other
  misc_feature (320)..(320): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaaacaaaaactggggaaagcccctacactcctgatcaatgcagcgtccagtttacagagtgggtcccctnaaggttcagtggcagtggatcgtgggacagtactttactctcaccatcagcgatctgcagcctgacgtatttgcgtacttactactgtacaacgagtacgtttacccgaacccgtttacgtttaccgggcggagggtaccaagggtggaacgacgtacgaaacgtacgtaggtcggctcgacctaaccgtagttcgttacgtctttaccgacgtttccttccccgcgttaaccg

SEQ ID NO: 56293 - DNA, 511 bp, Homo sapiens
  misc_feature: GYAE6OF02GMKRU.10.65.F10.1.454.CMB.1.raw
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactgggaaagcccctacactcctgatcaatgcagcgtccagtttacagagtgggtccctcaaggttcagtggcagtggatctgggacagtactttactctcaccatcagcgatctgcagcctgacgtatttgcgtacttactactgtcaactagtacgtttccggaaccccgttactttccgggcggtaacgggaccgtaagggtggagatacgaaacgtactgtggctgcacatctgtctcatctcccgctac

SEQ ID NO: 56294 - DNA, 575 bp, Homo sapiens
  misc_feature: GYAE6OF02HKLBO.10.65.F10.1.454.CMB.1.raw
  modified_base (189)..(189): a, c, t, g, unknown or other
  misc_feature (189)..(189): n is a, c, g, or t
  modified_base (265)..(265): a, c, t, g, unknown or other
  misc_feature (265)..(265): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgtgganacagagtcaccatctcttgccggacaagtcagaacattgacactattgaattggtatcaaacaaaacgtgggaaancccctacactcctgatcaatgcagcgtccagtttacagagtcgggtcccctgaaggttcagtggcagtggatcgtgggacagtactttactctcacctatcagcgatctgcagcctgacgtatttcgacgtacttactactgtaccaacgtacgtacggtttacccggtaaccccgttttagtttccgggacgggtaacgggtaaccgtaagggttacggaagtaacgtaccgaaacggtacgtggtacggtctcggaccaaccgtattccgttcgttaccttctacctttcccgttaccccgactaacg

SEQ ID NO: 56295 - DNA, 542 bp, Homo sapiens
  misc_feature: GYAE6OF02H32EA.10.65.F10.1.454.CMB.1.raw
  modified_base (361)..(361): a, c, t, g, unknown or other
  misc_feature (361)..(361): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacatagtcaccatctcttgccgacaagtcagaacattgacacctatttgaattggtatcaaacaaaaaactggggaaaagcccctacactccctgatcaatgcagcgtccagttttacagagtggggtcccctcaaggttcagtggcagtggatctgggacagactttacnctcaccatcagcgatctgcagcctgacgattttgcgtacttactactgtaccaacagtacgttttcccggaaaccccgtttacgtttccgggacgggtaacggggaccctaaagggtcggaaggtactacgaaaacgactggtggctagcaccatcttgtcttcacttcttcccgcctaac

SEQ ID NO: 56296 - DNA, 534 bp, Homo sapiens
  misc_feature: GYAE6OF02H6ST2.10.65.F10.1.454.CMB.1.raw
  modified_base (270)..(270): a, c, t, g, unknown or other
  misc_feature (270)..(270): n is a, c, g, or t
  modified_base (387)..(387): a, c, t, g, unknown or other
  misc_feature (387)..(387): n is a, c, g, or t
  modified_base (530)..(530): a, c, t, g, unknown or other
  misc_feature (530)..(530): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcattttgttggagacagagtcaccatctcttgccggacaagtcagaacattgacacctatttgaattggtatcaaacaaaaactggggaaancccctacactcctgatcaatgcagctccagtttacagagtgggtccctagaaggttcagtgcagtggatcgtggacagtactttactctcaccatcagcatctgcagcctagacgtnttttcgacgtacttactactgtacaactagtaacgtttcccggaacccgtttactttcgggacggtaaggacctaagggtggaacgtaatacgaaacgtactggtacggtctagcactatctagtccttcacttccttcccgntacg

SEQ ID NO: 56297 - DNA, 559 bp, Homo sapiens
  misc_feature: GYAE6OF02G0ZO9.10.65.F10.1.454.CMB.1.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgtgganacagagtcaccatctcttgccgganaagtcagaacattgacacctatttgaattggtatcaaacaaaaactggggaaagccctacactcctgatcaatgcagcgtccagtttacagacggtggggtcccctgaaggttcaagtggcagtggatcgtgggacagtactttactctcacctatcacgcgatctgcagccctagacgtattttcgacgtactttactacttcgtacaactagtacgtttacccggaacccgtttacgttccgggacggaagggtaccgtaaggttgggagaacgtacaaacgtacgttggtaggctcgacacctacgttcttcgttaccttccaagttcctttccccgactac

SEQ ID NO: 56298 - DNA, 583 bp, Homo sapiens
  misc_feature: GYAE6OF02GAIC0.10.65.F10.1.454.CMB.1.raw
  modified_base (269)..(269): a, c, t, g, unknown or other
  misc_feature (269)..(269): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaacttggtatcaacaaaaactggggaaancccctacactcctgatcaatgacagcgtcctagttacagagtcgggtccctacaagttcagtggcgtagtcggatcgtgggacagactttactctacaccatctagcgtaatctgcgacgccgttgaacgtagttttagaccgtaacttaactacttgtaccaactacgtacgttttacccggaaccccgtttacgtttaccgggacggtaacgggtaaccaaggggttagacgtaataccgaaacgtactacggtacgtcgtcggactaccctaattccgttgttcttacgtactcctttccccgactaaccg

SEQ ID NO: 56299 - DNA, 602 bp, Homo sapiens
  misc_feature: GYAE6OF02H0ZMF.10.65.F10.1.454.CMB.1.raw
  modified_base (284)..(284): a, c, t, g, unknown or other
  misc_feature (284)..(284): n is a, c, g, or t
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattgtatacaaacaaaaacgtggggaaacgcccctacactccngatacaatgacagccgtccagttttacagtacggtcggggtcccctcgtaaggttcaggtggcagtggatcgtaggacagtactttactctacaccatcagcgatcngcacgtctagactntttcgcgttacttactactacgtacaaacgtgtacgtttacccgggtaaccccgtttacgttaccgggcgggtaacgggtaccgtaagggttcggaagtacgtaacgaaacgtacgtaggtcggtaccttaggaccctaccgtaactttccgttaggttcccttaccgtaccctttcccgttacccccggacctacg

SEQ ID NO: 56300 - DNA, 600 bp, Homo sapiens
  misc_feature: GYAE6OF02IBP4L.10.65.F10.1.454.CMB.1.raw
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
tcagcatagtagtgcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccaccgtccctgtctgctattttgttggagacagagtccacctatctcttgccggaacaagtcagaacattgacaccttattgaattggtaatacaaacaaaaacgtggggaaactacccctaacactcctagactacaatgcaagcgtacctagttacagacggtcgggtcccctagtaaggttcagtgacagtgatcgtaggaaacgtctttacnctacactatcagctatcngactagccttgacgttatttcgaccgtaacttacactcgtacaataggtactttacccggtaaccctttagttccgggacggtaaggaccgtaagggtcggaacgagtaaaccgaaagtaccgtggacgtcgtcggaccctaacgtaacgttccgttagttactttaccgtatttaccccggttacccgaccctagtacccg

SEQ ID NO: 56301 - DNA, 563 bp, Homo sapiens
  misc_feature: GYAE6OF02I13QG.10.65.F10.1.454.CMB.1.raw
  modified_base (365)..(365): a, c, t, g, unknown or other
  misc_feature (365)..(365): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgctatttgttggagacagagtcaccatctcttgccggacaagtcagaacattgacactattgaattggtatacaaacaaaaacgtgggaaacgcccctacactcctagactacaatgcagcgtcctagtttacagacgtcgggtccctacgaaggttcagtgcagtgatcgagggacagtactttacnctacacatcagcgatctgcagctagacgtatttcgacttacttactacttgtaccaacgtacgtacgtttaccccggtaacccgtttacgtttaccgggacggtaacgggaaccgtaagggtcggaagtaacgtacgaaacgacgttggtacggctcgaccactacgtcgttcgtcttacctacttccctaccgctac

SEQ ID NO: 56302 - DNA, 563 bp, Homo sapiens
  misc_feature: GYAE6OF02HZZ78.10.65.F10.1.454.CMB.1.raw
  modified_base (272)..(272): a, c, t, g, unknown or other
  misc_feature (272)..(272): n is a, c, g, or t
  modified_base (366)..(366): a, c, t, g, unknown or other
  misc_feature (366)..(366): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgctattttgttggagacagagtcacatctcttgccggacaagtcagaacattgacactatttgaattggtatacaaacaaaaacgtggggaaacncccctacactcctagatcaatgcagctccagtttacagtacgtcgggtcccctgtaaggttcaggtggcagtggatcgtggacagtactttacnctacaccatcagcgatcgtgcacgtcctgactattttcgacgtacttactactgtactaacgtagtacgtttacccggaacccgtttacgtttaccgggacggtaacgggaaccaagggtcggaagtacgtacgaaacgtactggtcggctcgactaacctagttcgtacgttcttaccacttccttacccgctacg

SEQ ID NO: 56303 - DNA, 699 bp, Homo sapiens
  misc_feature: GYAE6OF02H7UUD.10.65.F10.1.454.CMB.1.raw
  modified_base (219)..(219): a, c, t, g, unknown or other
  misc_feature (219)..(219): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccacccgtccctgtctgctattttggttggagacagagtcacatctcttgccgganagtacagaactattcgaactaccttatttgtaatttggtaataccaaaacaaaaacggtacggggaaacacccctactacctctagactacgaatgaccgagtccgtacctagtttacgagtacggtcgggtacccctagtacggttcaggtcgcgtagtggacttcggtacgggaactagtttaacttttacctcgttccggactacgttcccgacgtacgtccgtcggaccgtaggacccttaggtaaacgtttacgtttcgaccgtaacttaagttaaccgttttacgtacgttaactaaacgttaagtaagttaacgaaacgttccgtccccgtactaaccggttaccgggtttaccgggggaaccgggtaaccgtaacggggttagtaacgtttaccgaaaacgtacgttcgggtacggtacacggtaccacccgtagttcccgtttagttccttaccgtaccttcccgtacccg

SEQ ID NO: 56304 - DNA, 848 bp, Homo sapiens
  misc_feature: GYAE6OF02J2M8R.10.65.F10.1.454.CMB.1.raw
tcagcatagtagtgcacgaccggtgctcgatttagctacgctctaaggggagtcagtctcagtcaggacacagcatggacatgagggtcccgctcagctctgggctcctgctactctggctcgaggtgccagatgtgacactccagatcgacccagtctacccaccgtcctgtctcgtctagttttcgttggacgtacgagacgtaccaccgtattccgtcgttacgaccggaacaaggttcaacgtaacctactttcggaaccttacccgttattttacggtaaactttacgggtaacttaaccgtaaaaccgtaaaaaaccggttacgggggtaaaacccgtacccccgtaacccttaccgttaccgtacggtaacgtaaccgtaaacttccggaccgttacggtaccccggttacctaacggttttaaccggtaacgggttaccgggtttacccgggggttaccccctacggtaaacggggtttcctaagggtccggacgtaacgggttggtaacgtcggtacggtacctaagtaccgttttactccgtactaccgtaatccgtacggaccgtatcgtactacgaacgttacccgtacgttaacgttactttaccggtaccgttaccgttaacttaccgtacgtaccaaacgtaccgtttaaccgggtttacccggttaacccgttacggttaccgggtaccgggtaaacggtacccgttaagggttaccgaaacgtaccggtaacgtaaacggtacgtacggtaccgtaccggtcctccgaaccttaccggttacttcgtacccttaccggttacccgttcccggttaaccctaccgttaaccg

SEQ ID NO: 56305 - DNA, 652 bp, Homo sapiens
  misc_feature: GYAE6OF02G2EYY.10.65.F10.1.454.CMB.1.raw
  modified_base (216)..(216): a, c, t, g, unknown or other
  misc_feature (216)..(216): n is a, c, g, or t
  modified_base (394)..(394): a, c, t, g, unknown or other
  misc_feature (394)..(394): n is a, c, g, or t
tcagcatagtagtgcacgaccggtgctcgatttagctacgctctaagggggagtcagtctcagtcaggacacagcatggacatgagggtccccgctcagctcctggggctcctgctactctggcctccgaggtgccagatgtgacatccagatgacccagtcctccaccgtccctgtctgctatttgttggagacagagtcaccatctctgccganaagtcagaacattgactacctattagaattggtatacaaacaaaaacgtgggaaacgccccctaacacctcctagactacaaatgaccgagtccgtaccgtagtttacgagtacgggtcgggtcccctagtaacggttcagtcggactaggtggtatcgtaggactacgtactttacnctacaccgatcgagtctatctacgacgacgtcccgtagtaccgttagttttccgaccttactttaccttaacgttcgtaacctaacgtaacgggttaccgtttaaccccgggtaacccgttttcggttaccgggaccgggtaacgggtaaccgtaagggtcggaaacgtaacgtaaccgtaaacgtacgtcggtacggtctacggacctaacgtacgttcgttacgttcctttacgttaccgtttcccaccgtatacg

SEQ ID NO: 56306 - DNA, 592 bp, Homo sapiens
  misc_feature: GYAE6OF02GN8T2.10.65.F10.1.454.CMB.1.raw
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (381)..(381): a, c, t, g, unknown or other
  misc_feature (381)..(381): n is a, c, g, or t
  modified_base (560)..(560): a, c, t, g, unknown or other
  misc_feature (560)..(560): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgctatttgtggagacagagtcaccatcctcgttgacccggaacaagtcaagaactattgactaccttatttgaattggtatacaaacaaaaacgtgggaaacncccctanactctagatcaatgcacgcgtacctagtttacagtagtcgggtccctagtaaggttcaggtcgacgagtgactcgtaggactaggtactttacnctaccactactcacgactactcgtgcacgtcctagtacgttagtttcgacgttacttactacgttcgtacctaacgtacggtaccgtttacccggtaacccgtttacgttaccgggacgggtaacggaccgtaagggtcgaacgactaacgaaccgtagtggtacggctcgactacctnttcgtctccttacacctttccgtacccactac

SEQ ID NO: 56307 - DNA, 611 bp, Homo sapiens
  misc_feature: GYAE6OF02F668N.10.65.F10.1.454.CMB.1.raw
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (369)..(369): a, c, t, g, unknown or other
  misc_feature (369)..(369): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgctatttgtggagacagagtcaccatctcttgtcggacaagtcagaacattgacactattgaattgtatacaaacaaaacgtgggaaacnccctaanactccagatacaatcgacacgcgtacctagtttaacaggtagtcgggtacccctagaagttcaagtgcgagtggactgtggaacagtactttacnctacaactatcagactatctcgacacgtctagtagttactttcgacgttacttaactacttgtaacaactaggtaccgtttacccgtaaacccgtttacggttaccgggaccggtaagggaacccgtaaaggtcggtaaacgtaacgtaccgaaaacgtacgttggtacggtacgtacgtactaaacccgtagttaccgttagttacccgttaacaccgttttacccctacccgtactaacc

SEQ ID NO: 56308 - DNA, 719 bp, Homo sapiens
  misc_feature: GYAE6OF02G9987.10.65.F10.1.454.CMB.1.raw
  modified_base (95)..(95): a, c, t, g, unknown or other
  misc_feature (95)..(95): n is a, c, g, or t
  modified_base (190)..(190): a, c, t, g, unknown or other
  misc_feature (190)..(190): n is a, c, g, or t
  modified_base (219)..(219): a, c, t, g, unknown or other
  misc_feature (219)..(219): n is a, c, g, or t
tcagcatagtagtgcacgaccggtgctcgatttagctacgctctaagggggagtcagtctcagtcaggacacagcatggacatgagggtccccgntcagctcctggggctcctgctactctggctccgaggtgccagatgtgacatccagatgacccagtctccaccgtccctgtctgctatttgtgganacagagtcaaccatcctcgttgccggaanaagtcaagaactattgaacctaccttatttgaatttggtaatacaaacaaaaacgtggggaaactcccctaagacctcctagactacaatgaccagcctacctagttacagtacggttcgggtcccctagtaacggttcaggtggactaggtcgattcgagggtaactacggtactttacaccgttacaacctagtacaggtctacgtcttacgactacgtaccgttaggtaacgttcgttttaccggaccgtttaaccgtttacgttaaccgttacgtaaccgtaaacgtaccgggtttaacccggtttaccccgggttaaaccccgttttaacgggttacccgggtaacgggggtaacccgggtaaccgtaaacgggttacggaacgttaaaccgtaacgtaaaccggttacgttgggttacgggtaccttcggaaccctaacgtacgttcgttacgtttaccgtccttaccgttccccgttacccggtacttacccg

SEQ ID NO: 56309 - DNA, 659 bp, Homo sapiens
  misc_feature: GYAE6OF02IJBHJ.10.65.F10.1.454.CMB.1.raw
  modified_base (188)..(188): a, c, t, g, unknown or other
  misc_feature (188)..(188): n is a, c, g, or t
  modified_base (212)..(212): a, c, t, g, unknown or other
  misc_feature (212)..(212): n is a, c, g, or t
tcagcatagtagtgcacgaccggtgctcgatttagctacgctctaagggggagtcagtctcagtcaggacacagcatggacatgagggtcccgctcagctcctgggctcctgctactctggctccgaggtgccagatgtgacatccagatgacccagtctccaccgtccctgtctgcatttgtagganacagacgtcacatctcttgccganaagtcagaacattgactactatttagattggtactacaaacaaaacgtagggaaactcccctacactcctgtactacagtacgcagtcgtacctagtttacacggacgtcgggtccctacgtaggttcaggtcggactaggtggactcggtacgggactaagtacctttaactcttaccgacctaagttacacggtaacgtactacgtcgtacgacgtcgtaggtaacgttagttttcgacgttaacttaccgtacgtagtaccaaacgtacgttaccggtttaccgtaacccgttttacggttccggaacgggtaccgggaacgtaacggtacggaaacgtacttaacgtaaacggactttacgggtaccggtcgtaccgaccgtaaccgttacgttccgttacggttccttaaccgtacccgtttaccctcccggtacttaaccg

SEQ ID NO: 56310 - DNA, 588 bp, Homo sapiens
  misc_feature: GYAE6OF02H6VYS.10.65.F10.1.454.CMB.1.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (377)..(377): a, c, t, g, unknown or other
  misc_feature (377)..(377): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (583)..(583): a, c, t, g, unknown or other
  misc_feature (583)..(583): n is a, c, g, or t
tcagcatagtagtgcacgaccggtgctcgatttagctacgctctaagggggagtcagtctcagtcaggacacagcatggacatgagggtccccgctcagctcctggggcctcctgctactctggctccgaggtgccagatgtgacatcccagatgacccagtcctccaccgtcccctgtctgctattttggttggagcagagtccaccatcctcttcgccggaanaagtcagaacattgaaccaccttatttgtaatttggtactacaaacaaaaactagggggaaacncccctanactcctagatacaattcgcagccgtacctaagttttacaggtcgtcggggttccctacgtaggttcaggtcggcaggttgntgtagggactagtactttactcgtctacatcgagcgtatcgngcacgccgtgactnttttcgcttacttactactgtaccaatcggtaacgtttcccggtaacccgtttacgttcgggacggtaacggacgaaggtggaacactacgaaacgacgttggtggactgacctacgtatcgtttacgtcttaccactttcctacccgtntaccg

SEQ ID NO: 56311 - DNA, 638 bp, Homo sapiens
  misc_feature: GYAE6OF02HNJG4.10.65.F10.1.454.CMB.1.raw
  modified_base (192)..(192): a, c, t, g, unknown or other
  misc_feature (192)..(192): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (401)..(401): a, c, t, g, unknown or other
  misc_feature (401)..(401): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtctccaccgtccctgtctgctatttggtgganacagagtcacatctcttgcggacaagtcagaaccatgacactattgattggatacaaacaaaactgggaaactcccanactctgatanaatgacagtcgtaccaagtttacgagtacggttcgggtccctacgtaaggttcagtcggagtaggtagtactcggtaggactaagtactttaacgtacctactaacatcgagcgtaatcgngtacacgtaccgtagtaccgttatttacggcgtaacgtttacctaacgtcgtaacctaacgtacgttaaccggttaccggttaaaccccgtttaggttaccggggaacgggtacgggaacctaagggtaacgggtacaaacgttaaccgaaacctaggttacgtacgggtacttaccgggaccaacgttaccgtgttcgttcccttaagttacccgttccgtccccgtaacgtacgg

SEQ ID NO: 56312 - DNA, 577 bp, Homo sapiens
  misc_feature: GYAE6OF02FWH9W.10.65.F10.1.454.CMB.1.raw
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (385)..(385): a, c, t, g, unknown or other
  misc_feature (385)..(385): n is a, c, g, or t
  modified_base (534)..(534): a, c, t, g, unknown or other
  misc_feature (534)..(534): n is a, c, g, or t
  modified_base (554)..(554): a, c, t, g, unknown or other
  misc_feature (554)..(554): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccaccgtccctgtctgctatttgtgganacagngtcaccatctctgccgacagcagacatgacactattgaattggtatcaaacaaaactgggtaaacncccctaacactcctagatcaaatcgacagtcgtaccagtttacaggtaggttcggggtcccctagaacggttcgaggtggcagtggtatcgtaggacagtacttactctcacatcagtcatcncgcgacgtcgtagacgttatttcgacttacttactacttcgtacaactacggtaccgtttacccggtaacccttacggtttccggacgggtaaggtaccgaagggtcgagtaactacgaacgtacgtcggtagtcgtagacctaccgtnttccgttagttccgtttacnccgtttaccttcccgacttaccg

SEQ ID NO: 56313 - DNA, 578 bp, Homo sapiens
  misc_feature: GYAE6OF02HQO55.10.65.F10.1.454.CMB.1.raw
  modified_base (212)..(212): a, c, t, g, unknown or other
  misc_feature (212)..(212): n is a, c, g, or t
  modified_base (269)..(269): a, c, t, g, unknown or other
  misc_feature (269)..(269): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatcgaccagtctccaccgtcctgtctgctatttgtggagacagagtcacatctctcgcgganaagtcagaacattgacacttattagattggtatacaaaacaaaaacgtgggaaaacncccctaacgactacctgatcaatgacagctacagttacacgagtcggtcccatagtcagtgcagngatgaggacagtacttacnctacacatcacgcgtaactcgtnacagtccngtacgtatttcgacgtactttacgactacgacaaatacgttaccgttacccgtacccgtttacgttccgggacgggtaacggtaacgaacgggttaggaactaacgtaaccaaagggtacttgggtacgtcgtccctaacgaacctacgttcgttacgttacttaccgtacgtccccgtttacccaccttacgg

SEQ ID NO: 56314 - DNA, 605 bp, Homo sapiens
  misc_feature: GYAE6OF02GYX4B.10.65.F10.1.454.CMB.1.raw
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (599)..(599): a, c, t, g, unknown or other
  misc_feature (599)..(599): n is a, c, g, or t
tcagcatagtagtgcacgaccggtgctcgatttagctacgctctaagggggagtcagtctcagtcaggacacagcatggacatgagggtccccgctcagctccgtggggctcctgctactctggctccgaggtgccagatgtgacatccagatgacccagtcctccaccgtccctgtctgctatttgtggagacagagtcacatctctgccganaagtcagacntnacactattgattgatacaaacaaaagtgggaaacncccctanactcctanactcaatcgacagccgtacctaagtttacaggtacggtccgggtacccctagtaaggttcaggtgacgtaggtcgatcgagggactagtactttacnctacacatcagtcatcngacncgtctagtacttatttcgacttaacttactacgtcgtaacaacttaggttacccgtttaccccgggaacccgttttccggtccgggaacgggtaacggtaaccgtaggttacgggaaataacgttaaccgaaaggttctcggtacggctacggaccaacccgttagttccgttagttcccttacgtacccgttcccgttacccgnttaccg

SEQ ID NO: 56315 - DNA, 657 bp, Homo sapiens
  misc_feature: GYAE6OF02IOC5K.10.65.F10.1.454.CMB.1.raw
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (270)..(270): a, c, t, g, unknown or other
  misc_feature (270)..(270): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtctccaccgtccctgtctgcatttgtgganacagngtcaccatctctgccggacaagtcagaacattcgacacttatttgaattggtatacaaacaaaacgtgggaaacnccctacactcctgatcaatcgcacgcctactaagtttacagacggttcgggtacccctacgtaaggttcagtggacaggtcggatcgtaggactacgtactttactcctaccaaccactcagctatctgcacgtccgtagacgtatttcgcgttaactttacgtacttacgtactaacgtaggtaaccggtttacccggtaaaccccgttttaccggttaccggggtacgggtaaccggggtaaccgtaacggggttacggaacgttaacgtaacctaaaccggttaaccgtggtaccgggtccgttaacggacccgtaaccgtacgtttaccgttcggtttacctttaccgtaaccgtttccccggtttacccccggaccttaccg

SEQ ID NO: 56316 - DNA, 665 bp, Homo sapiens
  misc_feature: GYAE6OF02GQ2W7.10.65.F10.1.454.CMB.1.raw
  modified_base (646)..(646): a, c, t, g, unknown or other
  misc_feature (646)..(646): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccggaggtgccagatgtgacatccagatcgacccagtctccaccgtccctgtctgctatttgtggagacagacgtcaccatctcttcgccggacagtcagaacattgactaccttattagaagttgtatacaaacaaaacgtgggaaacgcccctaacacctcctagactacatgacagccgtacctagtttacaggtacggtccgggtaccctagacggttcaggtgactaggtggtatcgtagggactaggtacttttacgctacaaccgtactacgtacgaccgtatccgtacgacgtaccgtccgttagtaaccggttagttttaccggacggtttaacctttacgttacgttacgtaaccctaacggtaccggttaaccggtttaaccccgggttaacccgttttacgggttaccgggaccgggaacggggtaaccggaagggttacgaacgtaaccgtaaccgtaaacggtacgttggacggtctacgtacccaagtacttcgtacttcttaccnctttccctacccgataccg

SEQ ID NO: 56317 - DNA, 679 bp, Homo sapiens
  misc_feature: GYAE6OF02JP8GU.10.65.F10.1.454.CMB.1.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
tcagcatagtagtgcacgaccggtgctcgatttagctacgctctaaggggggagtcagtctcagtcaggacacagcatggacatgagggtccccgctcagctcctggggctcctgctactctggctccgaggtgccagatgtgacatccagatcgacccagtcctccacccgtccctgtctagctatttgtaggagacagatcaccatctcgtgaccgganaagtcaagtaactnttcgaacctacttatttacgaattggtaactactaaacgaaaaacgtagggggaaacctcccctaacgactccgtagtactacaagtcgacaggtccgtacctaagttacagtacggttcggtccctagtaacggttcgagtggcgtaggtcgatcgtagggactacgttaactttcgactacaccagttacgacgtacgtactacgtcacacgtctaggtacgttattacgaccgtaacttacgtactagtacaacgtagttaccggttacccgtacccgtttacggttacgggaccggtaacggtaccgtaaggtacggaacgtaacgtaaccgtaaacggtccgttagggtacccgtaggtaaccgtaccgtaaccggttacgttccggtttaccgttaccttaccggttaacccgtccccgtttacccgtaccgttaccg

SEQ ID NO: 56318 - DNA, 775 bp, Homo sapiens
  misc_feature: GYAE6OF02JNV8B.10.65.F10.1.454.CMB.1.raw
  modified_base (178)..(178): a, c, t, g, unknown or other
  misc_feature (178)..(178): n is a, c, g, or t
  modified_base (190)..(190): a, c, t, g, unknown or other
  misc_feature (190)..(190): n is a, c, g, or t
  modified_base (726)..(726): a, c, t, g, unknown or other
  misc_feature (726)..(726): n is a, c, g, or t
tcagcatagtagtgcacgaccggtgctcgatttagctacgctctaagggggagtcgagtctcagtcaggacacagcatggacatgagggtccccgctcagctcctgggctcctgctactctggctccgaggtgccagatgtgacatccagatgacccagtcctccaccgtccctgtcngcatttgtgganacagagtcacatctctcgccggaacagtcagaactagttcgaccaccttatttagaatttaggtacttacaaaacaaaaacggtaacggggaaacgacccctactaaccgtcctacgtaatacaatacggacagaccggttacctaacgttttacgaaggtaacgggttccggggtacccccttacggttaaacggttcgaaggttcgggtacgtaggtttagggaccgttaggttacggggaacgtaggttaaccttttaaccttccgttaccctaaacccttacgggttaaccaacgggtacctaaccgttcgtaaccggtccgtaaccggtccgttaccggtaacgtttacgttttccggtaccgtttaaaccttaccgtttacgttaaccgtactaaccgtacgttaaccgggtttaccccggttaaaccccggttttaccgtttaccgggaacggggtaccgggtaaaccggtacggtaggtaacgtaacgtaaccggaaacgttacggtacggtcggtccgtaggtaccnccgaacgttcttacggtcctttacgtaccttcccttacccgttccaacg

SEQ ID NO: 56319 - DNA, 648 bp, Homo sapiens
  misc_feature: GYAE6OF02GJ5HG.10.65.F10.1.454.CMB.1.raw
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
tcagcatagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtcctgtctgctatttgtggagacagagtcacatctctgccggacagtcagaactatgacactattgaattggtatacaaacaaaactggggaaacnccctanacctctgatcaatgacagccgtactaagtttacagtacggttcgggtcccctagaacggttcgaggtcggacaggtaggacttacggtagggaactaggttaaccttttactccttaccctaacctattcgaacggtaccgaagttccttaggcctagtcccgtaggtaccggttaattttaccggaccgtttaactttaaccgttaacgtcgttaacctaacgtaggttaaccggttttaccccggtaacccgttttacgttccggggacggacggtaacgaagggttggaacgtataacggaacgtacgttcggtacggctcgaccgacctagttcttacggttccttacgtaccttccggttacccctagtaccg

SEQ ID NO: 56320 - DNA, 600 bp, Homo sapiens
  misc_feature: GYAE6OF01BH6T2.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaagacttctggatacaccttcaccggctactatatgcacgtgggtgcgacaggccctggacaagggcttgagtggagtgggatggaactcgaaaccctaagaggtggtacggacaacaaactagtacgacaagaagtaacgttttcgacgggtacgagggtaccaaccgaagtacggaaccgaagggaaccacgtaccactcagacacgacgtactaccgaagtcggagtccgtaggaacgtaccgaggtcctaggagtaacgtcgtacggaaccggaaccgtaccgggtacggttacggttacgttaccgtggtacggtacggtaagggacgggttacgggttaagtttaggttaacggg

SEQ ID NO: 56321 - DNA, 662 bp, Homo sapiens
  misc_feature: GYAE6OF01C58SL.36.84.H07.1.454.CMB.1.raw
  modified_base (251)..(251): a, c, t, g, unknown or other
  misc_feature (251)..(251): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagccgtggggcctcgaggtgaaggtctcctgcaagtacttcnggactacaccttcaccggctactatatgcacgtggtgcgacgacggccctaggaaccgaagggtcttaggagtggagtgggagtggtactaccaaacccgttaacgaggttgggtacggaaccaacgtaaaactacgtacgacgaaactaaggtaacgtttcggaacggggtacgaacggggttacccaaccgtacgtacggaaccgtaacgggaacctaaccggtacccaagttaccgagtacccgaacgtacgtaccgtaaccgagtacgggacgtccgtaggacggcgaacgggtactaggaacgtacgtacgtacggaaccggaccggtaccgggtaccgttaggttaacgttaccgtaggtacggtacggaacgggtaggggtcggtttaagttaggtttaacggg

SEQ ID NO: 56322 - DNA, 553 bp, Homo sapiens
  misc_feature: GYAE6OF01A47I3.36.84.H07.1.454.CMB.1.raw
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaagacttctggatacaccttcaccggctactatatgctacgtgggtgcgacgacggccctagggacaagggcttggagtggatgggatggatccaaacctaagaggtggnggacaacaaactngacaanagtaagtttcgagggcgacggtcacagtagacgagggacacgtcatcagcacgacgtcacagtcggatcgtagacgacgaggctaggacgagttccgtagacccgaacggaccggtccggtagttaacgtttacgtaggtacggtacggagggtaggggtacgggttagttaggtttaacggg

SEQ ID NO: 56323 - DNA, 796 bp, Homo sapiens
  misc_feature: GYAE6OF01BV28Z.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccatgtgcagctggtgcagtctggggctgaggtgaagagccgtggggcctgagtgaaggtctcctgcaagacttctggatacaccttcaccggctactatatgcacgtgggtcgcgtacgacggcccgtggaacaaggggtcttaggagtggagtgggagtggataccgaaacccgtaagaggtgggtgaccaactaaaactagtcggacaacgaaggtaacggtttacgaacggggtaccgacggggttaccaccgtaagtacggaacccggaacgggggtaacccgtaaccggttaccccgtaaacgtacccgaacggtaccctaaacgtaccggttaaccctaaccgtaacggttacgggggaacggttaccggttaacgggaacggtacccggtaacggggtacccgttaaggggtaaaccggtaacgtttaacccgggtaccgggtaaaacccgggtaacccgggtaaaccccggggggttaccccgggttttaagggtttaaaacccggttttaacccgggtttacgggggtttaacccggggtaacccgggggttaaaaccgggggtaaaccggggggttttaacccggggggttttaaagtttttaaaaccgggggg

SEQ ID NO: 56324 - DNA, 625 bp, Homo sapiens
  misc_feature: GYAE6OF01EK3PK.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctcagtgaaggtctcctgcaagacttctggatacaccttcaccggtctactatatgctacgtggggtcgcgacgacggcccgtaggaacgaagggtcttaggaggtggagtgggatgggaactaccaaacccgtagaggtggtacggacaacgtaaactgtacgaccaacgtaagtaacggtttcgaacggggtacgacggggtaccaaccgtagtacggaacccgaagggtacctaaccggtaccaagtaccgaacgaccaaccgtaacgttaccgtaacgtagtagggaacgcgtaggagacgaggcgtacggagtacgtacgtacgaaccgacggtaccgggtccgttaggttacgttacgtggtacgtacggagggtagggtacgggtttaattggttacggg

SEQ ID NO: 56325 - DNA, 546 bp, Homo sapiens
  misc_feature: GYAE6OF01ERVZS.36.84.H07.1.454.CMB.1.raw
  modified_base (287)..(287): a, c, t, g, unknown or other
  misc_feature (287)..(287): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaagacttctggatacaccttcaccggctactatatgcacgtggggtncgacgacggccctggaccgaagggcttggagtggagtggggatggactaccaaacctaacgaggtggtggacaacgtaaacttagtgacacgaaggtaagtttcgagggtcgagggtacacgagtcgaaccgagggacacgtccatcagcacagtctacagtggagctaggacgcgaggcgtagagatcgacgtacgaccggacggtccgttaggtacttacgtgtacggacggaggagggtacggttagttgtacggg

SEQ ID NO: 56326 - DNA, 645 bp, Homo sapiens
  misc_feature: GYAE6OF01BT4R2.36.84.H07.1.454.CMB.1.raw
  modified_base (296)..(296): a, c, t, g, unknown or other
  misc_feature (296)..(296): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcgagtcgtggggctggaggtgaagaagccgtggggcctcgagtgaaggtctccgtgacaaggtacttcgtggatacaccttcgaccggcttactatatgcacgtgggtncgacaggcctggacaagggtcttgagtggagtgggatggataccgaacctaacgaggtggtacggacaacaaacgtataggcaactaggtaagtttcgaacgggtacgtaggggtaccaaccgaagttacggaaccgtaacggggtaaccaaccggtaccaacgttaccgaacggtaccaaccgtaacggttactaaaccgtaaggttacgggaacgtccgtaggacgaacggtagggaccgttaggaaggtaccttacgtacggaaccggaaccggtaccggtaccggttagtaacgtttacgtggacggtacggaaggtacggggtacgggttagttaggttaacgg

SEQ ID NO: 56327 - DNA, 688 bp, Homo sapiens
  misc_feature: GYAE6OF01BL3QS.36.84.H07.1.454.CMB.1.raw
  modified_base (290)..(290): a, c, t, g, unknown or other
  misc_feature (290)..(290): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctgaaggatcctcttcttggtggcagcagccacaggagacccactcccaggtgcagctggtgcagtcgtggggctgaggtgaagagcctggggcctcagtgaaggtctcctgcaagacttctggatacaccttcaccggctactatatgcacgtgggtgcgacncggcctggacgaagggctgagtggatggggatagggactaccaaacccgtaacgtaggttggtacggacaaccgtaaaactagtcgaactaaccgtaaggttaacggttttacgaaggggtaccgaacggggttaccaaccgtaacgtacggaacccgtaaaggggaaccctaaccggtacctaactccgaagtacccaaccgtaaggttacctaacgtacgtagggacgtaccggttacggaaggtccaaacgggcgttaggaacgtaacgttccgtacggaaccgtaaccggtacggggttccccgttaagggtttaaaccttacggttacggttaccgggaacgggttaacgggaacgggggtttacggggtttaactttaagggttaacccggg

SEQ ID NO: 56328 - DNA, 561 bp, Homo sapiens
  misc_feature: GYAE6OF01D1VYS.36.84.H07.1.454.CMB.1.raw
  modified_base (253)..(253): a, c, t, g, unknown or other
  misc_feature (253)..(253): n is a, c, g, or t
  modified_base (549)..(561): a, c, t, g, unknown or other
  misc_feature (549)..(561): n is a, c, g, or t
tcagtacgctgtctcacgaccggtgctcgatttagcagacgtctgtcgcgggagagcatcacccagcaaccacatctgtcctctagagaatcccctgagagctcccgttcctcaccatggactggacctggaggatcctcttcttggtggcagcagccacaggagcccactcccaggtgcagctggtgcagtcgtggggctggaggtagaagaacgccgtggggcctcgagtgaaggtctctgcaagtcttgnggactacaccttcaccggctactatatgcgtacgtggggtcgccgaacgcgggcccgtagggaacgtaagggtcttaggaggtgggagtgggatcggtaactacgaaacccgtagaggtggtacggacaactaaacgtgtcgacgaactaaggtaagttcggaacgggcgtacgggtacaccgtagtacgaaccggaacgggaactaccgtaccactacgacgacaactacgtacactagtacgggactcgtcgggtacggcgggtacgtacggacggaacggtccgagagtacgnnnnnnnnnnnnn

SEQ ID NO: 56329 - DNA, 635 bp, Homo sapiens
  misc_feature: GYAE6OF01E2P5S.36.84.H07.1.454.CMB.1.raw
  modified_base (253)..(253): a, c, t, g, unknown or other
  misc_feature (253)..(253): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacgaggacgcccactcccgaggtgcagctggtgcgagtcgtgggctggaggtagaagagccgtgggcctgagtgaggtctcgtgacaagtcttcgnggactacctaccgttcgaccgtcttaactatatgcctacgtggggtcgaccggacgacggtcccgtaggacgtaagggtcttaggaggtaggagtgggtatggaactaccgaaaccgtagaggtggtacgacaactaatagtacgacaacgtagttaacgttacggacggtacgtacggtccaacgtacgtacgaaccgaggaacctacgtaccatacgacgacctagtacgtactaacgaggtggaacgcgtaggaacgcggacggtacgtaggacgtacgtcgtacggaacccgtaccggaccgggttaccgttaggttaacgttacggtcggtaggacgggtaagggtagggttagggtttaagttagggtttaacggg

SEQ ID NO: 56330 - DNA, 656 bp, Homo sapiens
  misc_feature: GYAE6OF01AR50H.36.84.H07.1.454.CMB.1.raw
  modified_base (379)..(379): a, c, t, g, unknown or other
  misc_feature (379)..(379): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggcggcagcagccacaggacgcccactcccaggtgcagctggtgcagtcgtggggctggaggtgaagaacgccgtggggcctcgagtggaacggtcctcctgcaagaccttctggactacaccttcgaccggctactatagtgaccacgtggggtcgaccgaccgacgggccccgttaggaccgaaggggtcttggacgtggagtgggatggactacgaaaccctagaggttggnggactaacaaactagtcgactaacgaaggtaacgtttcggaacgggtacgacgggtaccgaaccgacggtacgaacccggaacggacccgtaaccgtccctaacgtacgaaccggaccaaccgtacggttacctaacgtagtacgggaacgtcgtacggagacgtaggtaccgagtacgtatacgtacgaccgaaccggtccggtaccggttacggttcttaaccggttggtacgaccgggtaaggtacggggttacggttagttaacggttacggg

SEQ ID NO: 56331 - DNA, 619 bp, Homo sapiens
  misc_feature: GYAE6OF01EB8QE.36.84.H07.1.454.CMB.1.raw
  modified_base (377)..(377): a, c, t, g, unknown or other
  misc_feature (377)..(377): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctcagtgaaggtctccgtgcaagtacttctggatacaccttcgaccggtctactatatcgctacgtgggtgcgaccgaggcccctaggacgaagggtcttggagtggagtggatggaactaccgaaaccctaagaggtggtacggactaaacgaaactntcgacaacgtaaggtaagtttcgaacgggtcgacgggtaccaacgagtacgaaccgaacgggaacctaaccgtaccaacgtacgacgacacaagtcctaacgagtacggacgtcgtgacggtacgaggtccgtagacgtatcgtacgaaccggaaccggtacgggtaccgttaggttaacgttaccggttaggtacggtcgggtaaaggacggggttaacgggttaagttacggttaagggg

SEQ ID NO: 56332 - DNA, 807 bp, Homo sapiens
  misc_feature: GYAE6OF01B97A6.36.84.H07.1.454.CMB.1.raw
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (780)..(780): a, c, t, g, unknown or other
  misc_feature (780)..(780): n is a, c, g, or t
  modified_base (788)..(788): a, c, t, g, unknown or other
  misc_feature (788)..(788): n is a, c, g, or t
  modified_base (790)..(790): a, c, t, g, unknown or other
  misc_feature (790)..(790): n is a, c, g, or t
  modified_base (796)..(796): a, c, t, g, unknown or other
  misc_feature (796)..(796): n is a, c, g, or t
  modified_base (798)..(798): a, c, t, g, unknown or other
  misc_feature (798)..(798): n is a, c, g, or t
  modified_base (800)..(800): a, c, t, g, unknown or other
  misc_feature (800)..(800): n is a, c, g, or t
  modified_base (802)..(802): a, c, t, g, unknown or other
  misc_feature (802)..(802): n is a, c, g, or t
  modified_base (804)..(804): a, c, t, g, unknown or other
  misc_feature (804)..(804): n is a, c, g, or t
  modified_base (806)..(806): a, c, t, g, unknown or other
  misc_feature (806)..(806): n is a, c, g, or t
tcagtacgctgtctcacgaccggtgctcgatttagcagacgtctgtcgcgggagagcatcacccagcaaccacatctgtcctctagagaactccctgagagctccgttcctcaccatggactggacctggagactcctcttcgtggtggcagcagccacgaggacgcccacgtcccaggtcgcagcgtggtgcgagtcggngggctggaggtagaacggaacggccgtggggcctcggaagtacggacggttcctcgngtacgaaacgtcttacgaggtacttaaccgtaccgtttaccgaccggtactaaccgttatacgtcggtaccgtaacggtttcgggttacggtaccggtaaccggaccgggtaccccgttacggggaaaccggtaacggggtttaccgttaacgggtagggtttaacggggaacggggttagggggtaacgttaaccgggggtaaacctaaaccccgttaaaaacccgggtttaaacgggttaggggttaccgggggttaacggaaacctaaaaccgttaaaaacggtacgtaccggtaaacggtaaaccggttaaaacgggtttaacggtttacgggaacgggttaacggtaaccggttaccgtaaaccgtacggtaaacgggtaaccgggaacggaaaccccgtacgttaccgacgtacgaacggtaacctacggttaacgttacaaccggttagcgggtaactccgggtaagggtacccggtggcgggtaacggcggaaacggtccgtaaggtacgaggngcgagagngngagagnananangngng

SEQ ID NO: 56333 - DNA, 834 bp, Homo sapiens
  misc_feature: GYAE6OF01AUWVB.36.84.H07.1.454.CMB.1.raw
tcagtacgctgtctcacgaccggtgctcgatttagcagacgtctgtcgcgggagagcatcacccagcaaccacatctgtcctctagagaatcccctgagagctcccgttcctcaccatggactggacctggaggatcccttcttcgttggtggcagcagcccacaggacgccccactcccaggtgcagcgtggtgcgagtcgtggggctggaggtagaagaagccgtggggcctcgaggtggaaggtcctccgtgacaagtaccttcgtaggactaacctaccctttccgaacccgggtcttaactattagtcgtacctacggttcggggtgccggtaaccgacgggccccctaggggaaccgaaagggggtccttttagggagggttgggtaagggtgggggtaacgttacggggaaaccttaaccccgtaaaaaccccgttaaaccgtaaggggttacggggtttacgggaaccctaaaccgtaaaaaccgttacgtaccgaacctaaaccggtaaagggttaaacggtttttaccgggaaggggtaccggtaaccggggttacccgaacccgtaacgttaaccgggaacccggaacggggaacccgtaacccggtccctaacgttacccgacgtacccgaacctaacggttacctaaccgtaaggtacggacggtacgtgggacgtaccgggtaacggtaccgtaggtaacgtacgtccggtaacggaacccggacccgggtaaccgggtcccggtttacggttaacgtttacggtcgggtagggaccgggtagggtaacggggttacgggtttaagtttaggttaacggg

SEQ ID NO: 56334 - DNA, 723 bp, Homo sapiens
  misc_feature: GYAE6OF01D4L7S.36.84.H07.1.454.CMB.1.raw
  modified_base (382)..(382): a, c, t, g, unknown or other
  misc_feature (382)..(382): n is a, c, g, or t
tcagtacgctgtctcacgaccggtgctcgatttagcagacgtctgtcgcgggagagcatcacccagcaaccacatctgtcctctagagaactcccctgagagcctcccgttccctcaccatggactggacctggaggatcctcttcttggtgcagcagccacgaggacgcccactcccaggtgcagctggtgcgagtcgtggggctggaggtagaagagccgtgggcctcgagtgacggtctccgtgacaagtcttcgtaggactacctacccttacgaccggtactactatacgtgctagtgggtcgacgacgcggtcccgaggaaccgagggtcttaggaggtgggagtggggatcggactacccgtaaaccgtaacggnggttagggacggaaccaaacgtaaacttcgtacgaccgtaaaccgtaaggttaagggtttaccgacgggtaacggtacggggtaacctaaccgtaagtacccgggtaaccggtaacggggtaacccgtaaccggtaccctaacggtacccgtaacgtacccgaaccgttacgtaaccgtaaccgttagtaacgggtacgtcggtaacggacggacggtacggacgtaggaacgtacgttacgtaccggaacccggtaccggtaccgggttccggtttagttacgttacgggttgtaccggcgggtaacgggtacgggttcgggttaagttaggtttacggg

SEQ ID NO: 56335 - DNA, 809 bp, Homo sapiens
  misc_feature: GYAE6OF01EG3G0.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtgcagcagccaacgaggacgcccactcccgaggtcgcgagcgtggtcgcgtacggttcggtcggggcttaggagggtagaaaggaacggtccggtcgggggaccctacgaggtaggaacgggttccttccgtaggacctaaaggttacctttacggtacggtaacttaacccgtacccgtttaccgaacccggtactttaacgttagtacgtcggtaccgtaacggttggggttccggaccggtaaccgtacgggaccccgtagggaaccggtaaggggttcgttagggaggtagggtacggtagggactacggtaactaacccgtaaaacccgtaaggtagggttcgggtacggtaacctaaacgtaaacgttacgcgtaaaccgtaaagtaacgggttaacggtttacgggaacgggtaccggtaaccggggttaaccaaccggtaaggttacccggaaacccgggaacgggtaaccgtacccgtacgtacgtaccgacgacctaaccgtacgtaaccgtagtacggtaggacgtacgtaggacggacgaggtcgtacggacgtagttaccgtacggtaaccggacggtaccggtacgttacgttactacggttaggacggtacgggaagggtagggttaacggtttagttggttaacggg

SEQ ID NO: 56336 - DNA, 703 bp, Homo sapiens
  misc_feature: GYAE6OF01CLSSZ.36.84.H07.1.454.CMB.1.raw
  modified_base (238)..(238): a, c, t, g, unknown or other
  misc_feature (238)..(238): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggacgcccactcccgaggtgcagcgtggtgcagtcgtgggctggaggtgaagacgcgtggggcctgagtgacgtctcngactagcttcgtgtactacctaccttccgaccggtcttaactatacgtgccgtacggtggtacgccgaaccgtacggtacccggtagggaacgtaacggggtcttagggacggtagggacgttaggggacttacgggacttaaccgtaaacccgtaagtacggggttacgggtaccggtaaaccgtaaacgtaaaccgttaggttaccgaaccgtaacggtaaacggttaacgtttaccgggacgggtacgtaacggggttaccctaaccggacgtacccggtaacggaaccgggaacccttaccggtaccacgtacaccgtacgacgtaacgtacgtacgaggtagacggtcgtacgcgaacgtaggtacgtaggactacgtacgacggtacgaccggacgttacgttacgtcgttacggtaggcggtacgggacgggttagggtacggttgttaggttaacgg

SEQ ID NO: 56337 - DNA, 781 bp, Homo sapiens
  misc_feature: GYAE6OF01B7EIT.36.84.H07.1.454.CMB.1.raw
  modified_base (316)..(316): a, c, t, g, unknown or other
  misc_feature (316)..(316): n is a, c, g, or t
  modified_base (391)..(391): a, c, t, g, unknown or other
  misc_feature (391)..(391): n is a, c, g, or t
tcagtacgctgtctcacgaccggtgctcgatttagcagacgtctgtcgcgggagagcatcacccagcaaccacatctgtcctctagagaactcccctgagagctccgttcctcaccatggactggacctggaggtactccgttcttcgttgggtcggacaggcacgccaacgaggacgcccaacgtcccgaggtcgcagcgtggtgcgagtcgtgggctggaggtagaacggaacgtccgtggggcctagaggtcggaacggtcctcgtggactaaagtcgtttcgaggtaactaccgtaccgttaccgaccggtnttaactattagtcggaccgttacgtggggtacgtaccgaacgacggacccaaggaacgggaacgtaaccgggttnttagggacggtagggtagtaggggtacgtcgggttaaacgtaaccgtttaggtaggggttacgtaacgaaccgtaacgtagtagttaacgcgtaaacacgtaggttaacggttaccggaggacgtaaacgtaacgtacgtaactaacgtaaccggaaacgtaaacgaacggtaactaccgtaaacctaaactaaacgtaaccgttaacgttaaaccgtacgtaaagtaaccgaacgtaaccgttcggtaacgtaccgaacgtcccggaacggtaaccggtaaccgacccggttaaacgttacgtaacgtttacgtacggtaacggacggtaacgtaaccggtaacgtttacggtttaaggttttaacggacggttagggttaaaacccgg

SEQ ID NO: 56338 - DNA, 714 bp, Homo sapiens
  misc_feature: GYAE6OF01A6JXP.36.84.H07.1.454.CMB.1.raw
tcagtacgctgtctcacgaccggtgctcgatttagcagacgtctgtcgcgggagagcatcacccagcaaccacatctgtcctctagagaatcccctgagagctcccgttcctcaccatggactggacctggaggatcctctttcttggtggcagcagccacaggacgcccactcccaggtgcgagcgtggtgcagtcgtgggctgaggtagaagagtcgtgggctcagtgacgtctcctgcaagtcttcgtggactaccaccttcgaccggtctaactactagtcgacgtacgtaggggtcaccggaaccgcgggaccccgttaggggaaccgtaacggggtcctttagggaaggttagggaacggttagggggacgtaggggtaacctaacccgtaaaaccggtaaagtacggttacgggtaccggaaccaaaaccgtaaaacgtttacgacgtaaccgtaacggtaaacggttaacgggttttacgggaacggggtacggtaaccggggttaccaacggtaactaccggaaccggaacgggtaaccctaaccgtaccgacgtacacgtacaacgtacgtacagtacgcggtaacgtcgaggtacgaggacgtcgtaggacgtattccggagtaacccggacgtacggttaccgttacggtagttacgtcggtgtaacgggacggtaagggtaccggttaagtacgttacggg

SEQ ID NO: 56339 - DNA, 766 bp, Homo sapiens
  misc_feature: GYAE6OF01DPVQL.36.84.H07.1.454.CMB.1.raw
  modified_base (149)..(149): a, c, t, g, unknown or other
  misc_feature (149)..(149): n is a, c, g, or t
  modified_base (673)..(673): a, c, t, g, unknown or other
  misc_feature (673)..(673): n is a, c, g, or t
tcagtacgctgtctcacgaccggtgctcgatttagcagacgtctgtcgcgggagagcatcacccagcaaccacatctgtcctctagagaactccctgagagctccgttcctcacatggactggacctggagactcctcttcttggtggnagcacgccacgaggacgcccactcccgaggtcgcgacgccgttggcgcgtaggtcggtggggacttggagggtaagaaaggacggccggtggggaccttcgagtacggtaacggtcctccgtaggactaaaggttaccttcgtacgggtaactaccgtacccgtttaccgaaccgggtactttaaaccgtaattaacgtcggtaccttacgggttcgggttacggacccggaaccggtcccgggtaccccggttagggaaccggtaaggggttccgtttagggaggtacgggtagtagggtacgtacggggactaacccggtaaacttaacggacgggtcgggtacggaaacctaaaccaaacgtttgaccgtaacaaacggtacggttaacggttttacggacgggtacggtacggttaaccgactaacggtacgaacggacggtaacgtacccgtaacgactacgacgaccactacgtctaacgtggaacgcgacggtacgtgacgcggttacgagtaacgngttacgacggtacggaccggtacggttaccgtgtttaccgtacggtggtacggacggtaacgggtacgggttacgtaaggttgttaaacgggg

SEQ ID NO: 56340 - DNA, 670 bp, Homo sapiens
  misc_feature: GYAE6OF01A7TDY.36.84.H07.1.454.CMB.1.raw
  modified_base (168)..(168): a, c, t, g, unknown or other
  misc_feature (168)..(168): n is a, c, g, or t
  modified_base (191)..(191): a, c, t, g, unknown or other
  misc_feature (191)..(191): n is a, c, g, or t
  modified_base (534)..(534): a, c, t, g, unknown or other
  misc_feature (534)..(534): n is a, c, g, or t
tcagtacgctgtctcacgaccggtgctcgatttagcagacgtctgtcgcgggagagcatcacccagcaaccacatctgtcctctagagaatcccctgagagcttccgttcctcaccatggactggacctggaggatcctcttcgttggtggcaggcagccacaggacncccactcccaggtgcagctggtncagtcgtgggctggagtgaagacgccgtgggcctgagtgaaggtcctccgtgacaagtacttcgtggactacctaccctttccgaaccggtcttaactatatcgtaccacggttgggtacgccgtacgtacgggtcccgtaggaaccgtagggtctggaggtggagtcgggatcggactaccaaacccgtagaggtcggtaggacctaaataactacgtcgaaactaggtaacgttaacggtttacgacggggtcgtaacggtccaaccgtacgtacggaaccggaacgggtaccgtaaccggcccgtaataccggacgtacccgaacgtaccgtacgtaacncgggtacgggaactcggcggtaacgtccggaggttacgaggacgtctaccggaccgacgacccgtacgggtccgttacgttacgttaccgttggaccggtaggtaacggtagggtaacggtttagtggttaacggg

SEQ ID NO: 56341 - DNA, 748 bp, Homo sapiens
  misc_feature: GYAE6OF01CRHMI.36.84.H07.1.454.CMB.1.raw
  modified_base (694)..(694): a, c, t, g, unknown or other
  misc_feature (694)..(694): n is a, c, g, or t
tcagtacgctgtctcacgaccggtgctcgatttagcagacgtctgtcgcgggagagcatcacccagcaaccacatctgtcctctagagaactcccctgagacgcttccgttcctcaccagtggactggacctggaggactcctcttcgttggtggcagcagccacgaggacgcccacgtcccgaggtcgcacgcgtgggtgcgtaggtccggtgggctaggaggtagaagacggtcggtcggggacctagtaggtacggtaacggtcctacgtagacgaaacggttccgtttacgaggtaccttaaccgtaccgtttccggaaccggtacttaacctaagttacgtcggtacctacgggttcggcgaccgtaccggaccggtacccgtaggaacgttacgggtcgttaggacggttagggacgttgggattacggaacttacccgaaaccgttaggtggttacgggaaccgacgtaaaacgtaacttggaccgaagtaaccgttaaaggttacggttacgacggggtacgttaaccgggaccacgtacggaccggtaaccggacggtaacctacgacgacgtacgacacgaacgtcgtagacgtaggtccgagtcggtagacgacggtagaccgaggtacctaggtcccgaaagggccctaacggggtgttacccggttattaacgggttccgnggtaccggtaagggaacggttaccgggtaagtttaacgggtgtttaaaccgggg

SEQ ID NO: 56342 - DNA, 744 bp, Homo sapiens
  misc_feature: GYAE6OF01A260V.36.84.H07.1.454.CMB.1.raw
tcagtacgctgtctcacgaccggtgctcgatttagcagacgtctgtcgcgggagagcatcacccagcaaccacatctgtcctctagagaactcccctgagagctcccgttcctcaccatggactggacctggaggatcctcttcgttggtggcagcagccacgaggacgccccactcccgaggtgcagtcgtgggtgcgtagtcgtggggctggaggtagaagacgccgtggggcctagaggtgaacggtcctacgtgacgaagtcttcgagactaccaccttcgacgtctaactatagtcgactaggtcgggtacgacggaccgtacgggtccgtaggaacgtaggtcgttaggaggtagggtaagtgggtactacggtaactacccggtaaaaccgtaaggtagggtacgggtaccggaactaaacaacgttagtacgaacgtaaagtaacggttaaacgttcggggaacggtacggtaaccggtaccgaaacgttaaggtaccccggaaaccggtaacgggtaaccctaacggtctaacgtcgaaccgtacccgaagtactaccgtaacgaggtcggaagtaccggtaggaacgttccggaaggtacttacggaagtccgttaccggtaaacgaacccggggttcggaacccgggttactttaaagggttaccttacgggtacggttcggaaccgggtaagggttacgggtttaaggtttaacgttgggtttaaacccggg

SEQ ID NO: 56343 - DNA, 783 bp, Homo sapiens
  misc_feature: GYAE6OF01AVSMQ.36.84.H07.1.454.CMB.1.raw
tcagtacgctgtctcacgaccggtgctcgatttagcagacgtctgtcgcgggagagcatcacccagcaaccacatctgtcctctagagaactcccctgagagctccgttcctccaccatggactggacctggaggactccttcttcttggtggcagcacgccacgaggacgcccacctcccgaggtgcagcgtggtgcgagtggtgggctggaggtaggaagacgcgtcgggcctcgagtagaggtctccgtgaccgtaagtaccttcgtacggtactaccgtaccgttccgaccggtcttactatacgtcgtacgcgttcggggcgtaccggaaccgtcggtccccggaggtaacggaggggttccttaggggaggtgggtaaggtaggggtacggttacgggaacctaacccggttaaaacccctaaaggggtacggttacggggtagggaaaccctaaacgttaaaacgttacggtagaccgaaacggttaaacgggttaaacggttttcccggacgggggttaacctaacccgggggttaacccaaaccggttaacgttaaccggggaaccccggttaacggggaacccttaaccggttaacccggaccttaccggaaccggtacccaacgggttaacgtacccgtaaaggtacgtacgggacgtaccggagtaccggcgtacggtgtacgttaacggctacggtaccggagtacccggcggtacggttatccgtacgtagggcgacggtacggtagggtcggttttagtaggttacgg

SEQ ID NO: 56344 - DNA, 726 bp, Homo sapiens
  misc_feature: GYAE6OF01ESWJN.36.84.H07.1.454.CMB.1.raw
  modified_base (291)..(291): a, c, t, g, unknown or other
  misc_feature (291)..(291): n is a, c, g, or t
  modified_base (349)..(349): a, c, t, g, unknown or other
  misc_feature (349)..(349): n is a, c, g, or t
  modified_base (598)..(598): a, c, t, g, unknown or other
  misc_feature (598)..(598): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagcccacaggacgcccactcccgaggtcgcagctgggtcgcgtaggtcgtgggcttggaggtgaagacgccgtgggcctgagtgacggtctccgtgacagtcttcgtaggactactccgttcaccggtcttactagtntcgtcgacgtggggtacaccggacgtacggtcccgtagggaccgaagggtcttaaggnggtagtaggagggtacgtaggtaacctaacccgaaaccgttaagggtacggtacgggtacgtaaccgtaaacgtaaaccgttagtaaccggacgtaacgtaaggtttaaccggtttaggaacgggtaccggtaacgggttaccaaccggtaggtaaccggtaacccggtaaggggtaccctaaccggttacgaaccgttacgaaccgtaccgaaaccgtttggtaaccccgtagtaggtaaccgggtanaccggttagaccgtagacgggtacacgtaggtaaccttacggaaccgtcggaaccggtcggttcccgtaagtttacgtaccggtggaccgacgggtacggagggtttaccggttatgggttaaacggg

SEQ ID NO: 56345 - DNA, 938 bp, Homo sapiens
  misc_feature: GYAE6OF01AWXHB.36.84.H07.1.454.CMB.1.raw
  modified_base (135)..(135): a, c, t, g, unknown or other
  misc_feature (135)..(135): n is a, c, g, or t
tcagtacgctgtctcacgaccggtgctcgatttagcagacgtctgtcgcggggagagcatcacccagcaaccacatctgtcctctagagaatcccctgagagctccgttcctcaccatggactggacctggaggntcctcttcttggtggcagcagccacgaggacgcccactccccaggtgcagcgtggtcgcaggtccgtggggactggtacggtagaaggacgccggtcggggcctcgaggtggaacggttcctccgtgaccgaaagtacctttcgtagggaccttaacccgtacccgtttaccggaacccggtccttaaaccgttacgttaactcgtacccgtaacgggtttcggggtacgacccggtaaccggtaccggggtaccccgttaaggggaaccggtaaacgggggttccgttttaggggaaacgggtttgggggaacggtttaccggggggtacgttacgggggtaaccttaaccccgtaaaaacccccgggttaaacggtacggggttacggggttaacgggaacccttaaaacggtaaaacctttgtaccgggtaaccctaaaccggttaaacgggttaacgggtttttaccggggaaccggggtaccggtaaaccgggggtttaccccgtaaaccgtacggggttaacccgggaaacccggtaacgggggaaaccccgttaacccggtaacccgtaacggttaaccggaacggtacctaacccggtacgttacccgtaaacgtaacggttacgggaacggtccggtagggtaccggaccggtaacggtcgtacgggaacggttaccgtacgtaccgggaaccggtaccgtcccggggttacggttaaggttcccgttaacgggtgggttacccggtacggggtaggttaaccggggtcgggtttaacgttcgggttaaccggg

SEQ ID NO: 56346 - DNA, 484 bp, Homo sapiens
  misc_feature: GYAE6OF02IPPRM.36.84.H07.1.454.CMB.1.raw
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaagacttctggatacaccttcaccggctactatatgcactgggtgcgacaggccctggacaagggcttggagtggatgggatggatcaacctanagtggnggcacaaactatgacacagagttcaggcagggtcacatgacagggacacgtcatcagcacagtctanagtggancgtagagcgaggcgtagagatcgagacgcgacggcgtagtattacgtgtgcggagaggcggttatagtacgg

SEQ ID NO: 56347 - DNA, 499 bp, Homo sapiens
  misc_feature: GYAE6OF02F7C8U.36.84.H07.1.454.CMB.1.raw
  modified_base (283)..(283): a, c, t, g, unknown or other
  misc_feature (283)..(283): n is a, c, g, or t
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaagacttctggatacaccttcaccggctactatatgcactgggtncgacaggccctggacaagggcttgagtggatgggatggatcaacctaanagtggtgcaacaaactangacanagaagttcagggcagggtcacatgaccgagggacacgtcagtcagcacagtctacatggagctagagcgaggctaggagatcgtagaccgacgacgggtccgttagtaacttacgtgtgcggaggaggacgggttattagtagg

SEQ ID NO: 56348 - DNA, 487 bp, Homo sapiens
  misc_feature: GYAE6OF02GTUE5.36.84.H07.1.454.CMB.1.raw
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (434)..(434): a, c, t, g, unknown or other
  misc_feature (434)..(434): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaagacttctggatacaccttcaccggctactatatgcactgggtgcgacaggccctggacaagggcttgagtggatgggatggatcaacctangtggtgcanaactntgacanagtaagttcaggcagggtcacatcgacgaggacacgtcatcagcacagtctacagtggagcgtagagcgaggctgaagatcgngacgacgacggccgtagtacttacgtgtgcgaggagggtcggttatagtacgg

SEQ ID NO: 56349 - DNA, 503 bp, Homo sapiens
  misc_feature: GYAE6OF02H419P.36.84.H07.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
tcagtacgctgtctcacgaccggtgctcgatttagcagacgtctgtcgcgggagagcatcacccagcaaccacatctgtcctctagagaatccctgagagctccgttcctcaccatggactggacctggaggatcctcttcgttggtggcagcagcacaggagcccactcccaggtgcagctggtgcagtctggggctgaaggtgaagaacgcctggggcctcagtgaaggtctccgtgcaagactctggatacacctcacggctactatatgcactggngcgacagcccngacaagggctgagtggntgggatggatcgaaccctanagtggngcactaaacatgcacagaagttcaggnaggtcacatgaccaggganacgtcancagcactatcanagaggacngtgagacgagacgagagagtcgtacgacgacgaacggaccggtacgtacgttacgttagtacgacggacggaagggtacgggtacggttaggtagg

SEQ ID NO: 56350 - DNA, 519 bp, Homo sapiens
  misc_feature: GYAE6OF02IHJ84.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaagacttctggatacaccttcaccggctactatatgcactgggtgcgacaggccctggacaagggcttgagtggatgggatggatcaacctaacaggtggtggcaacaaactatgacacagtaagtttcgagggcagggtcacatgaccgagggacacgtccatcagcacagtactacagtgggagcgtagacgcgacggcgtaggagtatcgagaccgacgaccggtccgttagtaacgttacgtggtcggacggtaggagggtacggttagttagtagg

SEQ ID NO: 56351 - DNA, 517 bp, Homo sapiens
  misc_feature: GYAE6OF02IJ3X3.36.84.H07.1.454.CMB.1.raw
  modified_base (247)..(247): a, c, t, g, unknown or other
  misc_feature (247)..(247): n is a, c, g, or t
  modified_base (335)..(335): a, c, t, g, unknown or other
  misc_feature (335)..(335): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaagacttcnggatacaccttcaccggctactatatgcactgggtgcgacaggccctaggacgaagggcttgagtggagtgggatggatcaacctaangtggtgcaacaactatgcagagtaagtttcgagggcagggtcacgatagaccgagggacacgtacatcagcacgagtctaacagtggagcgtagacggacgaggcgtagacgtacgtactaggacgacgaccggtcgtagtaacttacgtggtcgacggaggagggtcggttatagttacgg

SEQ ID NO: 56352 - DNA, 516 bp, Homo sapiens
  misc_feature: GYAE6OF02FOUCX.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaagacttctggatacaccttcaccggctactatatgcacgtgggtgcgacgaggccctggacaagggcttgagtggagtgggatggataccaaccctaacgaggtggtggacaacaaacgtagtgacacgagtaagtttcgagggcagggtcacgagtacgaccgagggaccacgtccatcagccagactctacagtggatcgtagacgcgagcgtgaagtctcgtagacgacgcggcgtagtattacgtggtagcgaggacggcggttatagtagg

SEQ ID NO: 56353 - DNA, 531 bp, Homo sapiens
  misc_feature: GYAE6OF02FE3RP.36.84.H07.1.454.CMB.1.raw
  modified_base (282)..(282): a, c, t, g, unknown or other
  misc_feature (282)..(282): n is a, c, g, or t
  modified_base (331)..(331): a, c, t, g, unknown or other
  misc_feature (331)..(331): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaggtctcctgcaagcttctggatacacctttcaccggctactatatgcacgtgggtncgacaggccctggacaagggcttgagtggatgggatggatcaaccctanaggtggtgacacaactatgcacgagaagttcgagggtcagggtcaccagtcgaccgagggaccacgtccatcagcacagtctacagtggagctagagcgaggctaggacgtagtcgtagaaccggacgtaccgggccgttagttaacgtttacgtaggttacggacggtaaggagggtaccgggttattacggttaacgg

SEQ ID NO: 56354 - DNA, 822 bp, Homo sapiens
  misc_feature: GYAE6OF02IN4G5.36.84.H07.1.454.CMB.1.raw
  modified_base (225)..(225): a, c, t, g, unknown or other
  misc_feature (225)..(225): n is a, c, g, or t
  modified_base (286)..(286): a, c, t, g, unknown or other
  misc_feature (286)..(286): n is a, c, g, or t
  modified_base (427)..(427): a, c, t, g, unknown or other
  misc_feature (427)..(427): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagctacaagtgcccactcccaggtgcaactggtgcagtcgtggggctagaaatgaagaagccgtggggcctnaggtaggaaggtgtcctggacaagacgttcgaaggactacacccttacacgtagttttaanagaaaatcgtaaacggtcggggtagaccggtaacacgggaccaacgaagggaacggaaaggggtcttaggaaggtggagtaggggtaatcggggttactaaacccgttagtaaggtgggtacgactaacgaggttaattancgactaacgaaggtaacgtttcccggaagggacaaggtaaactccaacgtacgtaacggaaccgtaaacggaaaacgacgtacccgttaaccgaaacgtttaaaaacccgaacgttaaacggtttaaaccgtaacggtaaacggttaaaccggttaaggtaaacccgtaaaggttacccgtttaaggggaaaaccgttcccgggtaacccggggtaaaaggtaaaccccggtaacccgggggttaaccgttaaaccgtttaaagttaccgggtttaaacgtaggggtaaaccgtaaacggggtaacggttaaaaccgggtaaacggttttaacgggtttttaacggggaaaccggtttaacgggttaaacggtttaaaggtaaaaccccgggggg

SEQ ID NO: 56355 - DNA, 610 bp, Homo sapiens
  misc_feature: GYAE6OF02HY2OY.36.84.H07.1.454.CMB.1.raw
  modified_base (379)..(379): a, c, t, g, unknown or other
  misc_feature (379)..(379): n is a, c, g, or t
  modified_base (572)..(572): a, c, t, g, unknown or other
  misc_feature (572)..(572): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgaggtgaaggtctcctagcaagtacttcgaggtatactaccttcgaccggacttactatatgactacgtggggtacgcggacacggtcccgtaggaaccgtaaaggggtcttaggaggttggagtagggatggtaactaccgtaaaccctaagnggtgggtagaccaaactaaagtatggacctaagtaaggtacgtttacgagggactaacggggtaccacgaagtcgaaccgaacggacaccgtacaactacgagacaagacgttacaacgagtcggaagcgtaggagacgaggacgtagacgtatccgtagaccgtaacgccggtaccgttagtacctttaggnggtacgacggtaggtacgggtacggtttattagtacgg

SEQ ID NO: 56356 - DNA, 487 bp, Homo sapiens
  misc_feature: GYAE6OF02H0P61.36.84.H07.1.454.CMB.1.raw
  modified_base (334)..(334): a, c, t, g, unknown or other
  misc_feature (334)..(334): n is a, c, g, or t
  modified_base (414)..(414): a, c, t, g, unknown or other
  misc_feature (414)..(414): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaagacttctggatacaccttcaccggctactatatgcactgggtgcgacaggccctggacaagggcttgagtggatgggatggatcaaaccctaanagtggtggcaacaaactatgcaacagaagtttcagggcaggtcacatgacaggacacgtcatcagcacagtcacatggancgtgagcaggctagagatcgtgacgacgacggtccgtagtacttagtgtggcgaggaggtcggtattagtagg

SEQ ID NO: 56357 - DNA, 542 bp, Homo sapiens
  misc_feature: GYAE6OF02II1KL.36.84.H07.1.454.CMB.1.raw
  modified_base (265)..(265): a, c, t, g, unknown or other
  misc_feature (265)..(265): n is a, c, g, or t
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaagtacttctggatacaccttcaccggntactatatgcatgggtgcgacaggccctgggaccaaggggcttggagtggagtgggatggatccaaaccctaacgaggtggtaggacaacaaacgtatggacaacgagtaagtttcgaggggcagggtccaaccgagtagaccgagggaccacgtacatcagcacgagtaccanagtaggagcgtggancgagcctagagactcgtagaccgacggaccggtaccgttgttaacttacggtggtcggacggtaggacgggtcgggttattagtacgg

SEQ ID NO: 56358 - DNA, 717 bp, Homo sapiens
  misc_feature: GYAE6OF02HLATQ.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgagggtgaagaagcgtgggcctcagtgaaggtctcctgcaagcttctggatacaccttccaccggcttactatatgcacgtgggtcgacgacgacggccgtaggacgaagggtcttaggagtggagtgggtagtggactaccaaacccgtaagaggttgggtacggacctaaacctaaaacgttaacgtcgaaccgaaccgtaaaggtaacgggttttaaccggaacggggaccggtaacggggtacccgaacccgtaacgttaaccggaaccgggtaaccggggtaaacctaacccgggtacccaagttaccgaacgaccaaccgtaacgttaaccctaacgtacgtacgggaacgacgttagggacggacgtacgggtaccgtaggacggtaacgtacgtacggtaaaccggaccggtaaccgggtcccggtttaacgttaacgtttacgttacgggttacgggacgggtaaccgggtaacggggtacggggttaacgtttaaggtttaaccggg

SEQ ID NO: 56359 - DNA, 667 bp, Homo sapiens
  misc_feature: GYAE6OF02HLBN3.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcctggggcctcgagtgaaggtctccgtgcaagacttctggatacaccttcaccggctacgtatatcgcacgtgggtcgcgaccgaggccctaggacaaggggtcttaggaggtggaagttggggatggtactacctaaaccctaagaaggttgggtacggacaactaaaacttagtacgcaaaccgtaaggtaacgttttacgaagggtcgtaacgggtccgaaccgtaagtacgaaccgaacggggaaccaaccgggtaccctaacgtaccgaacgtacgaaccgtaagtacctaactagttacggacggtacgtacgaccggacgaacgggtcgtacgaacggtacgtacgtacggaaaccggaccggtaaccgggtccgttagttaaacgtttaccgtaggtcggtaaccgggaagggtacggggttacgggttagttacgtttaaacgggg

SEQ ID NO: 56360 - DNA, 682 bp, Homo sapiens
  misc_feature: GYAE6OF02HXA4K.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcgttggtggcagcagccacaggacgcccactccccaggtgcagctggtgcagtcgtgggctggaggtgaagaagccgtggggcctcgagtggtaaggtcctcctagcaagtaccttcgtaggactaccacccttcgaccggtctaactactatcgctacgtgggtgcggacgacggccctaggacgaagggtcttggagtggagtgggagtggtaactaccgtaaacccgtaacgaggtaggtacggactaaacgtaaacttagtacgacaacggtaaggtaaccggtttacggaacggggtacgtaacggggtaccaaaccgtaagtccggaaaccggtaaggggaacctaccgggtacccaagttaccgacgacctaacgtaccgttactaaacgagtacgggacgtacggtagacggcggaacgcgtacgaacgtagttccgtaggaaccgaaccggaccgggttacccgttaggttaactttcggtaggttcggaacgggtaagggtaacgggttagggtttattaagtttaacggg

SEQ ID NO: 56361 - DNA, 580 bp, Homo sapiens
  misc_feature: GYAE6OF02HRTVR.36.84.H07.1.454.CMB.1.raw
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcgtggggcctcgagtgaaggtctccgtgcaagtacttgtggataccaccttcgaccggtctactatatgcacgtgggtcgcgacgacggccctaggacgtaagggtcttaggaggtggagtgggatggactcgaaccctagaggtggngacaacaactancgacacgagtaacgtttcgagggcgagggtacacgatacggacgacgggactacgtacactacgacgactacacgtactacgagtggacgtcgtaggacgacgagtcgtagaacgtacgtcgtacggaccgaacggtaccgggtccgttaggttaacgtttacgtggtacgacgggtaggtacggggtagggttacgttgggtacggg

SEQ ID NO: 56362 - DNA, 586 bp, Homo sapiens
  misc_feature: GYAE6OF02JPCV0.36.84.H07.1.454.CMB.1.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtcggcagcagccacaggacgcccactcccaggtgcagctggtgcgagtcgtggggactgaggtgaagaagccgtggggcctcagtgaaggtctcctgcaagtcttctggatacaccttccaccggtctacgtatangcacgtgggtnacgacaggccctggacagggctgagtggatggatggactacaacctagagtggtagacgaacaactagcgacacgagtaagttcgacggtacggaggtaccacgtaagtacggaaccgtagggaaccgtacccgtaccgtaacgtacgaacgaaccgtaacgtacgtaccgtaacaaggtagggtacaccggtagacgacggtagacgtgaacggactcggtacgacgaccgtcgggacttagggtaacttcgttaggcggacggaggtaacgggtcggttatagttaacggg

SEQ ID NO: 56363 - DNA, 637 bp, Homo sapiens
  misc_feature: GYAE6OF02HULG0.36.84.H07.1.454.CMB.1.raw
  modified_base (236)..(236): a, c, t, g, unknown or other
  misc_feature (236)..(236): n is a, c, g, or t
  modified_base (553)..(553): a, c, t, g, unknown or other
  misc_feature (553)..(553): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttctggtggcagcagccacgaggagcccactcccaggtgcagctggtgcagtcgtgggctgaggtgaagagccgtggggcctcgagtgaggtctcgngacagtacttcgtaggactactaccttcgaccggtctaactatactgacctacgtgggtcgacggacgtaccgggaccctaggaaccgaaagggtccttaggacggttcgggaggtggggacgtaggtaactaccgtaaaacccgttaaggaggttcgggtacggacaaactaaacgtagtacgacaacgtaagtaacgtttacgagggtctaacgggtaccaactaaggcggtaaccgaacgggtacctaaccggtacaagtacgaacgaccgtactacggtacctacgagttacggaagtcgtagacgcgtaggntaggatacgtcgacgtacgacggtcggtacgtagtacgttacgtggtacgacggtacgtacgggtacggttataggttaacggg

SEQ ID NO: 56364 - DNA, 575 bp, Homo sapiens
  misc_feature: GYAE6OF02F5ESL.36.84.H07.1.454.CMB.1.raw
  modified_base (338)..(338): a, c, t, g, unknown or other
  misc_feature (338)..(338): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (427)..(427): a, c, t, g, unknown or other
  misc_feature (427)..(427): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaactgaagaagcctggggccttagtaaacttctcctgcaaggcttctggttacctctttcttacgtatggcatcagcgtgggtgcgacacggcccctggaacgaagggctcgagtggagtggggtgatcgagcctaanatcggtacaanaactgngacaacggtagttgacaggacagacgtacgacagtcgaaccagaacaccgaccgtaccgaacgacgcaacgngacgtaacagtacggaacgtggaacggactccgtagacgaccgtagaaccgaccgacgactaatagttactacgtggacgtacggaagtaaccggtaccggtacgttacggttaagttggttaacgttaagttttagggtttacgggg

SEQ ID NO: 56365 - DNA, 742 bp, Homo sapiens
  misc_feature: GYAE6OF02JLKP6.36.84.H07.1.454.CMB.1.raw
  modified_base (499)..(499): a, c, t, g, unknown or other
  misc_feature (499)..(499): n is a, c, g, or t
tcagtacgctgtctcacgaccggtgctcgatttagcagacgtctgtcgcgggagagcatcacccagcaaccacatctgtcctctagagaactcccctgagagctccgttcctcaccatggactggacctggaggactcctcttcgttgggtggcaggcagcccacgaggacgccccacctccccgagggtcgccaggtccgttgggtcgaccgacggttcggtcggggggtccttagggagggtaggaaagggaacggtcccgggttcgggggccctcgtaggtacggtaacgggtcctccgttggactaacggtactttacggacggtaactaacccgtaccttcccgaacccggtcttaaccttattagcgtaccgtacggtggggtacacggtaccgacgggtccccgtaaggaccgaaggggtcctaggtaggtggtacggtgggtagcggtaactacctaaacccgtagtgggtcgcgaacaaacgtaaacgtntacggataaccgtaaggttaacgttcggacgggtacgacggtaccaacgtacgtacgaccggtaacggacctaccggactacgtaacgccgtacgtaccgtacgtacgtacggtagtacggacgtacgtagacggtacgacgtacggtagtaacgcgttacgacggaaccgtacggacgttacgttaccgtagttccggtagtccggaacggtcgggaaggttacgggttactaggttacggg

SEQ ID NO: 56366 - DNA, 629 bp, Homo sapiens
  misc_feature: GYAE6OF02F8R2U.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcgagtgaaggtctcctgcaagtcttctggatacaccttcaccggtctactatatcgctacgtgggtgcgacgacggcccgtggaccgaagggtcttaggagtggagtgggatggaactaccaacccgtaagaggtgggtagacctaaacaaacgtatcgacacgaaggtaagtttcgaggacgtagggtaccaacgagtacggaccgacgggaaccaccgtaccaacgtcgacgaccaacgtacgtacctaacgtacgtacgggagtacgtagaacggtacgacggtacgacggtaagtacgtacgtacggtaaccgtaccggtaaccgggttccgttaaggttaccgttaacgtcggttacggtacggtaaggggtacgggtaccggtttaagttacggtttaacggg

SEQ ID NO: 56367 - DNA, 683 bp, Homo sapiens
  misc_feature: GYAE6OF02JTF5V.36.84.H07.1.454.CMB.1.raw
  modified_base (253)..(253): a, c, t, g, unknown or other
  misc_feature (253)..(253): n is a, c, g, or t
tcagtacgctgtctcacgaccggtgctcgatttagcagacgtctgtcgcgggagagcatcacccagcaaccacatctgtcctctagagaatcccctcgagagctccgttcctcaccatggactggacctggaggatcctcttcttggtggcagcagccacaggagcccacctcccaggtgcagctggtgcagtcgtgggctgaggtgaagagcctgggcctacagtagaaggtctcctggacaagactttcgnggataccaccgttccaaccggctacctatacgtagcccgtaacgttgggggtcaccggaccgtacgggtccccgtagggaacggaaacgggggttcctttaggagggttgggaggttacggggaagttcggggaacttcccgaaaaccccgttaataggggttgggtaccgggacaaccgtaaaacttactgggaacccagtaaaggtaacgttttccggagggacgaacgggtccgaaccgagtaccgacgtaacggggacaacggtaccactacgcgaccgactacgtcaccgtagtacggacgcgttacgagacggtacggagtacgagtacgtcgtacgaccggtaacgcccgggtaccgtggttaactttacggtacggttacggacgggaacgacggggtacgggttaagttacgttaacgggg

SEQ ID NO: 56368 - DNA, 786 bp, Homo sapiens
  misc_feature: GYAE6OF02JUQBV.36.84.H07.1.454.CMB.1.raw
  modified_base (245)..(245): a, c, t, g, unknown or other
  misc_feature (245)..(245): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
tcagtacgctgtctcacgaccggtgctcgatttagcagacgtctgtcgcgggagagcatcacccagcaaccacatctgtcctctagagaatccctcgagagctccgtttcctcaccatggactggtacctggaggactcctcttcttggtggacagcagccacgtaggagcccactcccgaggtgcacgcgttggtgcacgttcgtcggggcgtggagggtgaaggaacgccgtcgggggtcctnaggtagaacgggttccttccgngaacgaacgtactttccgngggtataacctccttccggaacccggctttaatacgttactcgacgttccgttgggggtcgacgtacgacggcccttaggaacccgtaagggtctttaaggaggtgggtacgtaggggagttggacttaacccgaaaacccgttactaggggttcgggtacgacccaaattaacccgattacgggacccttaacgaaaagggttttcgtttaaacggtacggggtagtaacggggttaacaacccggtaacgtacggtaaaccggaacggggtaaccgaaccgtaccgtaacgaccgtaaacgaccggttaaccaacggttaccgaaacgttacggtacgggtaacgacgtttacggacggtacggacgggtttacgacgggaacgaccggttacgacggtaccggacgggttaaccggtacgggttacgttaaacgtttccggtaaaggtccgggtcggtaagggttaaccgggtagggtttaaccgttagttacgggg

SEQ ID NO: 56369 - DNA, 686 bp, Homo sapiens
  misc_feature: GYAE6OF02JBR1H.36.84.H07.1.454.CMB.1.raw
  modified_base (327)..(327): a, c, t, g, unknown or other
  misc_feature (327)..(327): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctccgtgacaagacttcgtggataccgaccttacgaccggtctactatatcgctacgtggtcgcgacacggccctggacaagggtcttaggngtacgggagtgggatagggtactaccgaaaccctaagacgggttagggtacggactaaccgaaactcgtacgaccaaacgtaaggtaacgttttcgaacggggtacgtaacgggtaccgaaccgtaagtaccggaaccggtaacgggaaccgtaccgacccgaagttacccgaacgaccaacgtacgtactaaccggtacgttagggacgtaccgtacggaacgtacggacgggtacgtaggaacgtacgttacgtacgggaaccggtaaccggtaccggtaccgggttaacggttaaccgttacgttaggtacggtacggtacgggtaacgggttacgggttagtttagttaacgggg

SEQ ID NO: 56370 - DNA, 643 bp, Homo sapiens
  misc_feature: GYAE6OF02GTRDE.36.84.H07.1.454.CMB.1.raw
  modified_base (367)..(367): a, c, t, g, unknown or other
  misc_feature (367)..(367): n is a, c, g, or t
  modified_base (536)..(536): a, c, t, g, unknown or other
  misc_feature (536)..(536): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggaggatccttcttcttggtggcagcagccacgaggacgcccactcccgaggtgcagcgtggtgcgaggtcgtggggctggaggtagaagaacgccggtggggcctcgagtggaacggttctaccgtgacaacgtacttcgtaggtactacctaccttccgaccgtacttactatatcggactacggtgggtcggccgaaccgaccggtacccgtagggaaccgtaagggtcgttaggnggtagggaggtgggacgtaggtactaccgtaaacctacgaggtggtagacctaacgaaactgacacgtaacgagttaacgttcggagggtaccgagtacacctagtacgaacgacggactacgtaccatcgacgaccatacgtactactaggtgacgtgacgacgacgngacctagacgtacgttacgtacggaacggtacggtaccgtacgttacggttaacttacggtggtacgtcggtagggtacgggtaacgggtttactaggttaaccggg

SEQ ID NO: 56371 - DNA, 768 bp, Homo sapiens
  misc_feature: GYAE6OF02HPPZX.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtagaagaagccgtggggcctcgagtgaaggtctccgtgacaagtacttcgtggactacgtaccttacgaccggtctaactatatcgcacgtgggtgccgacgacggccgtaggacgaagggtcgttagaggtcggagtgggagtggactaccaaaccctaagtaggtggtagacaactaaacgtacgtacgtacgacgtaagtaacgtttacgagggtacgtaacgggtaccgaacgtaacgtaccgggtaaccggaaacggggtaaccctaaccggttacccgtaacgttacccgtaacgaaccgtaaccgtaaccggttaaccgttaacgaacgttaacggggaacgttacggtaacggtacggaacccggtacgggttaacccgtaggtaaccgtaacgttaccgggttaccgggaaacccggaacccgggtaacccgggttaacccgggtttacgtttaaccggtttaaccggtttacggggttaccgggaaccggggttaaacgggggttacgggggtttaacggggttttaacggtttaagggttttaaaccggggg

SEQ ID NO: 56372 - DNA, 631 bp, Homo sapiens
  misc_feature: GYAE6OF02GMZJA.36.84.H07.1.454.CMB.1.raw
  modified_base (133)..(133): a, c, t, g, unknown or other
  misc_feature (133)..(133): n is a, c, g, or t
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (282)..(282): a, c, t, g, unknown or other
  misc_feature (282)..(282): n is a, c, g, or t
  modified_base (387)..(387): a, c, t, g, unknown or other
  misc_feature (387)..(387): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (501)..(501): a, c, t, g, unknown or other
  misc_feature (501)..(501): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
tcagtacgctgtctcacgaccggtgctcgatttagcagacgtctgtcgcgggagagcatcacccagcaaccacatctgtcctctagagaatcccctgagagctccgttcctcaccatggactggacctggagntcctctcgttggtggcagcagccacaggagccctactccctaggtgcgngctggtncgagtcgtggggctaggnggtagaagaaggccgtcgggggtcctcgagttacggaacgggttcctccgtggtaaccgtaaggtaccgtttcgnggtaacgtaacctaccgttcgaaccggttctactaatcgtacggctacgttgggctaccgaacgtacggcccgtggaagtacggtcgttgacggtggaagtgggntaggactccaaaccgtaacgnggtcgggntacgtaaacaagtcgtagaccgaatacggtttaacgttgacggtacggtaggacctacagtcgaacggtagtaccgacacgaacngtaacacgacgtatacccgttagaccgtgagaccctagaaccgtggtaaccgtacgngtacgngtacgacgttacggcgttagtgttaacgtcgttaggcgaccggtagagggtccgtagttagtaccgg

SEQ ID NO: 56373 - DNA, 788 bp, Homo sapiens
  misc_feature: GYAE6OF02JHAAM.36.84.H07.1.454.CMB.1.raw
  modified_base (177)..(177): a, c, t, g, unknown or other
  misc_feature (177)..(177): n is a, c, g, or t
  modified_base (292)..(292): a, c, t, g, unknown or other
  misc_feature (292)..(292): n is a, c, g, or t
tcagtacgctgtctcacgaccggtgctcgatttagcagacgtctgtcgcggggagagcatcacccagcaaccacatctgtcctctagagaactcccctgagagcctccgttcctcaccatggactgggacctggaggattcctctttcgttggtggcaagcaagccaacgagggacnccctactccgaggtgcagtcgtggtgcgacggtcgtggggctaggacggtagaacgacgtccggtcggggacctcgaggtcggtaacggtcctccggtgacaagttaccgttcgnggtaactaccgtacctccggaccgtcttaactaagtgtaccggacgtacggttggggttacaccggaaccgccgggtaccgtagggtaaaccggacgggttcgttagggtaagggtcggtaacggggttacggggaacgtttacggggaacccttaacccggtaaacccggttaaacggttacggggttcggggtaccggtaaaacccgtaacgtaaaacgtttaccggaggacccttaaacgggttaacgggtttaaacggttccggtaaccggggtaccggtaaccggtaccgaaaccggtacggttacgaaccgggtaacggaccgtaaccgcgtaacgacgtacggaactaccgacgttccgaagtcaggtcgacgtagacgacggcgtcgtaggactacgttacggaccgtacggcgtaacgggttacctaggttactacgggttacgtacggcggtaaaggttcgggtaacgttacgtcggtttaacggg

SEQ ID NO: 56374 - DNA, 597 bp, Homo sapiens
  misc_feature: GYAE6OF02FXQ1J.36.84.H07.1.454.CMB.1.raw
tcagtacgctgtctcacgaccggtgctcgatttagcagacgtctgtcgcgggagagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtcctccgtgcaagacttctggatacgaccttcaccggctactatatgcacgtgggtgtcgactaggccctggacaagggcttgagtggatgggactggatcaaccaacgagtggtggcaacaaactagtcgactagacgtaagtttacgaggacgagggtcaacgtagtacgaccgacgggactaccgaccattcgagacaacgacgtactaacgagtcggacgtgtacggaagacgaacggcgttaggaagacgttacgttacggaaccggaacgtaacccgggtaccgttacggtaacgtttaaccgtaggttcggtaccgggtaagggtacgggtaccggggtttattacgggtttaacggg

SEQ ID NO: 56375 - DNA, 902 bp, Homo sapiens
  misc_feature: GYAE6OF02JJT74.36.84.H07.1.454.CMB.1.raw
  modified_base (195)..(195): a, c, t, g, unknown or other
  misc_feature (195)..(195): n is a, c, g, or t
tcagtacgctgtctcacgaccggtgctcgatttagcagacgtctgtcgcgggagagcatcacccagcaaccacatctgtcctctagagaactcccctgagagctccgttcctcaccatggactggacctggaggatcctcttcgtggtggcagcagaccacgaggacgcccacctcccgaggtcgcgagctggtncgtagtcggtgggctaggtaggtaggaaaggacgtccggtcgggcctacgaggtacggaacggtcctcgtacgactaacggtcttcgtacggataacctccgttaccgtaccgtacgttaacctaatagtcggtacctaacgggttcgggtacgaccggtaaccggaccggtacccggtacggtaacggtaacgggttacggttacgggaacggttaggaccgggttagggtaaggtacggtaaacttaacccggtaaaacccgtaacggttagggtacggggtttaccgaaaaccgttaaccgttaaacgtacgtacgggtaacctaaacggtaaacgggtttaacgttacccgggacgggtaacggtaacccggggtaaccgaaaccgtaacggttaacgggaaacccggtaaccgggggtaaaccctacccgggtaacctaaacgtaaccgtacgtaacccggtaaccggttaaacgtttaccgtaacgttaacgggtacgggtaaccgttacggaacggtaacgggtaccgggtaaccgttacggtaccgggtaaagtacccgtttaacggaacccgttaaacgggacccggttaaaccgggtttccggttttaacgggttaaccgttaccgtttaagggtaaccgggtacgggttaccggttaggggtttaaccggtttaacgttagggttttaaccggggg

SEQ ID NO: 56376 - DNA, 485 bp, Homo sapiens
  misc_feature: GYAE6OF01DK2HY.29.87.H10.1.454.CMB.1.raw
  modified_base (470)..(470): a, c, t, g, unknown or other
  misc_feature (470)..(470): n is a, c, g, or t
tcagatagagtactcacgaccggtgctcgatttagcagtactgcgttgggtttggggcagaagtctctctcagtccagacacagcatggacatgagggccccgctcagctcctgggactcctgctgctctggctcccagataccagatgtgacatccagatgacccagtctccatcctccctgtctgcatctgtgggagacagagtcaacgtcacttgccgggcgagtcaggcattaacaattattagctggtatcagcagcatccaggaaagttcctaagctcctgatctatgctgcatccactttgcaatcagggtcccatctcggttcagtggcggtggatatgggacagagttcactctcaccatcagcagcctgcagcctgaagatgttgctaacttattaactgtacaaaagtatcaactttcgacccccatccaccttcggacctaagggacacgactagganattaaacgaagtcgg

SEQ ID NO: 56377 - DNA, 474 bp, Homo sapiens
  misc_feature: GYAE6OF01C5A0P.29.87.H10.1.454.CMB.1.raw
  modified_base (225)..(225): a, c, t, g, unknown or other
  misc_feature (225)..(225): n is a, c, g, or t
tcagatagagtactcacgaccggtgctcgatttagcagtactgcgttgggtttggggcagaagtctctctcagtccagacacagcatggacatgagggccccgctcagctcctgggactcctgctgctctggctcccagataccagatgtgacatccagatgacccagtctccatcctccctgtctgcatctgtgggagacagagtcaacgtcacgttgccgggngagtcaggcagtaacaagtatttagctggtatcagcagcatccaggaaagtcctaagctcctgatctatgctgcatcactttgcaatcagggtccatctcggttcagtggcggtggatatgggacagagttcactctcaccatcagcagcctgcagcctgagatgttgcaacttattactgtcaaagtatcacttgcccccatccaccttcggcctaagggacacgactaggagaataacgaactacgg

SEQ ID NO: 56378 - DNA, 491 bp, Homo sapiens
  misc_feature: GYAE6OF01BEJ11.29.87.H10.1.454.CMB.1.raw
tcagatagagtactcacgaccggtgctcgatttagcagtactgcgttgggtttggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattattagcctggtatcagcagcatccagggaaagttcctaagctcctgatctatgctgcatccactttgcaatcagggtcccatctcggttcagtggcggtggatagtgggacagagttcactctcaccatcagcagcctgcagcctgaagatgttgctaactttattacttgtactaaagtatctactttcgccccctatccaccttcggccaagggacacgtactaggagacttaaacgacgtagg

SEQ ID NO: 56379 - DNA, 482 bp, Homo sapiens
  misc_feature: GYAE6OF01AOHH5.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattattagcctggtatcagcagcatccagggaagttcctaagctcctgatctatgctgcatccactttgcaatcagggtcccatctcggttcagtggcggtggatatgggacagagttcactctcaccatcagcagcctgcagcctgaagatgttgcaacttattactgtacaaagtatcactttcgcccctatccaccttcggccaacgggacacgactaggagattaaacgatacgg

SEQ ID NO: 56380 - DNA, 505 bp, Homo sapiens
  misc_feature: GYAE6OF01AWJAX.29.87.H10.1.454.CMB.1.raw
  modified_base (386)..(386): a, c, t, g, unknown or other
  misc_feature (386)..(386): n is a, c, g, or t
  modified_base (415)..(415): a, c, t, g, unknown or other
  misc_feature (415)..(415): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcagtcaggcattaacattattagcctggtatcagcagcatccaggaagttcctaagctcctgatctatgctgcatccactttgcaatcagggtccatctcgtcagtggcgtggatatgggacagagttcactctcaccatcagcagcctgcagcctgaagntgtgctaacttattactagtactaaagtntactactttcgacccccgtatccgtacccttcgggacccaaacgggtacctaaccggtactaggaacgtagttaaaaccgaacgttacgg

SEQ ID NO: 56381 - DNA, 499 bp, Homo sapiens
  misc_feature: GYAE6OF01B7QS0.29.87.H10.1.454.CMB.1.raw
  modified_base (202)..(202): a, c, t, g, unknown or other
  misc_feature (202)..(202): n is a, c, g, or t
  modified_base (484)..(484): a, c, t, g, unknown or other
  misc_feature (484)..(484): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatgacccagtctccatcctccctgtctgcatctgtggganacagagtcaacgtcacttgccgggcagtcaggcattaacattattagctggtatcagcagcatccagggaagttcctaagctcctgatctatgctgcatcctactttgcaatcgagggtcccagtctcggttcagtggcggtggagtagtgggacaggtacgttcactcgtacaccatcagcagcctgcagcctgaacgtattcgtgactaactttattactagtaactaagtatctacttcgcccctatcctaccttcggccaacggacacgactaggaanacttaacgagtacgg

SEQ ID NO: 56382 - DNA, 503 bp, Homo sapiens
  misc_feature: GYAE6OF01C54M8.29.87.H10.1.454.CMB.1.raw
  modified_base (403)..(403): a, c, t, g, unknown or other
  misc_feature (403)..(403): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttggccgggcgagtcaggcattaacaattatttagcctggtatcagcagcatccagggaaagttcctaagctcctgatctatgctgcatccactttgcaatcaggggtcccatctcggttcagtggcggtggatatgggacagagttcactctcaccatcagcagcctgcagcctgaagatgttanctaacttattactgtactaaagtatactactttcgcccccatcctaccttcggaccaaacgggacacggactagggagaacgttaaacgaacgttacggg

SEQ ID NO: 56383 - DNA, 471 bp, Homo sapiens
  misc_feature: GYAE6OF01CRB6N.29.87.H10.1.454.CMB.1.raw
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
  modified_base (460)..(460): a, c, t, g, unknown or other
  misc_feature (460)..(460): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcgaggcattaacaattattagcctggtatcagcagcatccaggaattcctaagctcctgatctatgctgcatccactttgcaatcagggtccatctcgttcagtggcggtgatatgggacagngttcactctacacatcagcagcctgcagcctgaagtntgttagactaacttattactagtacaaagtatctacttcgccccatcacttcgccaacggcacgacaganaatacgatcgg

SEQ ID NO: 56384 - DNA, 511 bp, Homo sapiens
  misc_feature: GYAE6OF01CY6QX.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcagtcgaggcattaacaattatttagcctggtatcagcagcatccaggaaagttcctaagctcctgatctatgctgcatccactttgcaatcgagggtcccattctcggttcagtggcggtggatagtgggacagtagttcactctcaccatacagcagccagcagcctagaagattgttgactaaacttattacttagtaactaaagtactctaacttccgcccctatccacccttccggaccgaacgggacacgtacgtaggaagtaacttaaacgactacggg

SEQ ID NO: 56385 - DNA, 488 bp, Homo sapiens
  misc_feature: GYAE6OF01D83ZQ.29.87.H10.1.454.CMB.1.raw
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggngagtcaggcattaacaattatttagcctggtatcagcagcatccagggaaagttcctaagctcctgatctatgctgcatccactttgcaatcaggggtcccatctcggttcagtggcggtggatagtgggacagagttcactctcaccatcagcagcctgcagcctgaagatgttgacgtaacttattactgtacaaagtatcactttcgcccctatcaccttcggccaaggacacgactaggagaacttaaacgactacgg

SEQ ID NO: 56386 - DNA, 484 bp, Homo sapiens
  misc_feature: GYAE6OF01E2954.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcagggtcccatctcggttcagtggcggtggatatgggacagagttcactctcaccatcagcagcctgcagcctgaagatgttgctaacttattactgtacaaagtatacactttgccccctatccaccttcggccaagggacacgactggagattaaacgactagg

SEQ ID NO: 56387 - DNA, 494 bp, Homo sapiens
  misc_feature: GYAE6OF01BDIRJ.29.87.H10.1.454.CMB.1.raw
  modified_base (476)..(476): a, c, t, g, unknown or other
  misc_feature (476)..(476): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattattagcctggtatcagcagcatccagggaaagttcctaagctcctgatctatgctgcatccactttgcaatcaggggtccatctcggttcagtggcggtggatatgggacagagttcactctcaccatcagcagcctgcagcctgaagatgttagctaacttattactgtacaaagtatctactttcgccccctatcctaccttcggccaacgggacaccgtactaggaanacttaaacgaacttacgg

SEQ ID NO: 56388 - DNA, 508 bp, Homo sapiens
  misc_feature: GYAE6OF01AX4J0.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcaggggtcccatctcggttcagtggcggtggatatgggacagagttcactctcaccatcagcagcctgcagcctgaagatgttgctaacttattactagtacaaagtatctactttcgaccccctatcctacccttcggacccaacgggacaaccgtactagggaagtaacttaaaacggaacttacggg

SEQ ID NO: 56389 - DNA, 521 bp, Homo sapiens
  misc_feature: GYAE6OF01CEERJ.29.87.H10.1.454.CMB.1.raw
  modified_base (395)..(395): a, c, t, g, unknown or other
  misc_feature (395)..(395): n is a, c, g, or t
tcagatagagtactcacgaccggtgctcgatttagcagtactgcggttgggtttggggcagaagtctctctcagtccagacacagcatggacatggacgggcccccgctcagctccgtgggactcctgctgctctggctcccagataccagatgtgacatccagatgacccagtctccatcctccctgtctgcatctgtgggagacagagtcaacgtcacttgccgggcgagtcgagggcattaacaattattagcctggtatcagcagcatccgaaggtaacgttctaagctcctgatctatgctgcactctactttgacaatcgaagggtcccatctcggttcaggtggcggtgatagtgggacagagttcactctcacatcagcagcctgcncgacctaggaacagttgtacggtactaaacgtttacttacgtattaacgaaagttatcctacttccgacccctatcctacgttccgacgaacggacaacgtacaggaacgtataaacgagttacgg

SEQ ID NO: 56390 - DNA, 497 bp, Homo sapiens
  misc_feature: GYAE6OF01B3DIY.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcccgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcaggggtcccatctcggttcagtggcggtggatagtgggacagagttcactctcaccatcagcagcctgcagcctgaagatgttgacaacgttattactgtacaaagtatcactttgccccctatccaccttacgaccgaaggaccaacgactaggacgaattaaacgaactggtacgg

SEQ ID NO: 56391 - DNA, 504 bp, Homo sapiens
  misc_feature: GYAE6OF01AYA09.29.87.H10.1.454.CMB.1.raw
  modified_base (485)..(485): a, c, t, g, unknown or other
  misc_feature (485)..(485): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaaagctcctgatctatgctgcatccactttgcaatcaggggtcccatctcggttcagtggcggtggatagtgggacagagttcacgtctcaccatcagcagcctgcagcctgaagatgttgctaactttatacttgtactaaagtactacactttcgcccctatccacccttcggcccaagggaccacggtacctaggaanacgttaaacgacgttacgg

SEQ ID NO: 56392 - DNA, 508 bp, Homo sapiens
  misc_feature: GYAE6OF01EF1CL.29.87.H10.1.454.CMB.1.raw
  modified_base (200)..(200): a, c, t, g, unknown or other
  misc_feature (200)..(200): n is a, c, g, or t
  modified_base (423)..(423): a, c, t, g, unknown or other
  misc_feature (423)..(423): n is a, c, g, or t
tcagatagagtactcacgaccggtgctcgatttagcagtactgcgttgggtttgggggcagaagtctctctcagtccagacacagcatggacatgagggccccgctcagctcctgggactcctgctgctctggctcccagataccagatgtgacatccagatgacccagtctccatcctccctgtctgcatctgtggganacagagtcaacgtcacttgccgggcagtcaggcattaacaattattagcctggtatcagcagcatccagggaaagttcctaagctcctgatctatgctgcatccactttgcaatcagggtcccatctcggttcagtggcggtgatagtgggacagtagttcactctcacatcagcagcctgcacgctgaagatgttgactaacttattactagtacaaagttntactactttcgaccccctatacctaccgttcggacccaaacggggaccaacggtactaggaagtacttaaaacggacgttacggg

SEQ ID NO: 56393 - DNA, 515 bp, Homo sapiens
  misc_feature: GYAE6OF01E1PEK.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattatttagcctggtatcagcagcatccagggaattcctaagctcctgatctatgctgcatccactttgcaatcagggtcccatctcggttcagtggcggtggatagtgggacagagttcactctcaccatcagcagcctgcagcctagaagatgttagactaacttattactgtactaaaagttatactactttcgaccccctattccaaccgttccggaccgaaacgggaccacgtaacgtaggaagtaacgttaaaacgaacgttacggg

SEQ ID NO: 56394 - DNA, 512 bp, Homo sapiens
  misc_feature: GYAE6OF01DVV8B.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctgtggganacagagtcaacgtcacttgccgggcagtcagggcattaacaattatttagcctggtatcagcagcatccagggaaacgttctaagctcctgatctatgctgcatccactttgcaatcagggtcccatctcgtcagtggcggtgatagtgggacagagttcactctcacatcagcagcctgcagcctagaagtattttgacttaacttattactagtactaactactttaacaacttacctactaactaacgtccgttacgaccgaacgggacccaaggtacgaaaccgaacgacgaacgtggtggtaccg

SEQ ID NO: 56395 - DNA, 526 bp, Homo sapiens
  misc_feature: GYAE6OF01CML9U.29.87.H10.1.454.CMB.1.raw
  modified_base (345)..(345): a, c, t, g, unknown or other
  misc_feature (345)..(345): n is a, c, g, or t
tcagatagagtactcacgaccggtgctcgatttagcagtactgcgttgggtttgggggcagaagtctctctcagtccagacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattataagttatttagcctggtttcagcagaaaccagggaaacgcccctaaactcctgatctacgctgcatccactttgcacagtcgggtcccgtctaggttcagcggnagcggatcgtgggacagtatttcactctcaccatcagcagcctgcagcctagaagatgttgactaacttattaactgtacaactagtacttagtaacgtaccctaccgtactacgttttacggccgtaacggggtaccgtaagggtcggagactacgaaacgtactagtaggctgctaccg

SEQ ID NO: 56396 - DNA, 497 bp, Homo sapiens
  misc_feature: GYAE6OF01DQ8VA.29.87.H10.1.454.CMB.1.raw
  modified_base (201)..(201): a, c, t, g, unknown or other
  misc_feature (201)..(201): n is a, c, g, or t
  modified_base (403)..(403): a, c, t, g, unknown or other
  misc_feature (403)..(403): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccagggaaagttcctaagctcctgatctatgctgcatccactttgcaatcaggggtccatctcggttcagtggcggtggatagtgggacaggagttcactctcaccatcagcagcctgcagcctgaagatgtanctaacttattacttagtacaaagtatctactttcgcccctatcctacttcggccgaacggacacgtacgtaggaagtacttaaacgacttacgg

SEQ ID NO: 56397 - DNA, 511 bp, Homo sapiens
  misc_feature: GYAE6OF01BWQKV.29.87.H10.1.454.CMB.1.raw
  modified_base (201)..(201): a, c, t, g, unknown or other
  misc_feature (201)..(201): n is a, c, g, or t
  modified_base (397)..(397): a, c, t, g, unknown or other
  misc_feature (397)..(397): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccagggaaagttcctaagctcctgatctatgctgcatccactttgcaatcagggtcccatctcgttcagtggcggtggatagtgggacagtagttcactctcaccatcagcagcctgcagcctgaagntgtgactaacgttattacttagtactaaagtatctactttcgaccccctatcctaccgttaccggccaacgggaacacgtacctagggaagtaacgttaaacgaacgttacggg

SEQ ID NO: 56398 - DNA, 505 bp, Homo sapiens
  misc_feature: GYAE6OF01AYVT1.29.87.H10.1.454.CMB.1.raw
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
tcagatagagtactcacgaccggtgctcgatttagcagtactgcgttgggtttgggggcgagaagtctctctcagtccagacacagcatggacatgagggcccccgctcagctcctgggactcctgctgctctggctcccagataccagatgtgacatccagatgaccccagtctccatcctccctgtctgcatctgtgggagacagagtcaacgtcacttgccgggcgagtcagggcattaacaattatttaagcctggtatcagcagcatccagggaaagttcctaagctcctgatctatgctgcatccactttgcaatcagggtcccatctcggttcagtggcggtggatagttgggacngagttcacttctcaccgatcagcancctgcngcctgaagntgttgcaactttatacttgtactaaagtattctactttgcccccatccaccgttcggcccaagggtacccacgtaactcggaagacttaaacgcgttaacgg

SEQ ID NO: 56399 - DNA, 499 bp, Homo sapiens
  misc_feature: GYAE6OF01AP8GQ.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcaggcattaacaattattagcctggtatcagcagcatccagggaaagttccaagctcctgatctatgctgcatccactttgcaatcagggtccatctcggttcagtggcggtggatagtgggacagagttcacgttctcacatcagcagcctgcagcctgaagatgttagactaacttattactagtacaaagtactctacttcgacccctatcctaccttccggccaagggacacgtacgtaggaagtaacgttaaacgtacgtacgg

SEQ ID NO: 56400 - DNA, 528 bp, Homo sapiens
  misc_feature: GYAE6OF01AUCN5.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattattagcctggtatcagcagcatccagggaagttcctaagctcctgatctatgctgcatccactttgcaatcaggggtcccatctcggttcagtggcggtggatagtgggacagagttcactctcaccatcagcagcctgcagcctgaacgtattcgttagacctaatttacttacttgtactaaaagttactactacctttcgaccccctatccgtaccctttcggacccgtaacgggacaacccggtacgtacgggaagtaacttaaacgtaacgttacggg

SEQ ID NO: 56401 - DNA, 523 bp, Homo sapiens
  misc_feature: GYAE6OF01EK73J.29.87.H10.1.454.CMB.1.raw
  modified_base (401)..(401): a, c, t, g, unknown or other
  misc_feature (401)..(401): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattattagcctggtatcagcagcatccagggaaagttcctaagctcctgatctatgctgcatccactttgcaatcagggtcccatctcggttcagtgcggtggatagtgggacagagttcactctcaccatcagcacgcctgcagcctgaagatgtanctaacttattactgtacaaagtatctactttcgaccccctagttacccacccgttccggacccgaaacgggaccctaaaccggtacgtagggaacgtaacgtttaaaaccgaacgttacggg

SEQ ID NO: 56402 - DNA, 514 bp, Homo sapiens
  misc_feature: GYAE6OF01D6GKH.29.87.H10.1.454.CMB.1.raw
  modified_base (397)..(397): a, c, t, g, unknown or other
  misc_feature (397)..(397): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcagggtcccatctcggttcagtggcggtggatagtgggacagagttcactctcaccatcagcagcctgcagcctgaagntgttagctaacttattactgtacaaagtatactactttcgacccctactcctacccttccggacccgaaacgggaccaacgtacgtacgggaagtaacgttaaacgaacgttacggg

SEQ ID NO: 56403 - DNA, 515 bp, Homo sapiens
  misc_feature: GYAE6OF01CI0B9.29.87.H10.1.454.CMB.1.raw
  modified_base (397)..(397): a, c, t, g, unknown or other
  misc_feature (397)..(397): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattattagcctggtatcagcagcatccagggaaagttcctaaagctcctgatctatgctgcatcactttgcaatcagggtccatctcggtcagtggcggtggatagtgggacagtagttcgactcgtcacatcagcagcctgcagcctagaacgntgttagctaactttattacttagtactaaagtactactacttccgaccccctagtccctaccgttaccggccaaacgggacctaacgacgtaggaacgaacttaaacgacgttacggg

SEQ ID NO: 56404 - DNA, 476 bp, Homo sapiens
  misc_feature: GYAE6OF01B0TG2.29.87.H10.1.454.CMB.1.raw
  modified_base (201)..(201): a, c, t, g, unknown or other
  misc_feature (201)..(201): n is a, c, g, or t
  modified_base (465)..(465): a, c, t, g, unknown or other
  misc_feature (465)..(465): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccagggaaagttcctaagctcctgatctatgctgcatccactttgcaatcagggtcccatctcggttcagtggcggtgatatgggacagagttcactctcaccatcagcagcctgcagcctgaagatgttgctaacttattactgtacaaagtatctacttcgacccctatcaccttcggccaggacacgactganactaagatagg

SEQ ID NO: 56405 - DNA, 502 bp, Homo sapiens
  misc_feature: GYAE6OF01EEO81.29.87.H10.1.454.CMB.1.raw
  modified_base (387)..(387): a, c, t, g, unknown or other
  misc_feature (387)..(387): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattattagcctggtatcagcagcatccagggaaagttcctaagctcctgatctatgctgcatccactttgcaatcagggtccatctcggttcagtggcggtggatagtgggacagtagttcactctcaccatcagcagcctgcngcctgaagatgttgacaacttattactgtacaaagtatactactttcgacccctactcctaccgttcggaccaacgggacaccggtactacggaagaacttaaacgacttacggg

SEQ ID NO: 56406 - DNA, 679 bp, Homo sapiens
  misc_feature: GYAE6OF01C06GX.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtcctccatcctccctgtctgcatctggtgggagacagagtcaacgtcacttggccgggcgagtcagggcattaacaattatttagcctggtatcagcagcatccgaggaaagttcctaagctcctgatctatgctgctactcctactttgacctaagtacgacggggtccctaacgttccgttcggtttcgaggttcgggtcgggttaggtaagtaggtggggaacgtaggtacgtttacctacgttacctaccgtaccctaagtaccgaacgtaccgacgtcccgtcgaccacggtacccgtacggtaagtacgttacgtttacggtaaccttaaacgtttaacgtttaaccgttacgttaaaccttaaaggttaaccttaccgttaacctttcccgtaccccccgtaattaccccgtaaccgtttacccggacccgtaaacggggtaaccaccgggtaaaccgtacgggtaaaggtaaacgttaaaaaccggtaacgtttaacgggg

SEQ ID NO: 56407 - DNA, 823 bp, Homo sapiens
  misc_feature: GYAE6OF01DEHCB.29.87.H10.1.454.CMB.1.raw
tcagatagagtactcacgaccggtgctcgatttagcagtactgcgttgggtttggggcagaagtctctctcagtccagacacagcatggacatgacgggccccgctcagcctccgtgggacctcctgctgctctggcctcccagataccagatgtgacactccagatccgaccctatcctacctacttccctccgtgtctcgtactactcgtgggtagggacgaacgagtacgtaccaacgttccgtacggttccgggaccgggtacgtacggtacggaacgggtacttaaacttaaacttaagttttacgtacgtccgttaggtactacgacgtccaagtacgtaacgtaccggtaaaggttaaccgtttaccgtaacgtccttaccgtagtactttactacgtcgtacctacgtaccttacgttacccgtacgtttacgaaccgttaacggtcccggtaacccgggttacccttacggtttccgggttaccggttaggtacggggtcgggttacgggtaagttaacggttacgggtaacgggtaaccgtaaggttacccgttacctacccgttacctacccgtaaccgtacgtacgaaccgacccgtcgtccgtacggaccgtacgtaccgtaagtacttacggtttaacgtacttaaaccgtttagttaacttaccgttaaagtaaccttaacgtttcctaaccgttaccccgtacccgtaacccgttaccgtacccggttaaccccggtaccggaaaccggaaaccggtacgtaaccgggttacgtaaaggttaaaccgttaacgtaaccgtgtaccgg

SEQ ID NO: 56408 - DNA, 493 bp, Homo sapiens
  misc_feature: GYAE6OF01EQ6Q5.29.87.H10.1.454.CMB.1.raw
  modified_base (199)..(199): a, c, t, g, unknown or other
  misc_feature (199)..(199): n is a, c, g, or t
tcagatagagtactcacgaccggtgctcgatttagcagtactgcgttgggtttgggggcagaagtctctctcagtccagacacagcatggacatgagggccccgctcagctcctgggactcctgctgctctggctcccagataccagatgtgacatccagatgacccagtctccatcctcctgtctgcatctgtggganacagagtcaacgtcacttgccgggcagtcagggcattaacaattattagcctggtatcagcagcatccagggaagttcctaagctcctgatctatgctgcatccactttgcaatcagggtccatctcggttcagtggcgtgatatgggacagagttcactctcaccatcagcagcctgcagcctagaagatgttagactaacttattactgtactaaagtatctactttcgaccccctatcctaccttcggccaacgggacaacgtactaggaagtaacttaaacgacgtacgg

SEQ ID NO: 56409 - DNA, 775 bp, Homo sapiens
  misc_feature: GYAE6OF01C5DI2.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctcggcctcccagactaccagatgtgacatccagatgacccagtctccatcctccctgtctgcatctgtggganacagagtcaacgtcacttggccgggcgagtcagggcaattaactaattatttagcctggtatcagcagcataccgaagggtaaacgttcctaagctcctgtatctatgctgctatcctactttgactaaacttccgacgggtccctagttccgtcggtttcacggttcgggtcggtaggtaagtaggttacgggaccgtaaggtacggtttaccaaccttccgtactaaccctattaccgaacggacccaacggtcccgtacggacccgtacggtacccgtaaggtaaaccgtaagtttcggtttaaccggtaaccgtttaaaacccttttagtttaaacccgttagggttaaaacccttaaaaaacgggtttcctttacccgttaaacccttttacccccggtaacccccccttaaaccggtttaacccccgttaaacccggttttaccccggggaaacccccggttaaaacgggggaaaccccgttaaaacccgggtaaccccggttaaaggggttaaaacccgttaaaaccggtttaaaaaacccggtaacccgggttttaaccggg

SEQ ID NO: 56410 - DNA, 554 bp, Homo sapiens
  misc_feature: GYAE6OF01BJ1I3.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggnagtcaggcattaacaattattagcctggtatcagcagcatccgaagggaaacttcctaagcctcctgatctatgctgcatcctactttgactaagtcgacggggtcccaacgttcgtcggtttcgaggtgggcggttggtaagtagtgggacaggtacgtctactctcaacatcagcacgcctgcagctagaagtatgttcgtactaactttacttactacgttaactaaagttctaccgtactttccgaccccctattcctaacccgttcggacccgtaacgggaccacgtacgtacgggaaagtaacgttaaacgaacgttacggg

SEQ ID NO: 56411 - DNA, 499 bp, Homo sapiens
  misc_feature: GYAE6OF01DGATG.29.87.H10.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggngagtcaggcattaacaattatttagcctggtatcagcagcatccagggaaagttcctaagctcctgatctatgctgcatccactttgcaatcagggtccatctcggttcagtggcggtgatagtgggacagagttcactctcaccatcagcagcctgcagcctagagatgttgactaacttattactgtactaaagtatactacttcgcccctatccaccgtttcggaccgaacgggacaacgtactaggagtaacttaaacgaagtacggg

SEQ ID NO: 56412 - DNA, 564 bp, Homo sapiens
  misc_feature: GYAE6OF01AVQKW.29.87.H10.1.454.CMB.1.raw
  modified_base (204)..(204): a, c, t, g, unknown or other
  misc_feature (204)..(204): n is a, c, g, or t
  modified_base (324)..(324): a, c, t, g, unknown or other
  misc_feature (324)..(324): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
tcagatagagtactcacgaccggtgctcgatttagcagtactgcgttgggttgggggtcagaagtcgtctcgtcaggtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcagtcgaggcattacattattagctgtatcagcagcatccgagggtaattccaagctctgatctatgctgcatcctatttgctaatcgacggtccntcgtacggttcagtggcggttagatagtggacagtagttcactntcacatcagcagtcngcagctagagtntgttacgactaacttattacgtattaacaaaagttcctacgttaccgtttccgacccccttaacgttaccccgtaccggtttacccgggaaacccgtaaacgggtaaccccgtaacgtaaccggttaacgggtaacgtttaaaccgttaaaacggttaccggtaacggg

SEQ ID NO: 56413 - DNA, 489 bp, Homo sapiens
  misc_feature: GYAE6OF01AQ726.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccaggggaaagttcctaaagctcctgatctatgctgcatccactttgcaatcaggggtcccatctcggttcagtggcggtggatatggggacagagttcactctcaccatcagcagcctgcagcctgaagatgttgcaactttattactgtacaaagtatcactttcgcccccatccaccttcggccaacgggacacgactggagacttaaacgaactgg

SEQ ID NO: 56414 - DNA, 502 bp, Homo sapiens
  misc_feature: GYAE6OF01EECEL.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (426)..(426): a, c, t, g, unknown or other
  misc_feature (426)..(426): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggngagtcaggcattaacaattattagcctggtatcagcagcatccagggaagttcctaagctcctgatctatgctgcatccactttgcaatcagggtccatctcggtcagtggcggtgatatgggacagagttcactctcacatcagcagcctgcagcctagaacgtatgttacgactaactttattactagtaacaaagtntactacttcgacccctatcctacttcggaccgaacgggacaacggtactaggaagtaacgttaaacgaagttacgg

SEQ ID NO: 56415 - DNA, 519 bp, Homo sapiens
  misc_feature: GYAE6OF01BI355.29.87.H10.1.454.CMB.1.raw
  modified_base (201)..(201): a, c, t, g, unknown or other
  misc_feature (201)..(201): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcaggcattaacaattatttagcctggtatcagcagcatccagggaaagttcctaagctcctgatctatgctgcatccactttgcaatcagggtccatctcggtcagtggcggtggatagtgggacagtagttcactctcaccatcagcagcctgcagcctagaagtntgttanactaactttattacttagtacaaagtactactactttacgcccctataccctaccgttaccggccaaacgggaccaaccggtacgtagggaagtaacgttaaaacgacgttacggg

SEQ ID NO: 56416 - DNA, 492 bp, Homo sapiens
  misc_feature: GYAE6OF01A25HJ.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (426)..(426): a, c, t, g, unknown or other
  misc_feature (426)..(426): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggnagtcagggcattaacaattatttagcctggtatcagcagcatccagggaaagttcctaagctcctgatctatgctgcatccactttgcaatcaggggtcccatctcggttcagtggcggtggatagtgggacagagttcactctcaccatcagcagcctgcagcctgaagatgttgactacttattactgttacaaagtntacctactttacgccccctagtcctaccttcggccaacggacacgactggagacttaacgactcgg

SEQ ID NO: 56417 - DNA, 488 bp, Homo sapiens
  misc_feature: GYAE6OF01EVQ04.29.87.H10.1.454.CMB.1.raw
  modified_base (201)..(201): a, c, t, g, unknown or other
  misc_feature (201)..(201): n is a, c, g, or t
  modified_base (394)..(394): a, c, t, g, unknown or other
  misc_feature (394)..(394): n is a, c, g, or t
  modified_base (425)..(425): a, c, t, g, unknown or other
  misc_feature (425)..(425): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcagtcagggcattaacaattatttagcctggtatcagcagcatccaggggaaattcctaagctcctgatctatgctgcatccactttgcaatcagggtccatctcgttcagtggcggtgatagtgggacagtagttcactctcaccatcagcagcctgcagcctgaagntgttgactaacttattactagtacaaaagtntctactttcgacccctatcctacttcggccaagggacacgtactggaagacttaaagagtcgg

SEQ ID NO: 56418 - DNA, 504 bp, Homo sapiens
  misc_feature: GYAE6OF01AW5QX.29.87.H10.1.454.CMB.1.raw
  modified_base (399)..(399): a, c, t, g, unknown or other
  misc_feature (399)..(399): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattattagcctggtatcagcagcatccagggaaagttcctaagctcctgatctatgctgcatccactttgcaatcaggggtcccatctcggttcagtggcggtggatatggggacaggtagttcactctcaccatcagcagcctgcagcctagaagntgttacgactaacttattactgtactaaagtatctactttcgcccctatcctaccttcggccgaacgggacacgtacgtaggaagtacttaaacgacgttacggg

SEQ ID NO: 56419 - DNA, 505 bp, Homo sapiens
  misc_feature: GYAE6OF01EGPHM.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcaggcattaacaattatttagcctggtatcagcagcatccagggaaagttcctaagctcctgatctatgctgcatccactttgcaatcaggggtcccatctcggttcagtggcggtggatagtgggacaggagttcactctcaccatcagcagcctgcagcctgaagatgttgcaacgtttattacttgtacaaagttatctactttcgccccctactcctaccttcggcccaaacgggacacggtactaggaagaacttaaacgaacttacggg

SEQ ID NO: 56420 - DNA, 537 bp, Homo sapiens
  misc_feature: GYAE6OF01DGJDL.29.87.H10.1.454.CMB.1.raw
  modified_base (206)..(206): a, c, t, g, unknown or other
  misc_feature (206)..(206): n is a, c, g, or t
  modified_base (444)..(444): a, c, t, g, unknown or other
  misc_feature (444)..(444): n is a, c, g, or t
  modified_base (532)..(532): a, c, t, g, unknown or other
  misc_feature (532)..(532): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatgacccagtcctccatccctccctgtctgcatcgtggtggganacagagtcaacgtcacgttggccgggcgagtcgagggcaagttaaacaattatttagccttggtatcagcagcatccgaagggtaaacgttcctaagcctcctgactctatgctgctactcctatttgactaagtcgacgggtcccattcgtcggttcaggtcgggcggtggataggtacgggactaggtacgttccactctacaccatcagcagcctagcagcctagagtagtgtanacttaattatacttagtaactaaagtctactacttccgaccccatcctaccgttcggaccaacggacacgactaggataacgtaaagngtcgg

SEQ ID NO: 56421 - DNA, 510 bp, Homo sapiens
  misc_feature: GYAE6OF01EVQSF.29.87.H10.1.454.CMB.1.raw
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattattagcctggtatcagcagcatccgagggaaagttcctaagctcctgatctatgctgcatcctactttgcaatcgagggtcccatctcggttcagtggcggtggatagtgggacagtagttcactcgtcaccatcagcagcctgcagctagagatgtnctacttatactagtacaaagtatctacttccgacccctactcctaccgttcggacccgaacgggtaccaccgtacgtaggaacgtaacttaaaccgaagttacggg

SEQ ID NO: 56422 - DNA, 694 bp, Homo sapiens
  misc_feature: GYAE6OF01CMQ7D.29.87.H10.1.454.CMB.1.raw
  modified_base (174)..(174): a, c, t, g, unknown or other
  misc_feature (174)..(174): n is a, c, g, or t
  modified_base (207)..(207): a, c, t, g, unknown or other
  misc_feature (207)..(207): n is a, c, g, or t
tcagatagagtactcacgaccggtgctcgatttagcagtactgcgttgggtttggggcaagaagtctctctcagtaccagaccacgagcatggacatgacggcccccgctcagctcctgggactcctgctgctctggctcccagataccagatgtcgacatccagatgaacccngtctccatcctcctgtctgcatcgtgtaggganacagagtcaacgtcacgttgccggctagtcaggcattaactaattattagctgtatcagcagcataccgaaggtaacgttctaagctctgtactctatgctcgacactctactttacgactaagttccgaacggggtccctaacgtccgtaccggttacaacggttacgggtaccggttacggtaagttaaggtacgggtaacgtaagttaacggttacctaacggtaccttacccgaaacctaacgttaccgtaacgaccgttaacggacccgttacggtacgaaccggtacccgtaggtaaacgtacgtttacgttacgtacgtaaaccgttacgtttaactacgtttaaacgtaaaaccgtttaactaccttaacccttaccgttacccccttaaccgttacccgtacccgtttaccggaccgtaaccggtaccgtaacggtaccgtaacggtaacgtaaccgttaaaaccgtaacgttaccgg

SEQ ID NO: 56423 - DNA, 534 bp, Homo sapiens
  misc_feature: GYAE6OF01BJQGO.29.87.H10.1.454.CMB.1.raw
  modified_base (201)..(201): a, c, t, g, unknown or other
  misc_feature (201)..(201): n is a, c, g, or t
  modified_base (402)..(402): a, c, t, g, unknown or other
  misc_feature (402)..(402): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcgaggcattaacaattatttagcctggtatcagcagcatccagggaaagttcctaagctcctgatctatgctgcatcctactttgcaatcgagggtcccatctcggttcagtggcggtggatagtgggacaggtagttcactctcaccatcagcacgcctgcagctgaagtntgttgactaactttacttacttacgtaactaaagtatacctactttccgaccccctacgtccctacccgttaccggacccgaaacgggtaccaaccgtacgtacggaagtaacttaaaaccggaagttacgg

SEQ ID NO: 56424 - DNA, 501 bp, Homo sapiens
  misc_feature: GYAE6OF01BSN8K.29.87.H10.1.454.CMB.1.raw
  modified_base (404)..(404): a, c, t, g, unknown or other
  misc_feature (404)..(404): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcagggtcccatctcggttcagtggcggtggatagtgggacagagttcactctcaccatcagcacgcctgcacgctagaagatgttnactaacttattactgtactaaagttatctactttcgcccctatcctaccttcggccaacgggacacgtacgtaggataacgttaaacgaacgtacgg

SEQ ID NO: 56425 - DNA, 488 bp, Homo sapiens
  misc_feature: GYAE6OF01E3PYG.29.87.H10.1.454.CMB.1.raw
  modified_base (201)..(201): a, c, t, g, unknown or other
  misc_feature (201)..(201): n is a, c, g, or t
  modified_base (422)..(422): a, c, t, g, unknown or other
  misc_feature (422)..(422): n is a, c, g, or t
  modified_base (472)..(472): a, c, t, g, unknown or other
  misc_feature (472)..(472): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcaggcattaacaattatttagcctggtatcagcagcatccagggaaagttccaagctccctgatctatgctgcatccactttgcaatcagggtcccatctcggtcagtgcggtggatatgggacagagttcactctcaccatcagcagcctgcagcctgaagatgttagctaacttattactgtacaaagtntctacctttcgacccccatccacccttcggcccaaggacacgactggaanattaaacgacttacgg

SEQ ID NO: 56426 - DNA, 574 bp, Homo sapiens
  misc_feature: GYAE6OF01DQQXG.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctgtggganacagagtcaacgtcacttggccgggcgagtcgagggctattaacaattattagcctggtatcagcagcagtaccgaagggaaagttccgtaagcgtacctgaatctatgctgctatcctactttgactaagtccgacgggtccctaagttccgtcggttcaggtcggcggtagtatagtgggaactagtagttccactctacaccatacagcagcctgacgacgtcctagaagtagttagttcgaactaacttattacgtagttaactaaatcgtactaccgttaccgtcccctagtccctaccgttaccggaccgaaacgggtacaaccggtacgtacggaaaggttaacgttaaaaccgtacgttacggg

SEQ ID NO: 56427 - DNA, 756 bp, Homo sapiens
  misc_feature: GYAE6OF01CROAY.29.87.H10.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagatcaacgtcacttgccgggngagtcgaggcattaacattattagcctggtatcagcagcataccgaagggtaaacgttacctaagcctcctgtactctatcgctgactactcctactttcgactaacgtcgtacggggtccctagttcccggttacggtttcgtagggttcggggtacgggttagggtaagttaacgggtcggggtaacgtacgggttacggtttaccctaaccgtttacccttacccgtaacccgtaagttacccgaacggtacccgtaacgggtccccttacgggaccctaacggtacccgttaaggtaaacggtcgtttaacggtttacggaaccctttaaacgtttacgtttaaccgtttaacggttaaacctaaaagttaccgttaaccttaacccgtttaccccgtacccccttaacgtttaccccgtaaccccggtttacccgggtaaaccccggtaaacggggtaaccccgttaacggtaacccggttaagggaaaccgttaaaacggttaaacccggtaacggtttaccggg

SEQ ID NO: 56428 - DNA, 538 bp, Homo sapiens
  misc_feature: GYAE6OF01EL1UZ.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcgagggcattaacaattatttagcctggtatcagcagcatccaagggaaagttcctaagctcctgatctatgctgcatcctactttgcaatcgacggggtcccatcgtcggttcaggtggcggtggatagtgggacagtagttcactctcaccatcagcacgcctgcagcctagaagtattgttacgactaactttattacttagtaactaaagttctactactttccgacccctatcctacccgttccggacccgaaacgggaccaaccggtacgtagggaagtaacgttaaaccgacgttacggg

SEQ ID NO: 56429 - DNA, 517 bp, Homo sapiens
  misc_feature: GYAE6OF01EEDFA.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggngagtcaggcattaacaattatttagcctggtatcagcagcatccagggaaagttcctaagctcctgatctatgctgcatccactttgctaatcgaggggtcccatctcggttcagtggcggtggatagtgggacagagttcactctcaccatcagcacgcctgcacgcctagagtatgttacactaacttattactagtaactaaagttactactactttccgacccctatcctaccgttcggccgaaacgggaccacgtacgtaggaagtaacgttaaacgagttacggg

SEQ ID NO: 56430 - DNA, 645 bp, Homo sapiens
  misc_feature: GYAE6OF01D6XZP.29.87.H10.1.454.CMB.1.raw
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggagacagagtcaacgtcacttggccgggngagtcgagggcaattaacaattattacgcctaggtatcagcagctacgtaccgaagggtaaacgtttccgtaaagccttcctagacttctaagtcgctgcactcctactttgactaacgtccgtacgggttccctcgttccgggttctagggtcgggtccggttaggtaatacggtcgggaacctaggtaacgttcaccgttctaccgtaacctagtaccgaagccacgtcctgaccacgtccgtagaacgtagttacgttacgtaactaacgtttaagttaaccgttacgtaactaaacgttacttaccttaaccgtttccgaccccctagttacccgtaacccggttaccggaaccgtaacgggaacctacggtaaccgtacggaaacgtaacgttaaaccggacgttggtaaccgg

SEQ ID NO: 56431 - DNA, 527 bp, Homo sapiens
  misc_feature: GYAE6OF01DI3EU.29.87.H10.1.454.CMB.1.raw
  modified_base (201)..(201): a, c, t, g, unknown or other
  misc_feature (201)..(201): n is a, c, g, or t
  modified_base (354)..(354): a, c, t, g, unknown or other
  misc_feature (354)..(354): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcagtcaggcattaacaattattagcctggtatcagcagcatccaggtaaagttcctaagctcctgatctatgctgcatcactttgcaatcagggtccatctcgttcagtgcggtggatagtgggacagngttcactctcaccatcaagcagcctgcagcctagaacgtattgttcgactaactttattaacgtagttaacaaagtactacctactttacgccccctaagtcctaaccctttacgggaccgaaacggggaccaacggtaacgtaagggagtaaataaaacggtaacgttaggg

SEQ ID NO: 56432 - DNA, 518 bp, Homo sapiens
  misc_feature: GYAE6OF01A024V.29.87.H10.1.454.CMB.1.raw
  modified_base (408)..(408): a, c, t, g, unknown or other
  misc_feature (408)..(408): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttggccgggcgagtcgagggcattaacaattattagcctggtatcagcagcatccgaagggtaaagttcctaagctcctagatctatgctgcatccactttgcaatcgacgggtccatctcggttcagtggcggtggatagtgggacaggtagttcactcgtcacctatcagcacgcctgcagcctgaagntgttgactaacttattacttagtaacaaagtctactactttccgacccctatcctaccgtccggaccaacgggacaacggtactaggaataacgttaaacgacgttacgg

SEQ ID NO: 56433 - DNA, 551 bp, Homo sapiens
  misc_feature: GYAE6OF01BVDVG.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcagggcattaacaattattagcctggtatcagcagcatccgaagggaaacgttcctaagctcctgatctatgctgctatcctactttgactaactcgacgggtccctagtccgtcggttcgtaggtggtcggtaggagtagtagggactagtagttcactctcaccatcagcacgcctgcacgcctagaagtatcgtagactaactttacttactagtactaaagtactactaccttccgacccctagtccgtaccgttaccggaccgaacggtaaccgacgtacgtacggtaagtaacgttaaacggtaacgttacggg

SEQ ID NO: 56434 - DNA, 551 bp, Homo sapiens
  misc_feature: GYAE6OF01B9YPR.29.87.H10.1.454.CMB.1.raw
  modified_base (200)..(200): a, c, t, g, unknown or other
  misc_feature (200)..(200): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctgtggganacagagtcaacgtcacttggccgggcagtcgagggcaattaacaattatttagcctggtatcagcagcatccgaagggaaacgttcctaagctcctgtatctatgctgcactccactttgactaatcgacgggtcccagtctcggttcaggtggcggtggatagtgggacagtacgttctactctacacatacagcagcctgcacgcctagaacgtagttgttacgactaactttattacttagtaacgtaaagttacttactacctttaccgaccccctatccctaccgttaccggaccgtaacgggaaccaacgtacgtacggaagtaacgttaaacgaacgttacggg

SEQ ID NO: 56435 - DNA, 880 bp, Homo sapiens
  misc_feature: GYAE6OF01ELGKY.29.87.H10.1.454.CMB.1.raw
tcagatagagtactcacgaccggtgctcgatttagcagtactgcgttgggtttgggggcagagtctctctcagtccagacacagcatggacgactgacggccccgctccaggcctcctgggactcctgcgtgcctcgtggcctcccagataccagatcgtgacatcccagactcgacccacgtcctcactccctccctgtctgcgatcgtggtggacacagtacgtaccaacggtccgacttaggcccgggacgagtccgaagggtactaacttaaactaattttaagtttaacggtccgttaggttaactacgtaaggaaccgaaacggtaccgtaaacgttaaccccggtaaaagggggtaaacccgttttacccgtaaacgggtccttacccgtaggtaccttaccttaacgttacgtaccgttacggtaccgtaacgttacccggttaaccggttttaccgaacgttaaaccggttacccgggttaacgggggtcccccttaaggttcccggtttacgggttaccgtaagggttcgggtacggggtaggtaagtttacggttaccggggaactaacggtaccgtttaccaccgttaccgtacctaaaccctacgttccgaaccggtaccctacggttaccccttaggtacccgttaacgtacccgtttaaagtaacgttacgtttaccggttaacgaaacccgttaaacgtttttaacgttaaccgttaacggttaaacccgttaaaaggttaccctttaccggttaaacccgtttcccgggaaccccttaaggttaccccgtaccggttaccggaaaccgtaaccgggaaacctacggttacgtaacggaacttaaccgtaaaccgtcgtacggg

SEQ ID NO: 56436 - DNA, 564 bp, Homo sapiens
  misc_feature: GYAE6OF01CB5VR.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttgccgggcgagtcagggcattaacaattattagcctggtatcagcagcatccgagggaaacgttcctaagctcctgatctatgctgcatccactttgacaatcgacgggtcccatcctcggttcgagtggcggtggatagtgggactagagtcatctcaccatacagcagccctgcacgcctaggaacgtattagtgtacctaactttacttaacgttacgtaactaaacgttacttaccttacgtttccgtaccccctacgttcctacccgtttaccggacccgaaaccgggaacctaaccggtacgtacgggtaaagtaacgttaaaacggtacgttaacggg

SEQ ID NO: 56437 - DNA, 536 bp, Homo sapiens
  misc_feature: GYAE6OF01EGNOS.29.87.H10.1.454.CMB.1.raw
  modified_base (202)..(202): a, c, t, g, unknown or other
  misc_feature (202)..(202): n is a, c, g, or t
  modified_base (419)..(419): a, c, t, g, unknown or other
  misc_feature (419)..(419): n is a, c, g, or t
tcagatagagtactcacgaccggtgctcgatttagcagtactgcgttgggtttgggggcagaagtctctctcagtccagacacagcatggacatgacgggcccccgctcagcctcctgggactcctgctgctctggctcccagataccagatgtgacatccagatgacccagtctccatcctccctgtctgcatctgtgganacagagtcaacgtcacttggccgggcagtcgaggcattaacaatttattagcctggtatcagcagcatcagggaagttccaagctcctgactctatgctgcatcctactttgacaagtcgacgggtcccattccgtcggttcaggtgggtcggtaggtactagtgggactagtacgttcacgtctacaccatcacgcacgcctgcagcctagaagtntagttcgactaactttattactagttaacaaagttctacctactttccgacccctatccgtaccgttccggaccgtaacggaccaacggtacgtaggaataacgttaacgcgtacgg

SEQ ID NO: 56438 - DNA, 505 bp, Homo sapiens
  misc_feature: GYAE6OF01B7FVB.29.87.H10.1.454.CMB.1.raw
  modified_base (201)..(201): a, c, t, g, unknown or other
  misc_feature (201)..(201): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccgagggaaagttcctaagctctgatctatgctgcatccatttgcaatcgacgggtccatctcggttcaggtggcggtgatagtgggacagagttcactctcaccatcagcagcctgcngcctagaanatgtnactaacttatactgtacaaagtctctactttccgacccctatcctaccttccggaccgaaacgggacaccggtacgtggaaataacgttaaacgacgttacgg

SEQ ID NO: 56439 - DNA, 561 bp, Homo sapiens
  misc_feature: GYAE6OF01BX0KL.29.87.H10.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctgtggganacagagtcaacgtcacttggccgggngagtcaggcattaacaattattagcctggtatcagcagcatccaagggtaaagttcctaagctcctgatctatgctgctatccactttgcaatcgacgggtccctatcgtcggttcaggtggcggtggattagtgggacagtacgttcaactctacaccatcagcagcctgcacgccgtagaagtattcgttagaccgtaactttacttacttacgttaacaaaagttacttccgttaacctttccgaccccctatccctacccgttaccgggtacccaaagggtacccaaccggtaactacgggtaagtaaacgttaaaccgaagttacggg

SEQ ID NO: 56440 - DNA, 537 bp, Homo sapiens
  misc_feature: GYAE6OF01CWQCY.29.87.H10.1.454.CMB.1.raw
  modified_base (227)..(227): a, c, t, g, unknown or other
  misc_feature (227)..(227): n is a, c, g, or t
  modified_base (415)..(415): a, c, t, g, unknown or other
  misc_feature (415)..(415): n is a, c, g, or t
tcagatagagtactcacgaccggtgctcgatttagcagtactgcgttgggtttgggggcagaagtctctctcagtccagacacagcacggacatgagggcccccgctcagctcctgggactcctgctgctctggctcccagataccagatgtgacatccagatgacccagtctccatcctccctgtctgcatctgtgggagacagagtcaacgtcacttggccgggngagtcagggcattaacaattattagcctggtatcagcagcatccgagggaaacttcctaagctcctgatctatgctgcatcctactttgctaagtcgaggggtcccatcttcggttcaggtggcggtggtatagtgggacaggtagttcactctcacctatcagccagcctgcacgccgtagaacgtnttgttacgactaactttattacgttagtaactaaagtctactacctttccgacccctatcctaccgttcggaccgtaacgggaccacgtacgtaggaacgtaattaaacgtagtcggtacgg

SEQ ID NO: 56441 - DNA, 671 bp, Homo sapiens
  misc_feature: GYAE6OF01ATLGU.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcactccgaagggtaacttacctaagccttccgtagactctatgctgctactcctactttcgacaatcggtaccggggtccctagttccgttcggttacgaggtcgggtcggtggtataggtacggggacgtagtacgttacctacttcctaccaacctactaccgaagccgaacgtcccgtcgaccgaccgtaccgtaggaacgtagttcggtttacgaaccttaaacgttttaacttaacgttacgtaaaccgtaaaagttaccttaccttaccgttttcccgaccccccttaacgttaccccgttaccccgttacccgggaacccgtaaaccggggtaacccaaccgggttaaccggtacgggtaaacgttaaaccgtttaaaaccggtaaccgtttacgggg

SEQ ID NO: 56442 - DNA, 619 bp, Homo sapiens
  misc_feature: GYAE6OF01EMTRE.29.87.H10.1.454.CMB.1.raw
  modified_base (203)..(203): a, c, t, g, unknown or other
  misc_feature (203)..(203): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacgtccagttgacccagtctccatcctccctgtctgcatcgtggtggganacagacgtccaccctcacgttggccgggacaagtccaggcctatttccaatttcctttagccttggtatcagcaagaaaccaggaaccaaacctcctacactcctagatctatgatcgcgtactagttagagtacggtcgggaccctagtcgacggttcgacggcggacgaggtaggacgtcgagggacagtacgttcactctcacatcagtacacgtcctgacgtacgccgtagtaacgttatttacgacttaactttattacgtacgttacctaaccttaactttaacctaacttaccctactaacgtacgtacccggttaccggaacccgtaacggggtacccgtaagggtaaccggaaaaccctaacggaaccggtaacgttcggtacggaccttacgaccgacccgttacg

SEQ ID NO: 56443 - DNA, 494 bp, Homo sapiens
  misc_feature: GYAE6OF01DFU9Y.29.87.H10.1.454.CMB.1.raw
  modified_base (481)..(481): a, c, t, g, unknown or other
  misc_feature (481)..(481): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttggccgggcgagtcagggcattaacaattatttagcctggtatcagcagcatccagggaaagttcctaagctcctgatctatgctgcatccactttgcaatcgagggtcccatctcggttcagtggcggtggatagtgggacagagttcactctcaccatcagcagccctgcagcctagaacgtatgttgactaactttattactagtacaaagtctactacttcgccccatccaccttcggccaagggacacgtactagganaactaagagtcgg

SEQ ID NO: 56444 - DNA, 574 bp, Homo sapiens
  misc_feature: GYAE6OF01C5ORM.29.87.H10.1.454.CMB.1.raw
tcagatagagtactcacgaccggtgctcgatttagcagtactgcgttgggtttgggggcataagtctctctcagtccagacacagcatggacatgagggcccccgctcagctcctggggctcctgctgctctggctcccaggtgccagatgtgccatccagttgacccagtctccattcttccctgtctgcatctgtaggagacagagtctccatcacttgccgggcagtcaggcattagaagttatttagccttggtttcagcaagaaaccagggaaacacccctaaactcctgactctacgctgcactccacttgcacgaggtcgggtccctgtaggttcaggcggcaggcggatcgtaggacagtattcactctcaccatcagcacgcctgcacgcctagaagtatgttacgaccttaaactttacttacttagtacaacgtagtactttaacgtaaccgttaaccccgtccgttaaccttacgttttacggaccgtaacgggggtaaccctaagggtacggaacgaacgttaaccgaaaacggtacgtaggtacggactcgccgtaaccg

SEQ ID NO: 56445 - DNA, 830 bp, Homo sapiens
  misc_feature: GYAE6OF01C1YMH.29.87.H10.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatcgacccagtcctccatccctccctgtctgcatcgtggnggganacagagtcaacgtcacgttcggccgggcgtagtacggaggtactaattaactatttagttacgtcgttagtactacgacgacgaacgtacgtaacgtaaccggggtaaaggttaaaccgttaccgtaacgtcccgttaccgtagtacttacgttagtaccggtacttacgtaaccttacccgttacctttaacgtttacgaaacccgttaacgggttaccccggggttaacccgggttacccttaccggtttacccgggtttaccgggttaaccgggtaggggttacgggggttaccgggttaggttaaacggtacggggtacgggtaacgttaaccggttaccgttaaccctacccttacgtaacccgtaaccgtacgtaccgacgtaccgtaccgtccgtacgaccgtacgtaccgtaaggtacgtttacgttaccgtaacgttaacctttaacgtttaagttaccgttaaacgttaaacgttaacgttaccttacccgtttaaccccgtccctaacccgttaccgttaaccccgttacggtaaccccggaaacggttaaccgaccggttaaacgtccgggtaaacgtaaaccgtttaaccggtaaaggtttcgtacgggg

SEQ ID NO: 56446 - DNA, 544 bp, Homo sapiens
  misc_feature: GYAE6OF01EJO7U.29.87.H10.1.454.CMB.1.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (536)..(536): a, c, t, g, unknown or other
  misc_feature (536)..(536): n is a, c, g, or t
tcagatagagtactcacgaccggtgctcgatttagcagtactgcgttgggtttgggggcagaagtctctctcagtccagacacagcatggacatgagggccccccgctcagcctcctgggactcctgctgctctggctcccagataccagatgtgacatccagatgacccagtcctccatcctccctgtctgcatctgtggganacagagtcaacgtcacttggccgggngagtcgaggcattaacaattattagcctggtatcagcagcatccgagggtaaagttcctaagctcctgactctatgctgctatcctactttgactaactcgacggggtcccagtcgtcggttcaggtggtcggtggtatagtgggacagtacgttcactctcacatcacgcacgcctcgcacgcctagaacgtatgttacgactaacttattactagtaactaaagttctacctactttccgaccctactccgtaccgttccggaccgaacggaccacggtacgtacggaagtaacgttaaaccgngttacggg

SEQ ID NO: 56447 - DNA, 750 bp, Homo sapiens
  misc_feature: GYAE6OF01A715N.29.87.H10.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctggtggganacagagtacaacgtcacgttggccgggngagtcgagggctaattaacaatttattacgccgtaggtatcgagcagcataccgaagggtaaacttcctaagtcctccgtgtatactatgctgctactccctacgtttcgactaagtccggtacgggtcccctagttccgttccgggttacgtacgggtcgggtaccggggttaggtaacgttacgggttacggggaacctaagggttaccgtttaccaaccgttaccgttaccccaaacccgtacgttaccgaacggtccgtaacggccccgttaggacccgtacggtacccgtagggaaacgttaggttcggttaacggtaaccttaaacgttttaatttaaccgttaagttaaacctaaaaggtttaccttaccgttaacccgtttacccgaccccccttaaagttcccccgttaacccggtttacccggggaaccccggtaaaacggggtacccaaccgggtaaccggttacgggtaaaacgttaaaccgttaaacccggtaaacggtttcgggg

SEQ ID NO: 56448 - DNA, 577 bp, Homo sapiens
  misc_feature: GYAE6OF01CQSAO.29.87.H10.1.454.CMB.1.raw
  modified_base (107)..(107): a, c, t, g, unknown or other
  misc_feature (107)..(107): n is a, c, g, or t
  modified_base (153)..(153): a, c, t, g, unknown or other
  misc_feature (153)..(153): n is a, c, g, or t
  modified_base (218)..(218): a, c, t, g, unknown or other
  misc_feature (218)..(218): n is a, c, g, or t
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
  modified_base (387)..(387): a, c, t, g, unknown or other
  misc_feature (387)..(387): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (572)..(572): a, c, t, g, unknown or other
  misc_feature (572)..(572): n is a, c, g, or t
tcagatagagtactcacgaccggtgctcgatttagcagtactgcgttggggtttgggggcagaagtctctctcagtccagacacagcatggacatgacgggcccccntcagctcctgggactcctgctgctctggctcccagataccagatgnacgggggatccagatcgacccagtcctccactccctcccttgtcctagctagtcgtggtaggganactaggactacaaacgtctacgttcggccgggactagtcgaaggtctaattaaactatttattagcctggtancagcagactaactccgaagggtaaacttcaagtcctacctgacttcagtnactgactagtcctacttagacaacgttgacgggtccagtctcggtnagggcggtacggtgaatggtacgggactaggtattccacttctacccaactatcgancgtacgacngacagtcaggtaancgttntagtactaacgttatactagtaactaagtctacgttacctaccgccctaagtccctacgtaccgaacgacggacaccgtagtaggaactaaactaacgtntacgg

SEQ ID NO: 56449 - DNA, 665 bp, Homo sapiens
  misc_feature: GYAE6OF01BHA0U.29.87.H10.1.454.CMB.1.raw
  modified_base (106)..(106): a, c, t, g, unknown or other
  misc_feature (106)..(106): n is a, c, g, or t
  modified_base (200)..(200): a, c, t, g, unknown or other
  misc_feature (200)..(200): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctcctgtctgcatctgtggganacagtagtcaacgtcacgttggccgggcgagtcgaggctattaacaattattagcctggtatcagcagcataccgaagggaaacacccctaaactcctagactctacgtctacgacacttacctacttttcgactaaccgtaggtcggggtcccgttcgtaacgggttcaggtccggaccgaggtccggaagttccgtaggggaactacggttactttaccaacgttcctacccgaacctaaacgttccgaacggcccgtaacgtccccgtaggaccgacgtaacccgaggtaaacgtaacgttggtttaacgactttaaacgttaatttacccgtagttacccaaacgtacgttacttaacggtaccgttaacccgtaccgtaagttacccggtttcgggaccggtaacggggtaacctaaggggtagaacggtactaaccgaaacggtaacgtggtggtaccg

SEQ ID NO: 56450 - DNA, 510 bp, Homo sapiens
  misc_feature: GYAE6OF01ATN3V.29.87.H10.1.454.CMB.1.raw
  modified_base (201)..(201): a, c, t, g, unknown or other
  misc_feature (201)..(201): n is a, c, g, or t
  modified_base (361)..(361): a, c, t, g, unknown or other
  misc_feature (361)..(361): n is a, c, g, or t
  modified_base (490)..(490): a, c, t, g, unknown or other
  misc_feature (490)..(490): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcgaggcattaacaattatttagcctggtatcagcagcatccagggaaattcctaagctcctgatctatgctgcatccactttgcaatcagggtcccatctcgttcagtggcggtgatagtgggacagtgtnactctcacatcagcagcctgcagcctagaagagtgttacgacctaacttattacttgtactaaacgtatcctactttcgacccctaactcctaccttccggtaccgaacggaccacgacttacgggaanaacgttaaaccgagttacgg

SEQ ID NO: 56451 - DNA, 655 bp, Homo sapiens
  misc_feature: GYAE6OF01CI8UK.29.87.H10.1.454.CMB.1.raw
  modified_base (204)..(204): a, c, t, g, unknown or other
  misc_feature (204)..(204): n is a, c, g, or t
tcagatagagtactcacgaccggtgctcgatttagcagtactgcgttgggtttgggggcagaagtctctctcagtccagacacagcatggacatggacgggcccccgctcagctcctgggactcctgctgctctggcctcccagataccagatgtgacatccagatgacccagtctccatcctccctgtctgcatctggtgganacagagtcaacgtcacttggccgggcgagtcgaggcattaactaattattagcctaggtatcagcagcactaccgaaggaagttcctaagctcctagtatctatgctgctactctactttgactaatcgtaacgggtccctatcgtcggttcgaggtggtcggtgacgtagtcgggactagtacgttccacgttccttacaacccgtataccgacgaccgacgtccgtacgacgacggtacccgtagtaacgtacgttacggttaacggtaccttaaacgtttaacgtttaacgttaacgttaacgtaaaacgtttaccttaccgttaacccgttttacccgacccccttaaacgttccccgtaacccggtttaccgggaacccgtaaacgggtaacccaaccggtaccgtaacgggaaacgttaaacggttaaaacgaccggttaacggg

SEQ ID NO: 56452 - DNA, 598 bp, Homo sapiens
  misc_feature: GYAE6OF01CZ1B7.29.87.H10.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttggccgggngagtcgagggcagttaacattatttagcctggtatcagcagcatccgaggaaagttcctaagctcctgatctatgctgcacgtccactttgcaatcagggtccagtctcggttcagtggcggtgagtagtgganagtattcatcgacaccgatcagcagtcctcgcgacgcctagaacgtagtagttagaccttaaacgtttnttaacgttagttaaccgtaaaacgttacttaaccgtaacgtttacccgtaccccccgtaagttaccccgttaaccccgtttaccgggaacccctaaacggggaaccctaaccggtaaccgttacgggtaaaccggttaaacttaaaaccgggtaaccgtttacgggg

SEQ ID NO: 56453 - DNA, 609 bp, Homo sapiens
  misc_feature: GYAE6OF01DVJG5.29.87.H10.1.454.CMB.1.raw
  modified_base (206)..(206): a, c, t, g, unknown or other
  misc_feature (206)..(206): n is a, c, g, or t
tcagatagagtactcacgaccggtgctcgatttagcagtactgcgttggggtttgggggcagaagtctctctcagtccagacacagcatggacatgacgggcccccgctcagctcctgggactcctgctgctctggctcccagataccagatgtgacatccagatcgacccagtctccatccctccctgtctgcatctggtggganacagagtcaacgtcacgttcggccgggcgagtcgagggctaattaacaatttatttacgccttggtatcagcagcaataccgaagggtaaacttacctaagctcctagactactatcgctgctactacctactttcgactaacgtcgacgggtccctatcgtcgttcgagtcgggacggtgtataggtagggactaggtacgttccacgttcctaccacctacgtcgacgcacgcctgacacgtactagaacgtagttcgtacgacttaaactttatacgtagttaactaaagttacttaccgtacctttacccgaccccttatacccgtaaccgttaccggaaccgtaacgggaacctaccggtaacgtacgggaaagtaacgttaaaccggacgttacggg

SEQ ID NO: 56454 - DNA, 718 bp, Homo sapiens
  misc_feature: GYAE6OF01C31O0.29.87.H10.1.454.CMB.1.raw
  modified_base (207)..(207): a, c, t, g, unknown or other
  misc_feature (207)..(207): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagactaccagatgtgacatccagatcgacccagtcctccatccctccctgtctgcatctggtggganacagagtcaacgtcacgttcggccgggcgagtccgagggactaagttaactaattatttagccttaggtatcgagcagcacgtaccgaagggtaaacgttaccgtaacgtcctaccgtagtactacgttatcgccgtagacctacgtaccttacttacgactaaacgtccggtaaccggggtaccctacgttccgtacggttcgtacgggtcgggtacggttggtaagttaggtacggggaacgtaggtacgttaccacgttcctaccgaacctactaccgaacgtacccgtacgtacctacgaccgtacggtacccgtagaaacgtcgttagtaacggttacctaaacgtttacttaacgttacgttaaacgttaaagttaccttaccgttaccttaccccgtaccccttaacgttaccccgtaacccggttacccggaacccgtaaacgggtaacccaccggtaaacgtaacgggtaaacttaaacggtaaaaccgtcggttaaccggg

SEQ ID NO: 56455 - DNA, 576 bp, Homo sapiens
  misc_feature: GYAE6OF01DE2BN.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttggccgggcagtcgagggcattaacaattatttagcctggtatcagcagcataccgaagggtaaagttcctaagcctcctgatctatgctgcatcctactttgcaatcacgggtcccatctcggttcaggtggcggtagagtagtgggactagacgttacgactcctcaccatcgacgcacgcctagcgacgtccgtagaatagttgttagactaactttattactagttaacgtaaagttacttaccgttacctttccgtaccccctaacttcccgtaccgtttacccggaaccgaacggggtaacccaaccggtaacgttacggtaacgtaaacttaaaaccggtacgttacggg

SEQ ID NO: 56456 - DNA, 554 bp, Homo sapiens
  misc_feature: GYAE6OF01C3ID0.29.87.H10.1.454.CMB.1.raw
  modified_base (204)..(204): a, c, t, g, unknown or other
  misc_feature (204)..(204): n is a, c, g, or t
tcagatagagtactcacgaccggtgctcgatttagcagtactgcgttgggtttgggggcagaagtctctctcagtccagacacagcatggacatggacgggcccccgctcagctcctgggactcctgctgctctggctcccagataccagatgtgacatccagatgacccagtctccatcctccctgtctgcatctggtggganacagagtcaacgtcacgttggccgggcgagtcgagggctaattaactaattattagcctggtatcagcagcagtaccgaaggtaaagttcctaagcctcctgtactctatgctgcatcctactttgacaatccgacgggtcccagtcgtcggttcaggtcggtaggtagagtagtacgggacagtacgttacactctaccacatcagcagtcctgcacgcgtagaacgtagttgttacgacttaacttattaactagttaacaaagtactactacttccgaccccagtcccgtacttacggaccgaacggactaaccgtacgtacggaagaacgttaaacgtagtacggg

SEQ ID NO: 56457 - DNA, 685 bp, Homo sapiens
  misc_feature: GYAE6OF01CIPL8.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatcgacccagtcctccatcctccctgtctgcatctggtgggagacagtacgtcaacgtcacgttcggccgggagacgtcgagggtctaattaacaatttagttagccttaggtatccagcagcacgtaccgaagggtaaacttccgtaagtcctacctagtactctagtcgctcgactactacttacctttgactaagtcggtacgggtccctagtcgttcggtacgtaggtgggtcggtagtagtaggtcggactaggtacgttacctacgtacctaccacgtaactccgaaggccaacgtccgttaccgacgtacgtaccgtagaaccgtagtttcgtacgtacgttaaactttacgttaaacgtacgttaaaccaaagtttacctacccttaaccgtttccccgaaccccgttacgttaccccgttaacccgggttacccggtaacccgggtaaaggtaccccgtaacgggtaaccgtaacgggtaaaccgttaaacttaaacccggtaaagttccgggg

SEQ ID NO: 56458 - DNA, 609 bp, Homo sapiens
  misc_feature: GYAE6OF01E2POE.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcgagggcattaacaattattagcctggtatcagcagcatccgagggaaacgttcctaagctcctgactctatgctgcatcctactttgactaatcgacgggtccctatcgttcggttcaggtgggcggtggatagtgggacagtagttccacgtctaccaacctatcgtaacgcacggtcctagccgagtcccgtagaagtattgttacggaccttaacgtttaacttaccttaggtaaacttaaaagttacgttaccttaccgtttaccgacccccttacgtaccccgttaacccgtttacccgggaaccgtaaaccgggtaaccacccggtaacgttaccggggaaattaaaccggttaaaaccgacgtttacggg

SEQ ID NO: 56459 - DNA, 518 bp, Homo sapiens
  misc_feature: GYAE6OF01EK6XH.29.87.H10.1.454.CMB.1.raw
  modified_base (227)..(227): a, c, t, g, unknown or other
  misc_feature (227)..(227): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacgttgccgggngagtcgaggcattaacaattattagcctggtatcagcagcatccagggaaagttcctaagctcctgatctatgctgcatcctactttgacaatcgacggggtcccagtccgtcggttcagtggcggtggatagtgggacagagttcactctcaccatcagcagcctgcagctagaatgtgtcgactaactttatactagtaactaaagtatactacttcgcccctagtcctaccgttacggccgaagggaccacggtacgtacggtaagtaacgttaaacgaagttacggg

SEQ ID NO: 56460 - DNA, 884 bp, Homo sapiens
  misc_feature: GYAE6OF01EHPQZ.29.87.H10.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggngagtcgaggcattaacaattattagcctggtatcagcagcataccgaggggtaaagttaccgtaagctccgtagacttctatgtctcgctactcctactttcgactaaacgtccgtaacggggtccctagttccgttaccgggttactacgggtcgggtaccggggttagggtaagtttaagggtacgggggtaacgtaacgggttaaccggtttaccgtaaccctttacccgttaccccgtaaaccccgtaacgttacccgaaaccggtacccgtaaccgggtaccccgttacgggacccgtaacgggtaccccgttaacgggtaaacggttaacggttttacgggtttaaccggtaaacccgtttaaaacccgtttttaaacgtttttaacccgtttaaacgggtttaaaccgtttaaaaaaaccggtttaaccgtttaaacccgttaaaccccgtttttttaccccggaacccccccctttaaccgttttaacccccgttaaacccccgggttttaacccccggggtaaacccccgggtaaaaacccgggggttaaccccggtaaaacccgggttaaacccgggttaaacggggttaaaacccggtttaaaaccgggttttaaaaacccggtaaacccggtttaaacccggggg

SEQ ID NO: 56461 - DNA, 613 bp, Homo sapiens
  misc_feature: GYAE6OF01DRBAL.29.87.H10.1.454.CMB.1.raw
  modified_base (203)..(203): a, c, t, g, unknown or other
  misc_feature (203)..(203): n is a, c, g, or t
  modified_base (422)..(422): a, c, t, g, unknown or other
  misc_feature (422)..(422): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtcctccatcctccctgtctgcatctggtgganacagagtcaacgtctacgttcggccgggcgtagtccgagggacctaattaacaattattagccgttggtatcagcagcactaccgaaggtaacgttcctaagcctccgtagactctatcgtactgctactctacttagactaagtcgacgggtcctagtccgtcggtacaggtcggtacggtagagtacggtacgggatgtaacgttcactctacactntacagcgacgctgacacgtacctaggaatagtcgtacgtacttaacgttacttacgttagtaactaaagtcctaccttacgttaccccacccgttacgttcccgtaaccgtttacccgggaacccgtaaacgggtaccgtacccggtaaaggttaccggaaagtttaaacggtaaaaccggtgtaaccggg

SEQ ID NO: 56462 - DNA, 510 bp, Homo sapiens
  misc_feature: GYAE6OF01CYKMD.29.87.H10.1.454.CMB.1.raw
  modified_base (227)..(227): a, c, t, g, unknown or other
  misc_feature (227)..(227): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttggccgggngagtcgagggcattaacaattatttagccttggtatcagcagcatccagggaaattcctaagctcctgatctatgctgcatccactttgcaatcacggggtcccatctcggttcagtggcggtggatagtgggacagacgttcactctcaccgatcagcacgcctgcacgcctgaacgattgttacacttaacttattaactagtaactaaagttatactaccttccgcccctaatccaccttcggaccaagggacacgactagataacttaaacgactacgg

SEQ ID NO: 56463 - DNA, 642 bp, Homo sapiens
  misc_feature: GYAE6OF01BOJFD.29.87.H10.1.454.CMB.1.raw
  modified_base (106)..(106): a, c, t, g, unknown or other
  misc_feature (106)..(106): n is a, c, g, or t
  modified_base (204)..(204): a, c, t, g, unknown or other
  misc_feature (204)..(204): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatcgacccagtcctccatccctccctgtctgcatctgtggganacagagtcaacgtcacttggccgggcagtcgaggctaattaacaattatttagcctggtatcagctagcactccgaagggtaaacgttcctaagcctcctagtatacctagtcgctcgactactccctacgtttgacctaagtcggtacggggtccctagttccttcgggttacgaggtcgggtcggttaggagttagtggggaacgtagtacgttaccacgtcctacaccagttccgacgactagccttagcgtacgtcccgtagtaacgtacgttcgttagtacctaacgttttacttacgtacgttaacgtaaaacttcgttacctaccgtttaccgacccccttagtacccgttacccgttaccggtaccggtaaccgggaccgtaaaccggtacgtaacggttaactaaacggttaaaccgtaacgttacggg

SEQ ID NO: 56464 - DNA, 790 bp, Homo sapiens
  misc_feature: GYAE6OF01BPNH2.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatgacccagtctccatcctccctgtctgcatctgtggganacagagtacaacgtcacgttggccgggcgagtccgagggctaagttaactaatttattagtccgtggtactcgagcagacactaccgaagggtaaacgtttaccgtaaagtccttaccgtagtattaccgttaagtcgtctacgacctacttccctactttacgactaagtcccgtaacggggtccctacgttccgttcggttacgtacgggtcgggtacgggttaggtaagttacgggttacggggtaaccgtaacgggttacgtttaccgtaaccgttaccgttacccaacccgtacgttaccgaacggtacccgtacggtacccgtacggaccgtaccggtacccgtaaggtaacgttacggtttacgttaacgttaaccgttaaaccttttaacgttaaccgtttaacgttaaacctaaacggtttaaccttaccgttaacccgtttaccccgaacccccttacgttaccccgttaaccccggtttaccccgggtaacccggtaaacccgggtaacccgtaacccggtaaccggttaaccgggtaaacgttaaacccggttaaaacggtaccggttaaccgggg

SEQ ID NO: 56465 - DNA, 685 bp, Homo sapiens
  misc_feature: GYAE6OF01ER3QH.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttggccgggcgagtcgagggcaattaacaattattagcctaggtatcagcagcataccgaagggtaaacttccgtaacgcttcctagactactatgctcgcacttcctactttcgactaagtcgtacgggtccctagttccgtcggttactaggtcgggtacgggtaggtagtaggtacgggtaactaggtacgttctacctctaccaaccataccaacgtcaacgtcctgaccacgtaccgtaggaacgtacgttagttacggaaccttaaacgttttaacgtttaaaccgtttaacggttaaacttaaaaacggttacccttaacgttaacccgttttaccccgaaccccccttaacgttaccccgttaaccccgtttaccgggaaacccgtaaaccgggtaaccctaaccggtaacggttaacgggtaaacgtaaaccggtttaaaaccggtacgttaacgggg

SEQ ID NO: 56466 - DNA, 613 bp, Homo sapiens
  misc_feature: GYAE6OF01CEP6F.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcgagggcattaacaattattagcctggtatcagcagcataccgagggtaaacgttacctaagctcctgtatctatgctgctactcctactttgacaatccgtacgggtcccatcgtcggttcgaggtggcggtggagtagtcgggacagtacgttcacgtctactaaccatcagcgacgtcctgccagtccgtagaagtattagttacgtactaacgtttacttaacgttacgttaactaaacgtttacttaccgttacctttcccgtacccccttaacgttaccccgttacccggtttacccgggacccggaaacgggtaacccgtaaccgggtaaccgttacgggaaagttaaaccgttaaaaccggtaaacgttacggg

SEQ ID NO: 56467 - DNA, 591 bp, Homo sapiens
  misc_feature: GYAE6OF01E1R41.29.87.H10.1.454.CMB.1.raw
  modified_base (204)..(204): a, c, t, g, unknown or other
  misc_feature (204)..(204): n is a, c, g, or t
tcagatagagtactcacgaccggtgctcgatttagcagtactgcgttgggtttgggggcagaagtctctctcagtccagacacagcatggacatgagggccccccgctcagctcctgggactcctgctgctctggctcccagataccagatgtgacatccagatgacccagtctccatccctccctgtctgcatctggtggganacagagtcaacgtcacgttggccgggcgagtcgaggcattaactaattatttagcctggtatcagcagcataccgaagggaaacgttcctaagctccgtgatctatgactgcacttcctacgtttgacaacgtccgtacggggtccctagttccgttcggttcgacggtgggtcggtagggtagtacggtgggactaggtacgttccacttcctacaacctactcgacgctacgtccgtcgccgaacgtccgtaagacgtacgttgttacgtaccttaacgtttattacgttacgtaactaaagttctacttacctttccgacccctacgtcctaccgttcggaccgacggtacaacgtacgtaggaagtaacttaaacgtgtacgg

SEQ ID NO: 56468 - DNA, 643 bp, Homo sapiens
  misc_feature: GYAE6OF01B52UF.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcgaggcattaacaattatttagctggtatcagcagcatccaggaacgttctaagctctgatctatgctgcactccactttgactaatcgacggggtccctagttccttacggttcgaacggtgggtccggtaggtagtagtacggggtaactaggtacgtttccgtacttcttacccgaacctacgttaccaaggtcctaacggtcccttcgaccgtacggtccccgttaaggaacgtaagttcgggtttaaccgacgttaaaccttttaagtttaaccgtttagtaactaaaacgttacttaccgttacctttacccgtaccccctaacttaccgtacccgtttcggacccggtaaacgggtacctaacggtaccgtacgggtaacgtaacgttaaaaccggagttacggg

SEQ ID NO: 56469 - DNA, 620 bp, Homo sapiens
  misc_feature: GYAE6OF01BUX4L.29.87.H10.1.454.CMB.1.raw
  modified_base (210)..(210): a, c, t, g, unknown or other
  misc_feature (210)..(210): n is a, c, g, or t
tcagatagagtactcacgaccggtgctcgatttagcagtactgcgttgggtttgggggcagaagtctctctcagtccagacacagcatggacatggacgggcccccgctcagcctccgtgggactcctgctgctctggctcccagataccagatgtgacatccagatcgacccagtcctccactccctccctgtctgcatctggtggganacagagtacaacgtcacgtcggccgggcgagtcgaggcaagttaactaattattagcctggtatcagcagcataccgaagggtaaacttcctaagcctcctgactctatgctgactactcctactttcgactaacgtcgacgggtccacgttcgttcggttcagggtggtcggtaggtagtagtgggactaggtacgtctactccactaacactcgacgccacgtcctcgcacgccgtagacgtagttgtacgtactaacgtttacttacgttagtaacgtaaacttactcctaaccgtttcccgaaccccttacgtacccgttacccggttacccggtaccggaaacggtaacccgtaaccggtaacggtaacggtaaacgtaaacgttaaaccggtaacggttacggg

SEQ ID NO: 56470 - DNA, 640 bp, Homo sapiens
  misc_feature: GYAE6OF01EGB7P.29.87.H10.1.454.CMB.1.raw
  modified_base (202)..(202): a, c, t, g, unknown or other
  misc_feature (202)..(202): n is a, c, g, or t
  modified_base (633)..(633): a, c, t, g, unknown or other
  misc_feature (633)..(633): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtggganacagagtacaacgtcacgttcggccgggagagtcgagggactaattaacaatttattacgccgtaggtatcagcagcactaccgaagggtaacgttacctaaggtcctcctagtactactatcgctcgactactccctacgtttacgactaaacgtccggtaacggggtccctagttccgttcggttacgtagggtcgggttaggtaggtataggttacggggaactaggttacttacctaccttcgtaccgaacctacgtcgacgccgtacgtccctagaccacgtccgtagaagtagttcgttacgaacttaacgttattacgtagtaactaaacgtactaccgttaacttcccgaccctacgttccttaaccgtccggtaaccgaaccggaccaacggtacgtacggaaagttaaaccgttaaacggngttacgg

SEQ ID NO: 56471 - DNA, 614 bp, Homo sapiens
  misc_feature: GYAE6OF01CQAFB.29.87.H10.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatcgacccagtctccatccctccctgtctgcatcgtgnggganacagagtcaacgtcacgttggccgggngagtcgaggcaattaacaattattagcctggtatcagcagcatccgaagggtaaacgttcctaaagcctcctgatctatgctgcactccactttgacaagtcgacgggtcccattcgtcggttcaggtggcggtaggtagtagtgggaactaggtacgttcactctaccaaccgatacgagccacggtccctgacacgtaccgtagaacgtacgttagttacgtactaaacctttagttaaccttacgttaaactaaacggttactaccttaaccgttacccgtacccctaattaccccgtacccgttaacccgggaccgtaaacgggaacccgtacggtaccggtaaggtaacgtaaacttaaaaccggtacgttaacggg

SEQ ID NO: 56472 - DNA, 794 bp, Homo sapiens
  misc_feature: GYAE6OF01BC7Z9.29.87.H10.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagatagagtactcacgaccggtgctcgatttagcagtactgcgttgggtttgggggcagaagtctctctcagtccagacacagcatggacatgagggcccccgctcagcctcctgggactcctgctgctctggctcccagataccagatgtgacatccagatgacccagtctccatcctccctgtctgcatctgtaggganacagagtcaacgtcacgttggcccgggnagtcgagggctaagttaactaatttatttagccttggtatcagcagcacgtaccgaagggtaaacgtttccgtaaacgtccttccgtagtaacttctaagtcgtacgtcgtacctacttaccctactttacggacctaacgtaccggtacgggggttacccctacgttacccgttcggtttacgtacgggttacgggtaccggggtagggtaacgttacggttacgggggtaaccgtaacggttacggtttaacccgtaaccgtttaccctacccgtaacccgtaaccttccgaaccggtaccgtaaccggtccctacggtaccgaccggtacccgtaaggtaaccggtagttaccgttacgtaaccgttaaaccgttttaacttaaccgtttaacgttaaacccgtaaaggtttaacccgttaccttaccccttttacccggtaaccccccttacgttaccccgttaaccccggttacccgggtacccgtaaaccgggtaacccgtaaccggtaccgtacgggtaaaccgttaaaccgttaaaacggtaaccggttaacggg

SEQ ID NO: 56473 - DNA, 549 bp, Homo sapiens
  misc_feature: GYAE6OF01DZPVS.29.87.H10.1.454.CMB.1.raw
  modified_base (443)..(443): a, c, t, g, unknown or other
  misc_feature (443)..(443): n is a, c, g, or t
  modified_base (484)..(484): a, c, t, g, unknown or other
  misc_feature (484)..(484): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcgagggcattaacaattatttagcctggtatcagcagcataccaagggaaagttcctaagctcctgatctatgctgacatcctactttgactaagtccgacggggtccctacgttcgtccggttcaggtcgggtcggtaggtagtagtgggactagtacgttactacgtcctacaccatacacgccagtcctgactacgctagagtcgtgttnacgttacttattactagtaacaagttactactacgtttccncccctattccgtaccgttccggacaacgggacacgtacgtaggtacgtaaactaacgtagtacgg

SEQ ID NO: 56474 - DNA, 558 bp, Homo sapiens
  misc_feature: GYAE6OF01EDKF8.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctgtggganacagagtcaacgtcacgttggccgggcgagtcgagggcaattaactaatttatttagcctggtatcagcagcatccgagggtaaacgttcctaagcctcctgattctatgctgctactcctactttgactaatcgtacgggtccctagtcttcggttcaggtgggtcggtggagtagtagggactagtagttcactctacaccatacagcacgcctgcgacgcctagaagtagttgttagtactaacttacgtttaactagttaactaaagttactacttacctttccgacccctacgtcctaccgttccggaccgaacggacacgtacgtaggaataacgttaaacgacgtacgg

SEQ ID NO: 56475 - DNA, 638 bp, Homo sapiens
  misc_feature: GYAE6OF01DMBU2.29.87.H10.1.454.CMB.1.raw
  modified_base (206)..(206): a, c, t, g, unknown or other
  misc_feature (206)..(206): n is a, c, g, or t
tcagatagagtactcacgaccggtgctcgatttagcagtactgcgttgggtttgggggcagaagtctctctcagtccagacacagcatggacatgagggccccccgctcagctcctgggactcctgctgctctggctcccagataccagatgtgacatccagatgacccagtcctccatccctccctgtctgctatctggtggganacagagtcaacgtcacgttggccgggagagtccgagggactaagtttaactaatttattacgccttggtactcgagcagctagtaccgaagggtaaacttcctaagctcctagatctatcgctcgctactcctattcgactaacgtccgacgggtcctagttccgtcggttacgaggtcgggcggtaggtacgtaggtacgggactaggtacgttcctactccgtaccacctagtacacgtacgacgtcctagccgacgtccaaggtaagtagttcgtacgtacttaacgtttatacgtattaaacgtaagttactaccgttacccgttacccgtacccctacgttcccgtaaccgttaccgggaaccgtaaacgggacctaaaccggtacggtaaacggtaacgttaaacggttaaaccgtagttaccggg

SEQ ID NO: 56476 - DNA, 547 bp, Homo sapiens
  misc_feature: GYAE6OF01A7CZG.29.87.H10.1.454.CMB.1.raw
  modified_base (201)..(201): a, c, t, g, unknown or other
  misc_feature (201)..(201): n is a, c, g, or t
  modified_base (441)..(441): a, c, t, g, unknown or other
  misc_feature (441)..(441): n is a, c, g, or t
  modified_base (528)..(528): a, c, t, g, unknown or other
  misc_feature (528)..(528): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttgccgggcgagtcgagggcattaacaattattagcctggtatcagcagcactccgaagggaaacgttacctaagtctcctagatctatgctgctatcctactttcgacaactcgacggggtcccagttccgtcggttcgagtgggtcggtggagttagtggggactaggtacgttctacgtcctcaaccactcagcacgtcctgcacgctagaagtatgttntactaacttattacttagtaactaaagtactactacttccgacccctactcctaccgttcggaccgaacggaccacgacgtacgganaacgttaaacgacgtacgg

SEQ ID NO: 56477 - DNA, 554 bp, Homo sapiens
  misc_feature: GYAE6OF01BG6X1.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (434)..(434): a, c, t, g, unknown or other
  misc_feature (434)..(434): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggngagtcaggcattaacaattatttagcctggtatcagcagcatccgagggtaaacttcctaaggcctcctgattctatgctgctactcctactttgacaatcggacgggtccctagttccgttcggttcgagggttggcggtaggattaggtggggacaggtagttcacttctaccaccatcacgcacgtcctgcacgacgtagaagtnttgttacgtactaactttattacgtagtaactaaagttctactacctttccgacccctatccctaccgttaccggaccgaacggaccaacgtacgtagagtaacttaaacgcgttacggg

SEQ ID NO: 56478 - DNA, 681 bp, Homo sapiens
  misc_feature: GYAE6OF01BIR6S.29.87.H10.1.454.CMB.1.raw
  modified_base (208)..(208): a, c, t, g, unknown or other
  misc_feature (208)..(208): n is a, c, g, or t
  modified_base (657)..(657): a, c, t, g, unknown or other
  misc_feature (657)..(657): n is a, c, g, or t
tcagatagagtactcacgaccggtgctcgatttagcagtactgcgttgggtttgggggcagaagtctctctcagtccagacacagcatggacatgacgggccccccgctcagctccgtgggactcctgctgctctggctcccagactaccagatgtgacatccagatcgacccagtcctccactcctcctgtctgcatcgtggtgganacagactcaacgtcacgttcggccgggagtacgtcgagggacctaagtttaaacctaaattttactttacggcccgtttaggttaactcgaacggtccgaagccgtaacgttacccggaaaggggtaaactttcccgtaaacggtcccttaccgtagtacttactaagtcgcgtagcctacgttaccctatttcgacctaagtccggacgggtccctagttccgtcggttcgaggtgggtacggtggagttagtagggacaggttactcacctctaccacgtactccgagccacggtccacgtcacgtcgtaaggatgtcgttaacacgttaactttacgttactaacgtaacgtaaactcttacttacccgtttacccgaccccttagttaccccgtacccgttaccggaaccgtaaccgggacctaccggtaacgtacgggttaaanaaaccgtttaacggtacgttacgg

SEQ ID NO: 56479 - DNA, 584 bp, Homo sapiens
  misc_feature: GYAE6OF01DU5BQ.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctcctgtctgcatctgtgggagacagagtcaacgtcacttggccgggcgagtcagggacattaaacaattattagcctggtatcagcagcataccgaagggtaaacgttcctaagctacctgatctataggctgcactcctaactttgacaatacgacggggtccctatccgttggttacagggtggtcgggtggataaggtgggtaacgaagtacgttacgacttcgtacctacaactacacggactacgccctgaccgtacgccgtagaaggtactagttacggacttaactttattaactagttaacaacgttattacctactttccgacccctagtacctacccgttcggaccaaagggaccaacggtacgtacgggaataaacgttaaagaacggtacgg

SEQ ID NO: 56480 - DNA, 782 bp, Homo sapiens
  misc_feature: GYAE6OF01C5CFU.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgaccagtctccatccctcctgtctgcatctggtggganacagagtcaacgtcacgttggccgggacgagtcgagggacattaactaattatttacgccgttggtatcagcagcagtaccgaaggggtaacttccgtaagtctcctaggtactctatggctcgcactccgtactttgactaacgtcggaaccggggtccctagttccgtacggttcgagggttcgggtacggtaggtaacgttaggtcggggtaacgtaaggttacggtttacctacccgttaccctacccgtaaccctagtaccgtaacggccctacggtccccgtacggaccgtacggttcccgtaagggaaacgtttacggtttacggttaccgtaaccttttaaacgttttaacgttttaacccgttaacggttaaaccgtttaaaaggttaacctttaccccgttttaacccgtttaccccgttaccccccgtaacgttttacccccgtaaccccgggttttaacccgggaaccccgggttaaaacgggggtaacccctaaaccgggttaaaccggttaaggggtaaaccggtttaaaaccggtttaaaaccgggtaaccggtttaaccggggg

SEQ ID NO: 56481 - DNA, 587 bp, Homo sapiens
  misc_feature: GYAE6OF01DDJ70.29.87.H10.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatcgtgtggganacagagtcaacgtcacttggccggngagtcgaggctattaacaattattagcctggtatcagcagcataccgaagggtaaacttcctaagtcctcctgtatctatgctgctactctactttgactaagtcgacgggtccctagtccgtcggttcgaggttgggcggtggtagtagtgggactagtacgttacactctactacatcgacgcacgcctgaccgagtcctaggagtagttgtagtaccttaactttactaacgttacgtaaacgtaagttacttaccgtacctttccgacccctaagtcccgtaacccgttccgggaaccgtaacgggaacctaccggtaccggtaggaacttaaacgtaaaccggtacgttacggg

SEQ ID NO: 56482 - DNA, 742 bp, Homo sapiens
  misc_feature: GYAE6OF01BL53W.29.87.H10.1.454.CMB.1.raw
  modified_base (212)..(212): a, c, t, g, unknown or other
  misc_feature (212)..(212): n is a, c, g, or t
tcagatagagtactcacgaccggtgctcgatttagcagtactgcgttgggtttgggggcagaagtctctctcagtccagacacagcatggacatgacgggcccccgctcagctccgtgggactcctgctgctctggcctcccagactaccagatgtgacatccagatcgacccagtcctccactccctccctgtctgctatcgtggtggganacgagacgtacaaccgtctaccgttcgggaccgggcgagtcgaagggtactaatttaaacgtaattttacgttacggtccgttaggttactcgaacgtcaacggtactaaccgtaccggaaaacggggttaaaccgttcccgtaacgtccttccgtagtacttcgtagtcgtcttacgacctacttcctacgtttacgactaacgtccgtacggtcctacgttcgtacggtcgtaggtcgggtaggtaggtagtacgggtacggacgtacggttacgttccgaaccttccgtaacccgtaactacgtaccgacggcgtaccgtcctacggtacccgacggtcccgtaaggtacgtattaccgttacttaaccgttaaactttacgttaacgtaacgtaaacgttaaacttccttaccgttaaccctttcccaacccgttaaccgttcccgtaacccggttacccggaaaccgtaaccgggaacctacggtacggttaaccgtaaagtaaccgttaaacgtcggttaacgg

SEQ ID NO: 56483 - DNA, 576 bp, Homo sapiens
  misc_feature: GYAE6OF01BB6VR.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcagtcaggcattaacaattattagctggtatcagcagcatccagggaagttcctaagctcctgatctatgctgctatcctactttgcaatcgagggtccatctcggttcagtggctagtgatcgtggactagtactttccaccctcacctactacaatacgtaccgttaggaagtactaggaagactagccgtagacctaaccgtttaacttaccgtacgttactacttacctaagttaactttttacggtttaccggtaccggttaccgtttaccgggaccgtaaacggggacctaaccgggtaacctagggtaacgtaacgttaaaaccggtacgttggtacggtaccg

SEQ ID NO: 56484 - DNA, 539 bp, Homo sapiens
  misc_feature: GYAE6OF01A3X3R.29.87.H10.1.454.CMB.1.raw
  modified_base (201)..(201): a, c, t, g, unknown or other
  misc_feature (201)..(201): n is a, c, g, or t
  modified_base (423)..(423): a, c, t, g, unknown or other
  misc_feature (423)..(423): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttgccgggcgagtcgagggcattaacaattattagcctggtatcagcagcatccagggaaagttcctaagctcctgatctatgctgcatcctactttgactaagtcgacggggtcccattccgttcggttctaggtgggtcggtggatagtgggacagtagttcactctacactatcagcacgcctagcacgctagagtatgtanactaattattaactagtaactaaagtactacgtacttaccgacccctatcccgtacccttaccggaccgaaacgggaccaacggtacgtaggaaagtaacttaaacgacgttacgg

SEQ ID NO: 56485 - DNA, 546 bp, Homo sapiens
  misc_feature: GYAE6OF01BU5FB.29.87.H10.1.454.CMB.1.raw
  modified_base (201)..(201): a, c, t, g, unknown or other
  misc_feature (201)..(201): n is a, c, g, or t
  modified_base (412)..(412): a, c, t, g, unknown or other
  misc_feature (412)..(412): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccagggaaagttcctaagctcctgatctatgctgcatccacttttgcaatcacgggtcccatctcggttcagtggcggtggatagtgggacgagtacgttctacgtctcacctatacagcacgcctcgcacgccgtagaagtntgtgtacctaacttattacttacgtactaaacgtactaccttactttaccgtaccccctacgtcctacccgttaccggacccgtaaacgggacctaccggtactacggaagtaacgttaaacgtaacgttacgg

SEQ ID NO: 56486 - DNA, 808 bp, Homo sapiens
  misc_feature: GYAE6OF01DVTB1.29.87.H10.1.454.CMB.1.raw
  modified_base (204)..(204): a, c, t, g, unknown or other
  misc_feature (204)..(204): n is a, c, g, or t
tcagatagagtactcacgaccggtgctcgatttagcagtactgcgttgggtttgggggcagaagtctctctcagtccagacacagcatggacatgagggcccccgctcagcctcctgggactcctgctgctctggctcccagataccagatgtgacatccagatgacccagtctccatccctcctgtctgcatcgtggtggganacagagtaccaacgtcacgttggccgggacgagtccgagggactaattaaactaatttattacgccgttaggtactcgagcagcacgtaccgaacgggtaacgttcctaacgcctccgtagtactctatgctcgctactcctacgtttcgactaacgtaccgtacgggtaccctacgttccgtacggttacgtacgggtcgggtacggttaggtacgttaacgggtacgggtaacgtacggttacgttaccgtaacctttacccgtaccctaacccgtaacgtaccgtaaccgaccgtaacggtcccgtacggtaccgtaaccggtacccgttaacggtaaacgttacgtttacggtttaaccgttaaacccgtttaaaccgttttaacgtttaaaccgtttaacggtttaaacgtaaaaccgtttacctttaacccgtttaacccgtttacccccggtaaccccctttaaccgtttacccccgttaaaccccggtttacccgggaaacccgggtaaaccggggtaacccgtaacccgggttaaaccggttaaacggggttaaacgtttaaaaccggttaaaaccggttaacggttacccgggg

SEQ ID NO: 56487 - DNA, 748 bp, Homo sapiens
  misc_feature: GYAE6OF01BN0QL.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcgagggcagttagaagttattagccttggtttcagacaagaaaccgaggaaacgcccctaaactcctagactctacgctgcactccgtactttgaccacgtaggtccgggggttcccgttcgttaacggttcgaacggtccggcgacgggtaccggtaagttccggtacggggtaacctaaggttacgttttaccaaccgtttccttacccgtaaacccctaagtttacccgaacggacccgtaacgtacccgttcggaccgtaacgtacccgtaggaaaacgtacgtttggtttacgtaaccgttaaaacctttttacgttaaccgttaggtaaccctaaacgtaaccgttcgtttaaaccggttaaccgtttaaaccccccgttacgtttaaccgtttaccggttttaccgggaccccgtaaaggggggtacccgtaaaggggtcggtaaacggtaaccgttaacgtaaaaaccgggtacttacggggttacggacctacggtaacccctaaccg

SEQ ID NO: 56488 - DNA, 814 bp, Homo sapiens
  misc_feature: GYAE6OF01DYKNF.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctccctgggactcctgctgctctggctcccagataccagatgtgacatccagatgacccagtctccatccctcctgtctgcatctgtgganacagagtcaacgtcacttgccgggnagtcgaggcattaacaattattagccttaggtatcgagcagccatccgaagggtaaagttccgtaagctccgtagtatctatcgtctgcatcctactttacgcaacgtcgacgggtcctacgttccgtcggttaccgagggtcggtacgggtacgggtaagttaaggttacgggggtaacgtaagggttaccgtttaccgtaaccgttacccttacccgtaacccgtaacgtttaccgaacggtacccgtaacggtaccccgttacggacccgtaaccggtcccgttaacgggtaaacggtacgtttaacgggtttaaccggttaaaccctttaaaacgtttttaaccgtttaaaccgtttaacggtttaaacccgtaaaaacggttttaccttaaaccccggtttaacccgttttaacccggtaaccccccccgttaaccgtttaaacccccgttaaccccgggtttaccccggggtaaaccccgtaaaacccggggggtaaacccctaacccgggttaaaccggttaaaccggggtaaacggttaaaaacccggtttaaaacccggtaaacggtttaacccggggg

SEQ ID NO: 56489 - DNA, 848 bp, Homo sapiens
  misc_feature: GYAE6OF01BS23U.29.87.H10.1.454.CMB.1.raw
  modified_base (107)..(107): a, c, t, g, unknown or other
  misc_feature (107)..(107): n is a, c, g, or t
tcagatagagtactcacgaccggtgctcgatttagcagtactgcgttgggtttggggcagaagtctctctcagtccagacacagcatggacatggacgggcccccgntcagcctcctgggactcctgctgctctggctcccagactaccagatgtgacatccagatcgacccagtcctccacttccctccctgtctagccattccgtaggtgggacgacaggtacgtaccaaacgtcctacgttcgggccgggtacgacgttaccgagggtactaaactttaaaccttaaagtttaacgttttacgacccgtttagggttaactacgtaacggaccgtagacctaacgttaaccccggaaagggttaaaccgtttccgaaacggtccttaccgtagtacttacctaagtcgtaacctcgaccgtacttaccctacgtttacgaacgtaacgtccggtaaaccggggttccctagtttaccgttcccggttagacgggttacgggtaccggttaacggtaagtaggttaccgggaactacggttacgttacctaccgttaccgtacctaaccgtacgttacgaacgtcctaacggtcccttaggacccgtaccgttaaccgtaaggtaacggttcgttacggtaacggttaaccctttaagtttaacgtttaacgtaacgtaaacgttaaacttccgttaacccgtttaccgttaacccggtacccctttaaccgtaacccggtttaacccgggttaccggaaacccgggttaaaccggttaaccccgacgggttaaaccggttacggtaaaaccggtttaaaccctaaaggttcccggttaaacgggg

SEQ ID NO: 56490 - DNA, 792 bp, Homo sapiens
  misc_feature: GYAE6OF01CG48I.29.87.H10.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
tcagatagagtactcacgaccggtgctcgatttagcagtactgcgttgggtttgggggcagaagtctctctcagtccagacacagcatggacatggacgggcccccgctcagctcctgggactcctgctgctctggcctcccagataccagatgtgacatccagatcgacccagtctccatcctccctgtctgcatctggnggganacagagtcaacgtcacgttcggccgggagagtacgaggtctaagttaactaatttatttagccgttaggtaactcgaacgcgaaggcctaacgtaccgaagggtaaaccgttccgtaacgtccttccgtagtaactcgtaagtgtctcgtactacttcctacgttcgacgtaaacgtccggacgggttacctaacgttccgtacggttcgtagggtcgggtacgggtaggtaacgttagggtacgggtaacgtaaggttcgtttacctaccgttactaacccgtaacctagtaccgacgaccgtaacgtcccgttacgaccgtaggtacccttaaggtaaccgttagttaccggtttaaccggttaaccttaaaccgtttttaacgtttaaaccgttaacgttaaacggttaaaccttaccgtttaccctttaaccgtttaccccggtacccccttaaacgtttaccccgttaaccccggttaacccggtaacccgggaaaccgggtaaaccgtaaacccggttacgggttaaaacccggtaaagggtttaaaaccgttaaaacccggggtggttttaacccgggg

SEQ ID NO: 56491 - DNA, 637 bp, Homo sapiens
  misc_feature: GYAE6OF01EN09R.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatgacccagtctcatcctcctgtctgcatctgtcggganacagacgtcaacgtcacttgccggnagtcaggcagttaacaattattagccttggtatcagcagcatcgaggaaagttccaagctcctgatctatgctgcattcctagtttgactaagtccgtacgggtcccaagttccgtacggttctaacgggtgggtccggttagggaattaaggttcggggaactacggtaacgttccaacttaccttacgaaccctaacgtcacggtaccacgtccgttagccgaacggtaccttaggaacgtagttcgttaacggaccttaaactttacgttaacgttacgttactaaaacgttcttacctaaccgtttacccgaccccttagtacccgtaccgtttacccgggaccgtaaaccgggtacctaaaccggtaccgttaaggtaacgtaaacgttaaaccgacgttaacggg

SEQ ID NO: 56492 - DNA, 579 bp, Homo sapiens
  misc_feature: GYAE6OF01BAJGU.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (400)..(400): a, c, t, g, unknown or other
  misc_feature (400)..(400): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggnagtcaggcattaacaattattagcctggtatcagcagcatccgagggtaaacttcctaagctcctagatctatgctgctatcctactttgactaaagtccgaggggttcccagttccgtcggtttacaggtcgggtcgggtaggatagtgggacagtacgttcactctcaccancagcagccctgcacgtccctagaacgtagttgttacgtacctaactttaagtttacttagttaacctaaacgttacttacctaacttttcccgaccccctaacgttcccgtaacccgttccggacccgtaaacgggaccaaccggtacgtacggaacgtaacgttaaacgacgttacgg

SEQ ID NO: 56493 - DNA, 569 bp, Homo sapiens
  misc_feature: GYAE6OF01BASZ2.29.87.H10.1.454.CMB.1.raw
  modified_base (204)..(204): a, c, t, g, unknown or other
  misc_feature (204)..(204): n is a, c, g, or t
tcagatagagtactcacgaccggtgctcgatttagcagtactgcgttgggtttgggggcagaagtctctctcagtccagacacagcatggacatgacgggccccccgctcagctcctgggactcctgctgctctggctcccagataccagatgtgacatccagatgacccagtctccatccctccctgtctgcatctgtggganacagagtcaacgtcacttggccgggcagtcagggcattaacaattatttagcctggtatcagcagcatccgagggtaaattcctaagctcctgatctatgctgcatcctactttcgcaatccgacggggtccccatccgttcggttcgaggtgggcggtggagtagtggggacagtagttcgactcgtcacctatcagtcacgcctgcacgcctagaagagttgttagactaactttattaaccttagtaactaaagtacttacctactttcccgaccccctacttcccgaccctttaccgggaccccgaaacgggaaccaaccggtaccgtagggaacgtaaacgttaaaccgtacgttacggg

SEQ ID NO: 56494 - DNA, 676 bp, Homo sapiens
  misc_feature: GYAE6OF01DZ16G.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctgctcccagataccagatgtgacatccagatgacccagtctccatccctccctgtctgcatctgtggganacagagtcaacgtcacgttggccgggcgagtcgaggcattaaacaattatttagccttggtatcagcagcataccgaagggaaacgttaccgtaagcctactgtatctatgctgacatcctatttcgcaagtcgacgggtcccagttcgttacggttcgaggtcgggtcggtaggtagttaggtcgggactaaggtacgttacgacttacctacccaccgtaactcgacgtaccgacgtcccgtacgaccgacgtacccgtagtaagtagttcgttagtacctttaaactttattaaccgttacgttaacgtaaacggttacttaccgttaaccgtttcccgaccccccttaacgttccccgttaacccggtttacccgggtaaaccccggtaaaacggggtacccgtaaacccgggtaccgttaacgggtaaacggttaaaacgtttaaaaccccgggtaacggtttaccgggg

SEQ ID NO: 56495 - DNA, 716 bp, Homo sapiens
  misc_feature: GYAE6OF01DC9HD.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagcctccgtgggacctcctgctgctctggctaccagactaccagatgtgacatccagatcgacccagtcctccatcctccctgtctgcatcgtggtgggagacgagagtacaacgtctaacgtcggccgggcgagtcgaggctaaattaaacgtaatttacgtttacggccttagggtaactcacgaccgaggtcctaaacgttaccccggaaaaggggttaaacctttacctaaacggtccttacccgtagtactttactaacgttcggcttacggtacctaaccttaccgttacgtttacggacctaaacggttccggtaaccgggtaccctagttccgtccggttagaacgggtgggcggttacgtaagtacgtagggaacgagttacgtactaccgtctactaccgtatacgacgaccgacgtcctgacctacgacgtagaacgttgtgttacgacttaaacgttacgttaagtaacgtaagtaaacgttacttaccttaccgttacccgtaccctacgttacccgtacccgttacccggaccggtaaacgtacccgtaacggtaaccgtaaggtaaactaacgtaaaaccggtgttaccggg

SEQ ID NO: 56496 - DNA, 500 bp, Homo sapiens
  misc_feature: GYAE6OF01A6J70.29.87.H10.1.454.CMB.1.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
  modified_base (425)..(425): a, c, t, g, unknown or other
  misc_feature (425)..(425): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttgccgggcagtcaggcattaacaattattagcctggtatcagcagcatccagggaattcctaagctcctgatctatgactgcatccactttgcaatcagggtcccagtctcggttcagtggcggtggatagtgggacngagttcacgtctcaccatcagcagcctgcagcctagagatgttgacaacgtttatactgtacaaagtntactactttcaccccgtatccctacctttcggcccaagggaccacgtactaggaactacttaaacgacgttacgg

SEQ ID NO: 56497 - DNA, 495 bp, Homo sapiens
  misc_feature: GYAE6OF01DJMZ2.29.87.H10.1.454.CMB.1.raw
  modified_base (106)..(106): a, c, t, g, unknown or other
  misc_feature (106)..(106): n is a, c, g, or t
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctccctgtctgcatctgtggganacagagtcaacgtcacttgaccgggcagtcaggcataacaatattagcctggtatcagcagcatccaggaaagttcctaagctcctgatctatgctgcatcgaacttcgcaatcagggtcccatactcgttcagtggcgtggatagtggacagagtcagtactcacatacngacancctgcagctagagagtgtgactaagttacttactgtacacgtagtacgttaagtacgtaaccctcgtaactatttggaccgaagggtaccaacggtgaacgataacaagtaactacgg

SEQ ID NO: 56498 - DNA, 558 bp, Homo sapiens
  misc_feature: GYAE6OF01BJMMV.29.87.H10.1.454.CMB.1.raw
  modified_base (200)..(200): a, c, t, g, unknown or other
  misc_feature (200)..(200): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctgtggganacagagtcaacgtcacttggccgggcagtcgaggcattaacaattattagcctggtatcagcagcatccgaagggaaagttcctaagctcctgatctatgctgcatccactttgctaatcgacgggtcccagttcgtcggttcaggtgggcggtggatagtgggacaggtacgttcacttctacaccatcagcacgcctgccgagccctagaacgtgttcgttagacttaactttattacttagttaactaaagttacttacctactttccgacccccttaagtcccgtaacccgttccggaccgtaaacgggaccaaccggtacgtaggtaacgtaacgttaaaaccgagttacggg

SEQ ID NO: 56499 - DNA, 513 bp, Homo sapiens
  misc_feature: GYAE6OF01BXVLR.29.87.H10.1.454.CMB.1.raw
  modified_base (226)..(226): a, c, t, g, unknown or other
  misc_feature (226)..(226): n is a, c, g, or t
  modified_base (401)..(401): a, c, t, g, unknown or other
  misc_feature (401)..(401): n is a, c, g, or t
tcagatagagtactcacgaccggtgctcgatttagcagtactgcgttgggtttgggggcagaagtctctctcagtccatacacagcatggacatgagggcccccgctcagctcctgggactcctgctgctctggctcccagataccagatgtgacatccagatgacccagtctccatcctccctgtctgcatctgtgggagacagagtcaacgtcacttgccgggngagtcagggcattaacaattattagcctggtatcagcagcatccagggaaagttcctaagctcctgatctatgctgcatccactttgcaatcgacgggtcccatcgtcggttcaggtggcggtggatagtgggacagagttcactctcaccatcagcagcctgcacgcctgaagntgttgactaactttattactagtaactaaagtactctactttccgacccctagtcctacccttcggacccgaacgggaccacgtactaggaagtaacttaaacgacgtacgg

SEQ ID NO: 56500 - DNA, 830 bp, Homo sapiens
  misc_feature: GYAE6OF01CZXBF.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagctcctgggactcctgctgctctggctcccagactaccagatgtgacatccagatcgacccagtctccatccctcctgtctgcatcgtggtgggacgacgagtacgtcaacgtcacgttcggccgggcgagtcgagggctaattaactaatttagttacgccttggtatcgagcagctacgtaccgagggtaaacgttccgtaaagtccttccgtagaactttccgtaagttcggtcttacggaccttaaccgttaccttaaccgtttttcgaaccgttaaacgttacccggtaaccgggggtttacccctaacgtttcccggtttacgggtttacgtaacggggttcggggtaccggttagggtaagttacgggtagggtaaccgtacgggtacgtttacccgacgtttacccgtacctaaaccctacgttacccgaggtaacccttacggccccgttacggtacccgaaccggtacccgttaagggtaaacgttaccggtttagttaaccgtaccgttttaaaacgtttacgtttaaccgttaacggtttaaaccgtaaaacgtttaacccgttacgtttaaccctttaccccgaccccgttaaccgttacccgtaaccccggtttaccggaaccccggtaacgggtaaacccctaccgggttaaacggttcgggttaaaaaccgttaacgttaaaacccggtacggtttacccgggg

SEQ ID NO: 56501 - DNA, 661 bp, Homo sapiens
  misc_feature: GYAE6OF01D3QH2.29.87.H10.1.454.CMB.1.raw
  modified_base (204)..(204): a, c, t, g, unknown or other
  misc_feature (204)..(204): n is a, c, g, or t
  modified_base (380)..(380): a, c, t, g, unknown or other
  misc_feature (380)..(380): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatcgacccagtctccactcctcctgtctgcatctggtggganacagagtcaacgtctacgttcggccgggcgagtcgagggactaattaaactaatttattacgccgttaggtatcagctagctataccgtaagggtaaacgttccgtaacgtctacctagtactctagtcgctcgactactacctacttgactagtcgacggtcctagtcgtcgtcnggtggacggtgagtagtgggatagtacttacactctacacctatacgacgcgacgccgtacgcaccggtctaaggtaagtagtttcggttaacgtaaccttaaacgttttacgttaaccgttacgttaaaacgtaacgtttaccttaccttaaccgttttccccgaaccccttaccgtttacccgtaaccccggttaccgggaacccggtaaaacgggtacccgtaaccggtaaccgttaagggtaaaccgttaaaccggttaaacgtaccgggttacggg

SEQ ID NO: 56502 - DNA, 910 bp, Homo sapiens
  misc_feature: GYAE6OF01ENPQV.29.87.H10.1.454.CMB.1.raw
  modified_base (107)..(107): a, c, t, g, unknown or other
  misc_feature (107)..(107): n is a, c, g, or t
tcagatagagtactcacgaccggtgctcgatttagcagtactgcgttgggtttgggggcagaagtctctctcagtccagacacagcatggacatgacgggcccccgntcagctcctgggactcctgctgctctggctcccagataccagatgtgacatcagatcgacccagtctccactcctccctgtctgcatcgtggtgggaacgacagtagtaccaacgtcacgttcgggccgggagagtcggaaggactaagtttaaactaaattttagttacggcttaggtatacgaagtccgaagacctacgtaccggaaagggtaaaccgtttccgtaaacggtcttacccgtagtaacttccgtagttccggtactacgacctaactttccttaacggtttacgacgttaaagttccccggggtaaacgggttccccttaagtttcccggtttagggtaccgtagggttccggggtagggttaggaaagttaacgggtacggggtaaccgtacgggttaccgttaacgttaccgttaccctaccgtaaccgtaaccgtaccgtaacggacccgtaaccggtcccgttaccgtaaccggtaacggtacccggttaacggtaacggttaacggtttaacgtttaaccgttaaaccgttttaaacgttttaaacgttttaacccggttaaacggtttaaaacccggttaaaacgttttaacccgttaacccgtttaacccggttttaaccccgaacccccgtttaaccgtttaaccccggttaaccccggggtttaccccgggaaacccgggttaaaacccggggtaacccgtaaacccgggttaaccgggttaaacgggttaaaaccccgggttaaaaccggttttaaaaaccggggaccggttttaacggggg

SEQ ID NO: 56503 - DNA, 799 bp, Homo sapiens
  misc_feature: GYAE6OF01B24P5.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctcgtggcctcccagactaccagatgtgacatccagatcgacccagtctccactccctccctgtctgcatcgtggtgggagacgagacgtacaacgtctacgttcggccgggacgagtcgagggactaattaaactaatttacttacgccgttaggtactacgagcacgctactaccggaagggtaaacgttaccgtaacgtcctaccgtagtactacgttatcgtcgtacgacctacgttacccttacgtttacgacgtaacgtccggtaccggggttaccctacgttccgttccggtttacgacgggttcgggtacgggtaggtaagttagggtacgggtaacgtacgggttacgtttaccgaaccttccctaacccgtaaccgtaacttccgaacgtacccgtaccgtcccgtacggtacccgtaaccggtacccgttaaggaaacgttcggtttacgttaccgtaaccgtttaaacgttttaacgtttaaccgttaacgttaaaccgttaaacgtttaccttaacccgtttacccgtttaccccgacccccgttacgttacccgttaacccggttacccggtaaccccgggtaaacggtaacccgtaaccggttaaccgtaacgggtaaaacgtttaaaccggttaaaaccggtacggttaaccggg

SEQ ID NO: 56504 - DNA, 673 bp, Homo sapiens
  misc_feature: GYAE6OF01E3C42.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgacgggccccccgctcagctcctgggactcctgctgctctggctcccagataccagatgtgacatccagatgacccagtctccatcctccctgtctgcatctgtgganacagagtcaacgtcacgttgccgggcgagtcgaggactaattaacaatttatttacgtcctaggtactcagcagctactccgaagggtaaagttcctaacgctcctagatctagtgctcgactacttccgtactttacgactaacgtacggtacggggttacccctagttcccggttcggttacgtacgggtcgggtacgggttggtaagttagggttacgggaacgtaggtacgtttacctaccgttaccttaccaaccgtagtaccgacgaccacggtccgtgaccgtacgtcgtaagtaacgtattcgttacgactttaactttaacgtttacgtacgttaacgtaaagttacttaccgttacctttacccggacccccttaacgttacccgtacccgttacccggacccggtaacggaacccgaacggtaccgtaaggaacgttaaacgtaaaccgtagttaccggg

SEQ ID NO: 56505 - DNA, 676 bp, Homo sapiens
  misc_feature: GYAE6OF01B1IJ7.29.87.H10.1.454.CMB.1.raw
  modified_base (207)..(207): a, c, t, g, unknown or other
  misc_feature (207)..(207): n is a, c, g, or t
tcagatagagtactcacgaccggtgctcgatttagcagtactgcgttgggtttgggggcagaagtctctctcagtccagacacagcatggacatggacgggcccccgctcagctcctgggactcctgctgctctggctcccagataccagatgtgacatccagatcgacccagtctccatccctccctgtctgcatcgtggtggganacagagtcaacgtcacgttggccgggacagtcgagggctattaaacaatttattagccttggtatcagcagcatccgaagggtaaacttcctaaagcttcctagtactctatgcttcgactactcctactttcgactaactcggtacgggtccctagttccgttcggtacgaggttcgggacggtaggtagtagtaggggaactaggtacgttctacttcgtacacctatacacgcacggtcctcgacacggtctaaggaatacggtgtttacgaaccttaaacgtttagttaaccgtttaagtaaaccgtaaaagttaccgttacctttaacccgtttaccccggaacccccttaacgttacccgtaccccggtttaaccggaaccccgggttaaacgggaaaccctaacgggtaaacccgttacgggtaaaacgttaaaccgtttaaaaaccgggtcgttaacgggg

SEQ ID NO: 56506 - DNA, 653 bp, Homo sapiens
  misc_feature: GYAE6OF01CYXSJ.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtcctccatccctccctgtctgcatcgtggtggganacagagtacaacgtcacgttcggccgggcgagtcgagggactaattaactaatttatttacgccgttaggtactcgagcacgctacgtaccgaaggggtaaacttccgtaacgccttaccgtgtactctagtgtcctcgcctacttcctactttacgactaacgtccgacgggtccctagttccgtcggttacgagggtcggtacggtagtagtagtcgggacgtagtacgttacacttctaccacatcgacgacacgtcctagaccgtacgtccgtagaagtacgttacgttacgtaaccttaagtttacttacgttacgttaacgtaaacttcgttaccttaccgttacccacccctacgttaccccgtaccggttaccggaacccggaacggtaaccgaccggtaaacggttacggaaacgttaaacgttaaccggtagtacggg

SEQ ID NO: 56507 - DNA, 784 bp, Homo sapiens
  misc_feature: GYAE6OF01DW4R6.29.87.H10.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatgacccagtctccatcctcctgtctgcatcgtggtggganacagagtacaacgtcacgttggccgggngagtcgaggactaattaactaattattacgccgttggtatcagcagcatccgaagggtaacgttacctaagctcctgtatctatgctgctactcctactttgactaagtcgtacgggtcctacgttccgtcggttacgaggtcgggtacggtaggtaagtaggttacggggaacgtaggtacggtttacctacgttaccgtacctaacctacgtaccgaacgtaccgtacggtacccgttacggaccgtaaccggtaccgttaacggtaaacggttacgtttacggtttaaccggtaacctttaaaccgttttaacgtttaaccgttaacggtttaaaccgtaaaaacggtttactttaaccccgtttaaccgttttacccccggtaaccccccgtttaaaccgtttaaccccggttaacccccggttttaacccggggaaccccggtaaaacccgggggtaaacccgttaaacccgggttaaacccggttaaacggggttaaaacccgtttaaaaccggtttaaaaacccggtaacggtttaaacccggggg

SEQ ID NO: 56508 - DNA, 689 bp, Homo sapiens
  misc_feature: GYAE6OF01BSDFI.29.87.H10.1.454.CMB.1.raw
  modified_base (107)..(107): a, c, t, g, unknown or other
  misc_feature (107)..(107): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
tcagatagagtactcacgaccggtgctcgatttagcagtactgcgttgggtttgggggcagaagtctctctcagtccagacacagcatggacatggacggcccccgntcagctcctgggactcctgctgctctggctcccagataccagatgtgacatccagatcgacccagtcctccacttccctccctgtctgccatcgtggtggganacagagtcaacgtcacgttgccgggnagtcgaggctattaactattattagccttggtatacgagcagactactaccgaagggtaactttaccgtaacgtcctccgtagtacttcgtagtcgtctacgtctaacttaccttacgtttacgacgtaaacgttccggtaacggggttccctagttcccgttacgggttacgtaaggttcgggtacggtaggtaagttacgggttacgggacgtaggttacgttaccgtaccgttaccgtacccacgtacttaccgacggtaccacgtccttacggcacggtacctaagtaacgtacttcgtacgtacttaacgtttactaacgttataacgttaaatcttaccttaccttccgtaccctacgttacccgtaaccgttacccggtaaccgaaagggtaccccgtaacgtaccggttacggaaacgttaaacgttaaaccgagtttacccggg

SEQ ID NO: 56509 - DNA, 851 bp, Homo sapiens
  misc_feature: GYAE6OF01BA5YE.29.87.H10.1.454.CMB.1.raw
  modified_base (106)..(106): a, c, t, g, unknown or other
  misc_feature (106)..(106): n is a, c, g, or t
  modified_base (213)..(213): a, c, t, g, unknown or other
  misc_feature (213)..(213): n is a, c, g, or t
tcagatagagtactcacgaccggtgctcgatttagcagtactgcgttgggtttggggcagaagtctctctcagtccagacacagcatggacatgacgggcccccgntcagctccgtgggactcctgctgctctggcctcccagactaccagatgtgacatccagatcgacccagtcctccactccctccctgtcctgctattcgtggtggganacgagacgtaccaacgtcacgtcggaccgggtcaggtccgagggacttaaacttaaacctaattttacgtttaacggcccgtttagggtaacttacgaacggcctaaacggtcctaaacgtacccgggtaaagggttaaaaccgtttcccgtaaacgcccgtttaccctaggtaaccttaccgttagtcggtaccttcgtacctacgtttaccccttagtttacgacgtaaaccgttcccgggtaaaccgggttccctaacggttcccggttaggttaccgtaacggggtcgggtaccggggttaacggtaaagtttacgggtacggggtaccgtaaaggttaccgttacccgttaaccgttcgtaacccgtactaacggtacccaaggaccccgtagtcccgtacgaccgtacggtaccgtaagtaacggttaacgttcggttaaccgtaacgtttaacctttaagttaaccgttacgttaaaaccgtaaacgttacttaacccgttaccctttaccccgtaccccctaacgtttaccccgtaccccgggttaacccgaacccgggtaaaccggtacccggtaacggttaaccgtaacgggtaaaatttaacccggaaaacgttccgggttaaccgg

SEQ ID NO: 56510 - DNA, 852 bp, Homo sapiens
  misc_feature: GYAE6OF01B9YD4.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatgacccagtcctccatccctccctgtctgcatcgtgtggganacagagtacaacgtcacgttggccgggcgagtccgagggtactaagttaaactaatttatttacgtaccgttaggttaactacgaacgacaacgtaccgtaacgtaccggtaaacggggtaaaacgtttacccgtaaacggtcccttacccgtaggtaacttaccgttaagtcggtacccgtttagaccgtaacctttaccccttaaccgttttacggaacctaaacgttacccgggtaaccgggggttacccctaacgtttcccgttacgggttccgtaaggttcggggtacgggtaggtaaggttaacgttacggggaacgtaaggttacgtttaccgtaaccttaccgttaacccaacccgtaacgttaccgaacggtaccgaacggtcccgtaggacctacggtacctaaggtaaagttacgttacggttaacggtaacctttaaacgtttaacgtttaaccgtaagttaaaccgtaaaacgtacctttaaccgttacccgttttacccgtaaccccccctaacggttacccgttaaccccggtttaccggggaaaccccgtaaacggggtaaacccgtaacgggtaaccggttaaacgggaaaccgtttaaacgtttaaaaaccgggtaacgttaacccggg

SEQ ID NO: 56511 - DNA, 750 bp, Homo sapiens
  misc_feature: GYAE6OF01EHAQC.29.87.H10.1.454.CMB.1.raw
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
tcagatagagtactcacgaccggtgctcgatttagcagtactgcgttgggtttgggggcagaagtctctctcagtccagacacagcatggacatgacgggcccccgctcagcctcctgggactcctgctgctctggcctcccagataccagatgtgacatccagatcgacccagtcctccatccctccctgtctgcatcgtgtggganacagagtcaacgtcacgttggccgggngagtcgaggcagttaacaattatttacgcctaggtatcgagctacgcactaccgaagggtaaacgttccgtaaagccttaccctaggacttcctaagtcgactgactacttacctacgtttacgactaacgttacggaaccggggtccctaacgttccgttccggttacgtaacgggtcggggtaccgggttaggtaagttacggttacggggaacgtagggttaaccgtttcgtaaccgttaccgtacctaacccgtaacgttaccgacgtaccgaacgttcccgttaccgaccgtaccggtacccgtaaggtaagtacgttttcggttacggtaacccttaaaccttttaacgtttaaccttaacggttaaacctaaaaggttaccttaccgttaacctttacccgtaccccctaacgttaccccttacccggttacccggacccggtaaaccgggtacctaaccggtaacgtacgggtaaaacgtaacgttaaaaccggtacgttaaccggg

SEQ ID NO: 56512 - DNA, 689 bp, Homo sapiens
  misc_feature: GYAE6OF01CLNYT.29.87.H10.1.454.CMB.1.raw
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (294)..(294): a, c, t, g, unknown or other
  misc_feature (294)..(294): n is a, c, g, or t
tcagatagagtactcacgaccggtgctcgatttagcagtactgcgttgggtttgggggcagaagtctctctcagtccagacacagcatggacatggacgggccccccgctcagcctcctgggactcctgctgctctggctcccagataccagatgtgacatccagatgacccagtcctccatccctccctgtctgcatctggtaggganacagagtaccaacgtcacgttcggccgggngagtcgaagggctaagttaaacctaatttatttacgccttggtaatcgagacgancactaccgaaagggtaaacgtttcccaagtcctacctaggactactatcgctacgctactcctacctttgctaacgtcggacgggtccctagttctcggttcgagggtggacggttggagtagtcggggaatacggtgttaccacttacctaccctaccgaactaccgacggtacaacggtccctcggacctacggacccgtaggaaacgttaggttcgttaccgtacttaaacccgttttatttaacgttagttaaaaccttaaacgttaacttacccttaccgtttacccgtaccccccttacgttacccgtacccggttaaccggacccggtaaacgggaacctaccggtaaaccgttcggaaacgttaacgttaaaacggtacgttacggg

SEQ ID NO: 56513 - DNA, 591 bp, Homo sapiens
  misc_feature: GYAE6OF01B4MW7.29.87.H10.1.454.CMB.1.raw
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (346)..(346): a, c, t, g, unknown or other
  misc_feature (346)..(346): n is a, c, g, or t
  modified_base (435)..(435): a, c, t, g, unknown or other
  misc_feature (435)..(435): n is a, c, g, or t
tcagatagagtactcacgaccggtgctcgatttagcagtactgcgttgggtttgggggcagaagtctctctcagtccagacacagcatggacatggagggcccccgctcagctcctgggactcctgctgctctggctcccagataccagatgtgacatccagatgacccagtctccatccctccctgtctgcatctggtgggagacagagtacaacgtcacgttcggccgggcgagtcgagggcaattaacaattatttagcctggtatcagcagcatcgagggaaagttccaagctctgatntangctgcatccatttgcaatcgacgggtcctatcgtcggttnaggtcgggcggtggagtagtggggaactggacgttccacttcctacacctactcacgcacggtccctaggctacggcctaggaacgttnttggttacgtactaacttttaacgttactacgtaactaaaggttctaccttaccttccgacccccttactacccgtaacccggttccggaaccgaaaccgggtaccaaccgggtacgtaacgggttaagtaaaccgttaaaggtaccggttacggg

SEQ ID NO: 56514 - DNA, 708 bp, Homo sapiens
  misc_feature: GYAE6OF01BKXHN.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagctcctgggacctcctgctgctctggctcccagataccagatgtgacatccagatcgacccagtctccactcctccctgtctgctatcgtggtagggagacagtacgtcacgtctacgttcggccgggtagacgtcgaggtactaattaacattttattacgccgttaggtactacgtagacgacgtccactaccggaaggggtaacttacccgtaagccgttcctagtacttcgtatcgctacgctacctcccgtacttacgaccttaagtacccggtacgggtccctacgttccgttacggttcgacgggttcggacgggttagtaacgtagggtacgggtaatacggttaccgttcctacgttacctaacgtaacctactacgaacgtccgaacgtccgtacgacgtaccgttcgtaagtaacggtatttcggtaacgttaacttaacgttttaacgttacgtaagttaacctaagtttacctaaccgttccggttacccaaccccgttataccccggttaccggtacccgggaaccgaacggtacccgaacggtaaggttacggaaacgtttaaaccggttaaagcgttacggg

SEQ ID NO: 56515 - DNA, 845 bp, Homo sapiens
  misc_feature: GYAE6OF01EX9H4.29.87.H10.1.454.CMB.1.raw
  modified_base (501)..(501): a, c, t, g, unknown or other
  misc_feature (501)..(501): n is a, c, g, or t
tcagatagagtactcacgaccggtgctcgatttagcagtactgcgttgggtttgggggcagaagtctctctcagtccagacacagcatggacatgacgggccccccgctcagcctccgtgggactcctgctgctctggcctcccagactaccagatgtgacatccagatcgacccagtcctccactccctccctgtctcgctacttcgtggtagggacacgaggtacgtaccaacgtctacgttcgggcccgggacgtacgtcgaaggactaattaactaatttattacgtccgttaggtactcgagacagacgtactaccgaacgggtaacgtttaccgtaaacgtccttacccgtaggtaacttacgttaagtcggtccttacgtacctaccttaaccgtaccttttacggacctaacgtcccgggtaacggggtacccccttaggttcccgttacggttcgagggttcgggtacggtaggtaacttagggtacggganacggttacgttcctaaccttcctacgtaaccctagtaccgactaccggaccctccgttacggaccctacggtacccgtaggaacgttacgttacgttaacggttacctttaaaaccggttttacgtttaaccgttaaacggtttaaaccgttaaaaccgtttaaaccgtttacccgtttaaaccccgttacccccgggttaaccccccttaccgtttaaccccgttaaccccgggttaccccgggtaaaacccgtaaccgggtaaacccggttaaaccgggtaacccgggttaagggttaaaaccggtttaaacccggtaaaaccgttaccgggttaaccgggg

SEQ ID NO: 56516 - DNA, 572 bp, Homo sapiens
  misc_feature: GYAE6OF01AORDY.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttggccgggcgagtcgagggcattaacaattatttagcctggtatcagcagcatccgaggaaagttcctaagctcctgatctatgctgcatccactttgactaagtcgacggggtccctattcgtcggttcgagtgggtcggtggtattaggtcgggacgaggtacgttcaccgttactcacctaactcgacgcagtcccgtcgcaccgtcgtaggaagtagttgttacgtactaacgtttatttacgttagtaacttaaagtcgttactaccctttaccgaccccctaacgtccctaccgttccggaccgtaacgggacaccgtaccgtaggtaacaacgttaaacgcgtacgg

SEQ ID NO: 56517 - DNA, 514 bp, Homo sapiens
  misc_feature: GYAE6OF01E33FI.29.87.H10.1.454.CMB.1.raw
  modified_base (395)..(395): a, c, t, g, unknown or other
  misc_feature (395)..(395): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattatttagcctggtatcagcagcatccagggaaattcctaagctcctgatctatgctgcatccactttgcaatcacgggtccatctcgttcagtggcggtggatagtgggacagtagttcacgtctcaccatcagcagcctgcagcctaganatgtagactacttattactgtaacaaagtactctacttaccgccccctatccctaccgttaccggccctaaacgggaccaccgtaacgtacggaaagtacgttaaaacgacgttacggg

SEQ ID NO: 56518 - DNA, 696 bp, Homo sapiens
  misc_feature: GYAE6OF01AU7CT.29.87.H10.1.454.CMB.1.raw
  modified_base (106)..(106): a, c, t, g, unknown or other
  misc_feature (106)..(106): n is a, c, g, or t
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagatagagtactcacgaccggtgctcgatttagcagtactgcgttgggtttgggggcagaagtctctctcagtccagacacagcatggacatgagggcccccgntcagctcctggactcctgctgctctggctcccagataccagatgtgacatccagatcgacccagtcctccatccctcctgtcctgcatcgtgtgganacgagatcaacgtcacgttcggccgggngacgtcgagggcctaattaacaatttatttacgccttggtaatcgagcagacacgtaccgaaggtaacgttacctaacgtccgtcctagtactcgtatcgctcgactacttcccgttacgtttacgactaacgtaccggtaccgggtaccctagttccgttacggttacacgggttcgggtaccggttaggtaacttaggtacgggactaacggttacgttacctaccttacctacccgaaccgtactacgaccggactaaccggtccctgaccgaccggttccgtaaggtaacgttcgttaagtacgtaacctttaacgtttacgttacgttaagttaaaccgtaaattccgtaaccgttccttacccggacccttacgtacccgttaccggttacccgaacgttaaccgggtaaccaaccgggtacgtaaggtaaacccgtacgttaaaacgtccggttacgg

SEQ ID NO: 56519 - DNA, 576 bp, Homo sapiens
  misc_feature: GYAE6OF01BPAQT.29.87.H10.1.454.CMB.1.raw
  modified_base (203)..(203): a, c, t, g, unknown or other
  misc_feature (203)..(203): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatgacccagtctccatcctccctgtctgcatctggtggganacagagtcaacgtcactggccgggcgagtcgaggcattaacaattattagcctggtatcagtcagcatccgaaggaacgttcctaagtctcctgactctatgctgcatcctactttgactaatcgacggggtcccagtcgtcggttcaggtcggtcggtggattaggtcgggacaggtatttccgacttacctacgaacctacgtacaacggctaacgcctgacacgtccgtagaagtacgttgttacgacctaacgtttacttaccgtagtacaactagtacttacgtaaccgttaaccctaccgttaacgttaccgtttcgggaccgtaaggggtaccgaagggtacggaagagtaacaaaacgtgtacgg

SEQ ID NO: 56520 - DNA, 812 bp, Homo sapiens
  misc_feature: GYAE6OF01ESMCQ.29.87.H10.1.454.CMB.1.raw
  modified_base (107)..(107): a, c, t, g, unknown or other
  misc_feature (107)..(107): n is a, c, g, or t
  modified_base (406)..(406): a, c, t, g, unknown or other
  misc_feature (406)..(406): n is a, c, g, or t
tcagatagagtactcacgaccggtgctcgatttagcagtactgcgttgggtttgggggcagaagtctctctcagtccagacacagcatggacatgacgggcccccgntcagctccgtgggactcctgctgctctggctcccgagactaccagtatgtcgactatccgaagactaccgacccacgttcctaccctacgttccccttcccgtcgtctcgtctagttcgtaggtagggaacgacaggacgttacgaaccgttcgacgttcgggccgggagtacgtacgaggtactaacgttaacttaagtttacgttacgtcgttaggtactacgagtccgagactacgtaccggaaaggttaacgttacccgtaaggtccttacgtagtactcgttactgtccgtacncgtaccttacctacgttacacgtaaccggtcgtacggtacctacgtccggttacggtacggtaggtacgggttacggacgttaggtaacgggtacggtacgtaccggttaacgttacctaccgttaccctacgtaaccgtacgtacccggacgtaccgtaaccgtccgtagtaccccgtaacggtacccgttaaggtaacgttacggttaacgttacgtaaccctttaacgtttacgttaaacccgttaaggtttaaacccgtaaaccgtttacgtacccgttaaccccgttttcccgaaaccccttacggttaccccggtaacccggttaacccgggtaacggtaaaccggtaaccgtacgtaaccgggtaacggtaaacgtaacggttaaccgacggttaacgg

SEQ ID NO: 56521 - DNA, 741 bp, Homo sapiens
  misc_feature: GYAE6OF01D3HET.29.87.H10.1.454.CMB.1.raw
  modified_base (107)..(107): a, c, t, g, unknown or other
  misc_feature (107)..(107): n is a, c, g, or t
  modified_base (205)..(205): a, c, t, g, unknown or other
  misc_feature (205)..(205): n is a, c, g, or t
  modified_base (388)..(388): a, c, t, g, unknown or other
  misc_feature (388)..(388): n is a, c, g, or t
tcagatagagtactcacgaccggtgctcgatttagcagtactgcgttgggtttgggggcagaagtctctctcagtccagacacagcatggacatgacgggcccccgntcagcctcctgggactcctgctgctctggctcccagataccagatggtgacatccagatcgacccagtctccatcctcctgtctgcatctggtggganacgagacgtacaacgtcacttggccgggcgagtcgaggacagttaacaattattagcctggtatcgacgtcagcactaccgaagggtaaacgttcctaaacgcttaccgtgtacgttctattgactgacctactccttactttgactaacgtcgtacggggtcctacgttcgttcggttacgnggtggtcggtaggagttaggtcgggacgagtacgttcgacttaccgtaccctaactacgttacgacgtaccgtaacggtcccgttagcccgtaaggtccccgttaagggtaaacggttaggtttaaccgggtttacgtaacccgttaaaaccgttttaactttaccttaacgggttaacctaaccggttaacgttaaccggttttaaacgtaaacccggtttaaaccccctttaccgggtttaaacccgtttaccggttttaccggggtaaaccggaaaccgggggtaacccggtaaaacggggtacggtaaaacggtacgttaaaacccgaaaccggttacggttaacgggg

SEQ ID NO: 56522 - DNA, 702 bp, Homo sapiens
  misc_feature: GYAE6OF01A8NHM.29.87.H10.1.454.CMB.1.raw
  modified_base (207)..(207): a, c, t, g, unknown or other
  misc_feature (207)..(207): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtcctccatccctccctgtctgcatcgtggtaggganacagacgtaccaacggtcctacgttcggccgggacgtagtcgagggactaattaaactaatttacgtttacgccgttaggttacacgtagcagctacgtaccggaagggtaaaccttaccaagtcctacgtgtattctatcgactgacctactaccttacgtttacgactaacgtcggtacgggtccctattccgttcggtacgtaggtcggtcggtagtaggtaggtacgggactaggtacgttctaccgtctaccgacctagtcgaacgcctacggtaccgcgacgtaccggtcgtaacggtaacgtaggtttactaaccggttaacctttaaagtttaaccttacgtaacgttaaaccgtaaaacgttccttaaccgtttaacccttccccgacccttaccgttacccgtaccccggtacgggtaacccgaaaccgggtacctaacgggtaaccgtaggtaaacgttaaaccgttaaacggtcgttaacggg

SEQ ID NO: 56523 - DNA, 674 bp, Homo sapiens
  misc_feature: GYAE6OF01ATGCJ.29.87.H10.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
tcagatagagtactcacgaccggtgctcgatttagcagtactgcgttgggtttggggcagaagtctctctcagtccagacacagcatggacatgagggcccccgctcagctcctgggactcctgctgctctggctcccagataccagatgtgacatccagatgacccagtcctccatccctccctgtctgcatctggtggganacagacgtcaacgtcacgttcggccgggngagtcgagggtactaagttaactaatttattacgccgttaggtactcgacgtcacgctacgtaccggaagggtaacttccgtaagtcctaccgtaggtactacctagtcgtctacgactactcctacgttacgactacgtcgacggtcctagttcgtcgttacaggtcggtcgtaggagtaggtggtactagtacgttacacgtcctactaccacgtacgagtccgtacgtcctacgtaccgacgtccgtaagtaacgtagttacgttacgtaccgttaaagtttacttacgttaacgtaaacgttaacgttctacccgtttaccgttacccgacccgttaaccgtacccgttaccggttacccgggaaccgtaaacccgggtaccgttaaccggtaacggtagggttaaaaccgtaacgtttaaacgggccggttaacggg

SEQ ID NO: 56524 - DNA, 764 bp, Homo sapiens
  misc_feature: GYAE6OF01BKLOG.29.87.H10.1.454.CMB.1.raw
tcagatagagtactcacgaccggtgctcgatttagcagtactgcgttggggtttgggggcagaagtctctctcagtccagacacagcatggacatggaccgggccccccgctcagcctccgtgggacctcctgctgctctggctcccagataccagatgtagacatccagatcgacccagtcctccactccctccctgtctgccatcgtggtagggacacagtacgtaccaacgtcctacgttcggcccgggcgaagtccgaagggactaattaaactaatttattacgccttaggtatacgagcacgactacgtaccgaagggtaaaccgttccgtaacggtccttaccgtagtacttaccgttagtcggtctacgacctacttacccgtacgtttcgactaacgtccggtacgggtccctagttccgtacggttcgagggtcgggtcggtagtacgttaggtacgggtactacggttacgtacctacccttacgtacccaccgtacgtaccgtacgccgacgtcccgcgaccgaccggtaccgtaaggtaacgttacgttcgttaaccgttaaccgttaaactttacgttaaccgtaacggttaacttaaacgttaccttacccgttacccgttttccccgaaccccgtttaccgtaaccccggttacccggttaacccgggaaccggtaaacccgggtaaccgaccgggtaaaccggttaacgggaaacgtttaaaccgttaaacccggtaggtaaccggg

SEQ ID NO: 56525 - DNA, 559 bp, Homo sapiens
  misc_feature: GYAE6OF01D03AF.29.87.H10.1.454.CMB.1.raw
  modified_base (201)..(201): a, c, t, g, unknown or other
  misc_feature (201)..(201): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
  modified_base (468)..(468): a, c, t, g, unknown or other
  misc_feature (468)..(468): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctcctgtctgcatctgtggganacagagtccaacgtcacgttggccgggcgagtcgaggcattaacaatttattagccttggtatcagcagcatccgaagggtaacttccgtaagctacctgatctatgctgctatcctacgtttgctaagtcgacgggtcccagttccgtggttcaggtcggcggtggatagtgggactaggtacgtcacttctaccacctatacacgcacgtccngccagtccctagagngttgtcgactaacgtttattactagtaactaaagttntacctacgttcccgacccctagtacccgtacccgttcggaccggtaacgggaccaccggtacgtacgggataaacgttaacgcgttacggg

SEQ ID NO: 56526 - DNA, 738 bp, Homo sapiens
  misc_feature: GYAE6OF01ERNRE.29.87.H10.1.454.CMB.1.raw
tcagatagagtactcacgaccggtgctcgatttagcagtactgcgttgggtttgggggcagaagtctctctcagtccagacacagcatggacatgacgggccccgctcagctcctgggactcctgctgctctggctccagactaccagatgtcgacatccagactacgacccagtcctacctactccctcctagtctcgactagtcgtagggtgggaactacgagtacgtaccaacggtcctacgttcgggaccgggtacgtacgtacggacgggtactaacgttaaacctaatttaacgtttaccggtaccgttagggttactacgacggtacgaacgtacgtaacgtaaccgggtaaacgggtaaccgtttaccgtaacgtccttaccgtagtacttactacgtcgtactacgtacctacgtaccttacgttacgtaaccgtaacggtcccgggtaaccggtaccctaacggttccgggttacggttcggtaacggggtcgggtaacgggttacggtacgtaacgggtacgggaactacggttacgttaccgtaccttaccgtacccacctacgtacgaaccgtccgtacgtccgcgtacgaccgtacgtacgtagtacgtcgtaactacgttaacttgttaacgttagtaactacgtactcttacccttaccgactccgtacgtaccgtaccggacgacgtacgactacgtacgtaagtacgtaaagtcgtacgg

SEQ ID NO: 56527 - DNA, 675 bp, Homo sapiens
  misc_feature: GYAE6OF01DRIV3.29.87.H10.1.454.CMB.1.raw
  modified_base (342)..(342): a, c, t, g, unknown or other
  misc_feature (342)..(342): n is a, c, g, or t
tcagatagagtactcacgaccggtgctcgatttagcagtactgcgttgggtttgggggcagaagtctctctcagtccagacacagcatggacatgacgggcccccgctcagctcctgggacctcctgctgctctggctcccagactaccagatgtgacatccagatgacccagtcctccatccctccctgtctgcatcgtggtgggagacagagtcaacgtccacgttcggccgggcgagtcgagggtctaattaaactaatttattacgccttaggtactcagacagctacgtaccgaagggtaaacttaccgtaacgtccttcctagtactctatgcgtnactactcctactttgactaacgtcggacggtccctagttccgtcggttctacgggtcgggaggttaggtagtaggtacgggacgtagtacgttacctacttccctactaaccgtataccgacgtaccacggtccgtacgccgtaacgtcgtaaggtaagttacgttagttacgttaccttaacgttttaacttacggttaacgttaattaaaccggtctttaacccgttaccttacccgaccccttacgtcccgttacccggttacggaacccggtaaacggacccgaacgtaccggtaacggtattaaacggttaaaccggtcgttacgggg

SEQ ID NO: 56528 - DNA, 739 bp, Homo sapiens
  misc_feature: GYAE6OF01ACR6Y.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagctcctgggacctcctgctgctctggctcccagactaccagatgtgacatccagactcgacccagtcctccactccctccctgtctgcatcgtggtaggacgacagtacgtacaaccgtcacgttcggccgggcgtagtcgaggactaattaactaagtttatttacgccgttggtaactcgtacgctacgacctaacgtaccggtaaggggtaaacttccctaaggtccttccgtagtacttacctaagtcgtcgtagcctactacctacttcggacctaaacgtccggaacggttacctacggttccgtacggttccgaggtcgggtacgtaggtagtacggtacggacgtacggtacttaccgtacctccgtaaccgtacgacgtacgtaccgaccgtaccggtcctaacggcctacggtacccgtagtaacgtacgtttcggtaaccttaacctaagtttaaccgttacgttacgttaaactaaacgttccctttaaccgttacccgtttacccgaacccgttacccgtaccccgttaccgtaccgggtaaacccgtaaaccgggtacccgtaacgtaaccgggtaaggtaaaccgttaaacccggttaaaggtccgttaacggg

SEQ ID NO: 56529 - DNA, 780 bp, Homo sapiens
  misc_feature: GYAE6OF01EDKDH.29.87.H10.1.454.CMB.1.raw
  modified_base (206)..(206): a, c, t, g, unknown or other
  misc_feature (206)..(206): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtcctccactcctccctgtctgcatcgtggtggganacagagtcaacgtcacgtcggccggcgagtcgaggactaattaaactaatttattacgcgttagtactcagcagctacgtaccggaagggtaacttccgtaaaggtccttccgtagtacttacttagtcgtccgtacgtacctaccttacccgttacgttttacggaaccttaacgttacccggtaaccggggttcccctaacggttttcccgggttaccggttcggtaacgggtcggggtaacggggttacggtaaggttacgggtacgggtaacggttaacggtacggtttacctaccgttaccgttacccaaccgtactaccgaaccggtccgtaccggtccgtacggaccgtaccgtacgttaagtaacgtttagtttaccgtaacctttaacgtttacgttaaccgttaacgttaacccttaaactttaacctttaaaccgtaaccttaaccctaccgtaaaccgtttaccggtacccggttaccgggaacccggtaaacccgggtacccgggtaaacggtaaacccggaaaccgtaacggaaccggttacggttggtcccggtaccgg

SEQ ID NO: 56530 - DNA, 743 bp, Homo sapiens
  misc_feature: GYAE6OF01BG48S.29.87.H10.1.454.CMB.1.raw
  modified_base (203)..(203): a, c, t, g, unknown or other
  misc_feature (203)..(203): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtctccatccctcctgtctgcatctgtaggganacagacgtacaacgtcacgttggccgggacagtcgaggctaattaactaattattagcctaggtatcagcagctactaccgaagggtaaactttacctaacgtccttacctagtacttactatcgtctagacctacttaccctactttacgacgtaacgtccggtacgggtaccctacgttccgttacggttacgtagggttcgggtacggtaggtaacgtaggtacgggtaactaggttacgttacctaaccttaccgtaaccgtaaccgtactacgacggtacccacggtcccgtacggacctacggtaccgttaaggtaaacgtttacgttttacgaacctttaacgtttaacgttaccgttaacgttaacctaaaccctttaaccgtttaaacctaaaccttttaaccccgtaacgttaaaccgtttaaccgggtccccggttaaccgggtaaacccggtaaacccggggtacccctaaaggggttaacccggaaaacccgtaacggaaccgtaaacggttcggtacggtaacccg

SEQ ID NO: 56531 - DNA, 697 bp, Homo sapiens
  misc_feature: GYAE6OF01BTYN7.29.87.H10.1.454.CMB.1.raw
  modified_base (107)..(107): a, c, t, g, unknown or other
  misc_feature (107)..(107): n is a, c, g, or t
  modified_base (208)..(208): a, c, t, g, unknown or other
  misc_feature (208)..(208): n is a, c, g, or t
tcagatagagtactcacgaccggtgctcgatttagcagtactgcgttgggtttgggggcagaagtctctctcagtccagacacagcatggacatgacgggcccccgntcagctcctgggactcctgctgctctggctcccagataccagatgtgacatccagatcgacccagtcctccatccctccctgtctgctatctggtaggganacaggactaccaacgtcacgttcggccgggagagtcgaggctaagttaactaatttattacgcctaggtatcagcagcactaccgaagggtaacttccgtaacgtccgttcctagtactactagtcgtcctgactactcctacgttcgactaacgtcgtacgggtaccctacgttccgttcggttcgtagggtcgggtacgggttaggtaacgttaggtacggggaactacgggttacgtttaccgaccgttcctaccaaccgtactaccgacgtaccgtaacgtccgtacgtaccgacgtaccgtaagaagttcttacggttacgtaaccttaactttacgttaacgttacgtaacgtaacgttactaccgttaccctttaccgaccccttacgttaccccgtacccggttacccggaaccgaaccgggtaacctaaccggttacggtaacggtaaacgttaaacgttaaaccggtacggttaccggg

SEQ ID NO: 56532 - DNA, 693 bp, Homo sapiens
  misc_feature: GYAE6OF01BSTVE.29.87.H10.1.454.CMB.1.raw
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (272)..(272): a, c, t, g, unknown or other
  misc_feature (272)..(272): n is a, c, g, or t
tcagatagagtactcacgaccggtgctcgatttagcagtactgcgttgggtttgggggcagaagtctctctcagtccagacacagcatggacatggacgggcccccgctcagctcctgggactcctgctgctctggctcccagataccagatgtgacatccagatcgacccagtcctccatccctccctgtctgcatctggtggganacagatcaacgtcactggccgggngagtcgaggctaattaacaatttattagcctgtatcagcancatccgaagggtaaacttcctaagcctaccgtagatctatgctgactactcctaactttgactaatcgacgggtccctaagtccgtcggttctaggtcggaggtacggaataggtagggacgtaggtacgttaccgtactacctaccgtaacctaactacgtaacgaccgaacgtcccgtgacccgtacggacccttaaggaacgtacgttcggttacgtaaccgttaaacctttaagtttaaccgttagggttaaacctaaaaacggtttacctaaccctttaaccgttttccccgaaccccccgttagttaaccccgttaaccccgtttaccgggaaacccgtaaaaccggggtaaccctaaccgggtaacgtaacgggtaaacgtaaaacggtttaaaaccggaacgtttaaccgggg

SEQ ID NO: 56533 - DNA, 747 bp, Homo sapiens
  misc_feature: GYAE6OF01EQDZH.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcagggcattaacaatttattagcctggtatcagcagcatccgaaggggtaaacttccgtaagccttacctgtactctatcgtctgacctactcctacgtttgactaaacgtccgaacggggtcccctagttccgttcggttacgtacgggtggtacgggtggtaagtagttaggggtacctaaggttacgttacctaccgttaccttacccgaaaccctagttaccgaacgtcccgtaacgtccccgtaggtacccgtaacggtcccgtaaggtaacgttacgtttagtttaccggtaacccgttaaaacgtttttaacgtttaaccttaacggttaaaccttaaaaacgttcttaacccgtttaacccgtttaccccgacccccccgtttaaacgttcccccgttaaccccggtttacccgggaaccccggtaaaccggggtaacgtaaaccccggttaacggtaccgggttaaaacggtaaaccggttttaaaacccgaccgggtttaaccggg

SEQ ID NO: 56534 - DNA, 867 bp, Homo sapiens
  misc_feature: GYAE6OF01A04YR.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtcctccatccctcctgtctgctatctggtggganactagacgtcaacgtcacgttcggccgggagtagtcgacggggctaacgttaaactaactttaacgtttacggtcccgttagggttaattccgtaaggaccgaacggtacctaacggtaacccggtaaacgggggtaaaacgtttcccgtaaaacggtccctttaccgttacggtaactacgttacgtcgtccgtacggtacctacgttaccctacgtttacggacctaacgtccggtaacggggtcccctaacgttccgttcggttcgtacgggtgggtaccggttaggtacgttaggtacggggtacgtaacggtacggttaccgtaccttaccgtacctaacccgtacgtaccgaacgacgtaacggtccgtacggtaccgaccggtaccgtaacggtaacggtacggttacgttaaccggtaacctttaaaccgtttacgttttaaccgttaacgttaaaccgtaaaacgttaaccttaaccggttaacccgttttaccccgaaccccccgtttaaccgttacccggttaacccccggtttaccccgggtaacccgggtaaaacccgggttaacccggtaaacccgggttaaacccggttaaccgggttaaaccggttaaaaccggtttaaaacccgggttaaccggttaacccgggg

SEQ ID NO: 56535 - DNA, 802 bp, Homo sapiens
  misc_feature: GYAE6OF01BUR5K.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggcctcccagataccagatgtgacatccagatgacccagtctccatcctccctgtctgcatcgtggtggganacgagtagtacaacgtcacgttcggccgggcgagtcgagggactaattaactaatttatttacgccgttaggtactcaacgtcaggactacgtaccggtaaaggggtaaacgtttcccgtaaacgtcccttaccgttaggtaactacgttaacgtcggtaccgttacggaccttaaccgttacccgttaaccgttttacgaccgtaaacgttcccgggtaaaccgggggttacccctaacgtttacccggttccggtttaacggtacggggttacggggtccggggttaaggtaacggttacgggtacggggtaacgtaacgggttaaccgtttacctaccggttaccttaccccgaaacctacgtaccgaacgtaccgtaacggtcccgtacgaccgtacgtaccgtaaggtaacgttaggttaccgttaacggtaaccttaaacgtttacttaacgttacgttaacgtaaaacgtttccttaacgttaacccgtttcccgaacccctaacgttccgtaaccccgttccgggtaacccggaaaccggtaccgtaacggtacgtaacgggtaactaaacgttaaaccggtgtacggg

SEQ ID NO: 56536 - DNA, 796 bp, Homo sapiens
  misc_feature: GYAE6OF01CIHY0.29.87.H10.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
tcagatagagtactcacgaccggtgctcgatttagcagtactgcgttggggtttgggggcagaagtctctctcagtccagacacagcatggacatgacgggcccccgctcagcctcctgggacctcctgctgctctggcctcccagataccagatgtgacatccagatcgacccagtctccactccctccctgtctgcatctggtggganacagagtcaacgtctacgttcggccgggngagtcgagggctaattaactaattattacgccgtaggtactcgagcagacacgtaccggaagggtaaacgttcccgtaacgtcctacgtgtatcttactcgtctgactacttccgtactttgacctaagtccggtacgggtaccctacgttccgtacggttcgtagggtcgggtaccgggtaggtaacgttacgggttacggggaaccggttaacggtaacggtttccctaacccgttacccgtaaccctaaccgtaacttaccgaacggtaccgtaccggtaccgttcggaacccgtaccggtacccggtaagggtaaccggttacgtttacgggttaacccgttaaccgtttaaaaccgtttttaacgttaacccggtttaaacgttaaaccgtaaaaccggtttaacctttaccccgttaacccgttttaccccgaaccccctttaaccgttacccgttaacccccgggttaccggtaaacccggaaccgggtaacccgtaacccggtaacggtaacggtaaacgtaaccggttaaaacggtccggttaacggg

SEQ ID NO: 56537 - DNA, 761 bp, Homo sapiens
  misc_feature: GYAE6OF01EQQE1.29.87.H10.1.454.CMB.1.raw
  modified_base (209)..(209): a, c, t, g, unknown or other
  misc_feature (209)..(209): n is a, c, g, or t
  modified_base (525)..(525): a, c, t, g, unknown or other
  misc_feature (525)..(525): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctccagactaccagatgtgacactccagatcgaccctagtctccactccctcctgtctcgcatctggacggganacgagtcgtacaacgtcacgttcggccgggagtacggtacgagggtactaattaaactaatttacttacgtccgtaggtactacgacgtacagactaacgtaccgaaagggtaacgttaccgtaacgtccgtaccttagacttacttacgtcggactcgtacgtaccttacctacgtttcggaacctaacgtacccggtaaccggggttacccgtaactttcccgggttccggttaacggtacgggtcggggtacgggtaaggtaacgttagggtacgggtacgtaacggtacgttactacgtctacccgaacttnaaccgactacgacgtactcgacgtacggtactaggaagtacgttcgtagtaacttaactttacgtttacggtaactaaacggtaaactttacacccgtttaccttaccccggtaacccctacgtttaaccccgttacccgggttaacccggaccgggtaaaacccggggtactaaaaccggtaacggtaacggggtaaaactttaaacccgggttaaaacgtcgtttaaaccgggg

SEQ ID NO: 56538 - DNA, 764 bp, Homo sapiens
  misc_feature: GYAE6OF01E4L06.29.87.H10.1.454.CMB.1.raw
  modified_base (205)..(205): a, c, t, g, unknown or other
  misc_feature (205)..(205): n is a, c, g, or t
  modified_base (326)..(326): a, c, t, g, unknown or other
  misc_feature (326)..(326): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtctccactccctccctgtctgcatctggtggganacagacgtcaacgtccacgttcggccgggcgagtcgagggcaattaacaatttattacgcctggtatcagcagcacgtccgaaggggtaacttaccgtaagtctccgtagtactctagtcncgtcgctacctcctactttcgacctaacgtaccggtaccggggttaccctacgtttccgtaccgggttcgtaacggggtttcggggcgggttacggtaacgttacgggtacggggtaacgacggttaacggtttcctacctttaccgtaccctaaacctcgtaccgtaccgaccgtacgtcccgtacgacccgtaccgtacccgtaaggtaacgtacgtttcggttaacgtaacctttaaacgtttactttaaccggtaacgttaaccgttaaaacgttcccttaaccttacccgttttaccccgaccccccgttaacgttacccccgttaacccggttaccccgggaaccggttaaacccggggaacccttaaacccgggtaaccggtaacgggtaaacgggtttaaaacttaaaacccgggtacggtttaccgggg

SEQ ID NO: 56539 - DNA, 933 bp, Homo sapiens
  misc_feature: GYAE6OF01CB373.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtgganacagacgtcaacgtcacgttggccgggacgagtcgagggctaattaactaattattagccgtggtatcgagcacgcacgtaccgaaggggtaaacgtttccgtaacgtccgttacctaggtacttcgttaacgttcggtcctcgtacctaacttcccttacgttttacgacctaaacgttcccggtaaccgggggttaccctaacggtttccggtttaccggggtttaccgtacgggggtttacggggtaccgggggttaaggtaacggtttaacgggttacggggggtaaccgtaacgggttaaccggttttaccgtaacccgtttacccgttacccgtaaacccgtaacgttaacccggttaacggacccgtaaccgggtccccgtttaacgggacccgtaacggtacccggtttaacggtaaacggttaacgtttacgggtttaaccgttaaccttaaacccggttttttaaaccgtttaaccggtttaaacggttaaacccgtttaaaaacggtttacccgtttaaccgttttaaacccccggttttccccgtaacccccccgtttaaccgtttaacccccggtttaacccccggggtttaaccccggggtaaaccccggggtaaaacccggggttaaccccgtaaacccggggttaaaccgggtttaacggggtaaaacccgggttttaaaccgtttaaaaacccggggtacggtttaaaccggggg

SEQ ID NO: 56540 - DNA, 716 bp, Homo sapiens
  misc_feature: GYAE6OF01B9M6L.29.87.H10.1.454.CMB.1.raw
  modified_base (105)..(105): a, c, t, g, unknown or other
  misc_feature (105)..(105): n is a, c, g, or t
tcagatagagtactcacgaccggtgctcgatttagcagtactgcgttgggttgggggcagaagtctctctcagtccagacacagcatggacatgagggcccccgntcagctcctgggactcctgctgctctggctccagataccagatgtgacatccagatcgaccctagtcctccatccctcctgtctgactatctggtggagacagagtaccaacgtcacgttcggccgggtagtagtccgagggactaattaacgtaattattacgccttaggtatcagacgagacacgtaccgaagggtaaacttccgtaagtccttaccgtagtactctatcggctagtactacgttcctagtttcgaccgtaagttccggaccgggttcctacgttcgttccggttagacggttcgggtacggtagtacgtagtacgggacgtagtaccggttcctaaccttcctaccgaaccgttaacgttccgaaccggcctaaccggtcccgtcgtaccgtaccgtacgttagaaacgttcgttacggttaacaacctttaaagtttacttaacgtacgtaacgttaaagtaccttccggtaaccgttcccctaaccccgtagttacccgttaaccccgggtaaccggtaacccggtaaacgggaccccttaacgggtaaacccgtacgggtaaaacttaaacccggttaaacggtacggttccggg

SEQ ID NO: 56541 - DNA, 658 bp, Homo sapiens
  misc_feature: GYAE6OF01AFMBG.29.87.H10.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtctccatccctccctgtctgcatcgtggtaggganacagagtcaacgtcacgttcggccgggngagtcgagggctaattaactaatttattacgccttggtactacgagcacgctacgtaccggaagggttaaacgttccgtaacgtccttccgtagtacttactagtcgtctcgactacttccttactttacgactaacgtcggtacgggtccctacgttccgttcggttcgtacggtcgggtacggtggtagtaggtacgggacgtaggtacgttcaccttcctaccactactcgacgtcacgcctagcgacgtccgtaggaagtcgttgttacgacttaacgtttacgtacgttaataacgtaaacgttaccttaccttaccgttaccctacccctaacgttcccgtacccggttaccggaacccgtaaccgggaaccgtaccggtaacgttaggaaaccttaacgtaaacgtacggttacggg

SEQ ID NO: 56542 - DNA, 662 bp, Homo sapiens
  misc_feature: GYAE6OF01EX68N.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctccagactaccagatgtgacatccagatcgacccagtcctccatcctccctgtctgcatctggtggagacagacgtcaacgttcacgttcggccgggacgtagtcgaagggctaagttaactaattattagcctaggtatcagcagctagtaccgaagggtaacttccgtaacgtctactgactctatcgctgcctatcctagtttcgactacgtcggtaccgggtaccctagttccgtcggttcgtagggtcgggtacggtaggtaacgtagggtacgggactaggtacgttacactcgtaccaacgtacgtcacgtaccacgtccgtagaccacgtacgtagaagttacgttacgttacgtaaccttaactttaacgttacttaacgtaaacgttaaacgttacctaccgttaccgtttaccccgaccctacgttaccctaacccggtttaccggaaccggtaaacgggacccgtaaccggtacggttacggtaaacgttaaacgttaaacggtaacgttacggg

SEQ ID NO: 56543 - DNA, 759 bp, Homo sapiens
  misc_feature: GYAE6OF01CKWFH.29.87.H10.1.454.CMB.1.raw
  modified_base (232)..(232): a, c, t, g, unknown or other
  misc_feature (232)..(232): n is a, c, g, or t
  modified_base (399)..(399): a, c, t, g, unknown or other
  misc_feature (399)..(399): n is a, c, g, or t
tcagatagagtactcacgaccggtgctcgatttagcagtactgcggttggggtttgggggcagaagtctctctcagtccagacacagcatggacatggacgggccccccgctcagcctccgtgggacctcctgctgctctgcctccagactaccagtatgtacgacactccaaggactccgaacccctatcctaccctactccctcccttgtctcgactatcggtggagganacgagtagtactaacgtctacgtcgggccgggagtacggtacggacgtactaattaactatttatacgtcgtagactagagtcagactaactaccgggaaaggttaactaccgaactcccgtacgtagtactttcacgtcggtaccttacactaccgtactttactnaccgtaacgtacgggaccgtttccacggtttacgtaccggtaagtgggtaccgggtaggtaaggtacggttagaccgggacgtacgtacgttaccgactacctacccaacgtactaccgaggacctaccgacgtacacgtaccgaacgtagtaagttacggttataacggttaaccttaaagtttaaccgtttaataacgtttaaaccgaagtttacctaacccggttacccttaccccgaaaccttacccgtacccggtaaaccccggttacccggaaaccggtaacccggttaacggtaacccgtaacgggttaaccggtaaaacgttaaaccgtaaacgggtttaaaccggtccggg

SEQ ID NO: 56544 - DNA, 706 bp, Homo sapiens
  misc_feature: GYAE6OF01C5WKH.29.87.H10.1.454.CMB.1.raw
  modified_base (395)..(395): a, c, t, g, unknown or other
  misc_feature (395)..(395): n is a, c, g, or t
tcagatagagtactcacgaccggtgctcgatttagcagtactgcgttgggtttgggggcagaagtctctctcagtccagacacagcatggacatggacgggcccccgctcagctccgtgggactcctgctgctcgtcggctcccagactaccagtatgtgacatccagactcgaccctagtcctacctcttccctccttgtcctgactagttcgtggacggagacagtacgtacaacgtcacgttcggccgggagtagtcgaggactaaattaactaattatttacgaccgttgtaactcgagcgagtcacgtaccggaaagggtaaactttccgaacgtccttaccgtatacttcgttaactcgtaccgtcgtacctacttaccttaccggttnaaccgttaacgtccgggtaacggtccctagttccgttggttacgaggttcgggaggttagacgttaggacgggactaggtacgttacctaccttcgactaccgtaagtcacgcctacgtccgacgcgtaactccgtagacttacgttgtacgtaacttaacgtttacgtaacctagttaaactaacgttacttcccgttaaccgttaccccgtaccctaacccgttaccgtaaccccggttacgggacggtaaacccgggtactaacgggtaacggtaagtaaacggttaaacgtaacggtacggttacgg

SEQ ID NO: 56545 - DNA, 612 bp, Homo sapiens
  misc_feature: GYAE6OF01A9K5N.29.87.H10.1.454.CMB.1.raw
  modified_base (209)..(209): a, c, t, g, unknown or other
  misc_feature (209)..(209): n is a, c, g, or t
  modified_base (606)..(606): a, c, t, g, unknown or other
  misc_feature (606)..(606): n is a, c, g, or t
tcagatagagtactcacgaccggtgctcgatttagcagtactgcgttgggtttgggggcagaagtctctctcagtccagacacagcatggacatggagggcccccgctcagctccgtgggactcctgctgctctggctcccagataccagatgtgacatccgagactcgacccagtctccatccctccctgtctgcatcgtggtggganacagacgtcaacgtcacgttggaccgggcagtcgaggtctaattaactaatttattagcctaggtactcagcagctagtaccgaagggtaacttcaagtctactagatctatcgtctgactatcctacttgactaagtcgtacggtcctagtcgtcggtacaggtcgggcgtaggataggtacggacgtagtacgttctactcgttacactttagaccacgtacgacgtcgtcgacgtacgtaccgtaggaacttacgttacgttagtaaccttaacgtttaactttacgtaacgttaaacttaagtaccttaaccgttaccgttaccctacccctacgttacctacccgtaccggtaaccgaacggactaacgtacgtaggaataaacgttaacgnggtacg

SEQ ID NO: 56546 - DNA, 813 bp, Homo sapiens
  misc_feature: GYAE6OF01EK2CE.29.87.H10.1.454.CMB.1.raw
  modified_base (254)..(254): a, c, t, g, unknown or other
  misc_feature (254)..(254): n is a, c, g, or t
tcagatagagtactcacgaccggtgctcgatttagcagtactgcgttgggttgggggcagaagtctctctcagtccagacacagcatggacatgacgggcccccgctcagctcctgggactcctgctgctcgtggcctcccagataccagatgtgactatccagactcgacccagtcctccacttccctccctgtcctgctactcgtgggtacggacgaccagtacgtaccaacgtctaccgttcggcccgggngaacgtccgaccggtataacttaactaatttagttacgccgttaggtactaccgaggcacgtactaacgtaccgtaaggggttaaacttccgaacgtcctccgtagtacttccgtatccggattaccgactaaccttccgttacgttacgaacgtacgtcgggtaaccggtccttaagttccgttcggttacgagggttcggtcggtaagtagttacgggtcgggtaacttacggttaacgtttacccgtaacttaccctaacccgtaaccgtaacgtaccgacggtaccgtacccggtaccggttaccgaccttaccggaccgtttaaggtaaccggttagttccggtaaccgttaacctttaaacctttaacggttaaccttacggttaaaaccgttaaacgtttaaccgttcccgtttaaccccgttcccgtaaaccccgttaccggtacccgttttacccgggaacccgggttaacccgaaacgggtaaaccccgtaaccggttaacgggtaacggttaaaaccgttaacggttaaaaccgtcggtttaaacggg

SEQ ID NO: 56547 - DNA, 702 bp, Homo sapiens
  misc_feature: GYAE6OF01DZCBW.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagcctcctgggactcctgctgctcgtggctcccagactaccagatgtgacatccagatcgacccagtctccactccctccgtgtctgctattcgtggtagggaacacaggacgtaccaacgtcctacggttcgggccgggacgaggtcgaaggtactaaagttaaactaatttagttacgtccgttaggtactcgacgtcgagtactacgtacggaacggggtaaacgtttaccgtaacgtccttacgtacgtatacttagtcgctacgtctactacctacgtttcgacgttaacgtcggtaccggttaccctacgttcgttaccggttacgacggggttcggtacgggtaggtaaggttaacgggtcggggtaacgtaacggtaccttacgtaccgttacgtaccaacctacgtacgacgcgtacgcctacgacacgtcgtaaggtacttagtcgtacgttactaacgtttacttacgttaactaagtaaagttacctacgttaccttcccgtaaccctagtacccgtaccgtaccggaccggaaacggtactacgggtacgtaacggtaacttaacgtaaccggtgtacgg

SEQ ID NO: 56548 - DNA, 644 bp, Homo sapiens
  misc_feature: GYAE6OF01ANVMT.29.87.H10.1.454.CMB.1.raw
  modified_base (206)..(206): a, c, t, g, unknown or other
  misc_feature (206)..(206): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatcgacccagtctccatcctccctgtctgcatcgtggtaggganacagacgtcaacgtcacgttggccgggcagtcgaggctaagttaactaatttacttacgccttaggtactcgagcacgcactaccgaagggtaaacttccgtaacgtctcctagactactagtcgactgactactcctacttcgacaacgtcgacgggtcctaagtcgttacggtcgtacggtcgggcggtagtagtaggtacgggactacggtacgttacctaccgttcctaccgtaccaacgtaccgagtccgtaccgtacctcgacgtacgacccgtaggtaaacgtgttacgttacgtaacttaactttacgttactacgtaaactaaacgtctaccttaccgttccctaaccctcgttacccgtaccgtaccggaaccgtaacgggaacctaccggtaacgtaacggaaacttaaccgtaaggtaaccgtagg

SEQ ID NO: 56549 - DNA, 756 bp, Homo sapiens
  misc_feature: GYAE6OF01D7CSC.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatcgacccagtcctccatccctcctgtctgcatctggtggganacagatcaacgtctacgtcggccgggagagtcgaggactaattaaactaatttagttacgccgtagtatcgagcacgctacgtacgaacgggtaaacgttccgtaacgtcctacgtgtacttctagtgtctcgcctattacccgtacgtttagacctaagtcccggtacgggtaccctacgttccgttcggttcgaggggtcggtcggttaggtacgtaagggtacgggtaactaagggttaccgtttaaccgtaccttacccgtacctaaccgtaacttccgaaccggaccctacggtccccgtagacccgtaacggtcccgttaaggaccgttagtttacggttacctaaaccgtttaacgttttaacgttaacgtttaacgttaaacgttaaacgtaccctttaaccgttacccgttttaacccccgaccccttaaccgttaccccgttaacccggttacccggggtaaccgtaaacccgggtaacgaacccgggttaacggtaacggttaaaccggttaaacgtttaaacccgggtaacgttccggg

SEQ ID NO: 56550 - DNA, 658 bp, Homo sapiens
  misc_feature: GYAE6OF01B5X2P.29.87.H10.1.454.CMB.1.raw
  modified_base (153)..(153): a, c, t, g, unknown or other
  misc_feature (153)..(153): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtnacatccagatgacccagtctccatcctccctgtctgcatctgtggagacagagtcaacgtcacgttggccgggcagtcgaggctaattaactaatttacttagccgttaggtactcgagcagcactaccgaagggtaaacttccgtaagtcctcctagtactactatgctagtcactcctactttcgactaacgtacgtacgggtccctacgttcgttccggttacgtaggtacgggtcggtaggtagtacggtacgggtacgtacggtacgttacctacgttcctaccgtaacctactccgtaacgacgacgtccgtcgaccgtacgtaccgtaggtaacgtacgttagttacgttacgttaactttaacgttaacttaacgttaacgtaaacgttacgttaccttaccgtttacccgtaccccgtacctacccgttaccgtaccggtaccgtaacggaacgaccggtacgtacggaagttttttaacgaaacgtacggtacgg

SEQ ID NO: 56551 - DNA, 791 bp, Homo sapiens
  misc_feature: GYAE6OF01DD0FP.29.87.H10.1.454.CMB.1.raw
  modified_base (606)..(606): a, c, t, g, unknown or other
  misc_feature (606)..(606): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagactaccagatgtgacatccagatcgaccagtctccacttccctcctgtctgcattcgtggtggggacgaactaggtaacgtccaaaccggttccaccggtttcgggcccgggggtcgaacggttccggaaggggtactaacgttttaaaacctaaagttttaacgttttaacggtcccgtttagggttaactaccgacggtaccaacgccgtaacgtaccgggtaaaagggttaaacgttacccgtaacgtcccgttacctcggtaacttccgttacttcggtccttacgtacctaaccttccttaacgtttaccgaaccgtaacggttacccggaaccggggttccctaccgtttccggttccggttaccgtaggggtacgggtcgggtacgggtagttacgggtcggggtaacgttaacggtacgtttacctaccgttcctaccgaccgttaactcggaacnccgtacggtaccccaggtaccgtacgtaccgttggtaaacgtagtttcgtacgtaacctttacgtttattaaccgtattaacccgttaattaccgtacttacccgttacccgaccctacgtacccaccggttacccgacgtaacggactaccggtacgtacggaactaacgtaaacgtgtacggg

SEQ ID NO: 56552 - DNA, 756 bp, Homo sapiens
  misc_feature: GYAE6OF01CL66R.29.87.H10.1.454.CMB.1.raw
  modified_base (109)..(109): a, c, t, g, unknown or other
  misc_feature (109)..(109): n is a, c, g, or t
tcagatagagtactcacgaccggtgctcgatttagcagtactgcgttgggtttgggggcagaagtctctctcagtccagacacagcatggacatggacgggccccccgntcagctcctgggactcctgctgctctggcctcccagataccagatgtgactatccagatcgacccagtctaccactccctccctgtctcgcactcgtggtagggacgacaggagtaccaacgtctacgttcgggaccgggacgtagtacgaggactaagttaaacctaatttagtttaacgccgttaggtactacgacgacgtacgacctacgtacccggtaagggttaaaccgtttaccgtaacggtccttacccgtaggtactaccttagtcggtctacgtacctaccttaccgttacgtttcgacgttaacgtcggaccgggttacctacgttccgtgttacgagggttcgggtacggtggtactagggtacggactacgtacgttaccaccgttacctacctaccgtactacgacgtaccgaccgtccgacgaccgtacgtaccgtaggtacgtagttcgttaacgtactttaacgttacttaacgttacgtaaaccgttacttaccttcccgttacccgtttacccaccccgttaaccgttaccccgttaacccggttacccgggtaaaccggaaccgggtaacgttacccggtaaggttaaccgggtaaacttaaaccgggttaaaccgtaggttaccggg

SEQ ID NO: 56553 - DNA, 730 bp, Homo sapiens
  misc_feature: GYAE6OF01DKX7S.29.87.H10.1.454.CMB.1.raw
  modified_base (210)..(210): a, c, t, g, unknown or other
  misc_feature (210)..(210): n is a, c, g, or t
tcagatagagtactcacgaccggtgctcgatttagcagtactgcgttgggtttgggggcagaagtctctctcagtccagacacagcatggacatggacgggccccccgctcagcctcctgggactcctgctgctctggctcccagataccagatgtgacatccagatcgacccagtcctccatccctccctgtctgcatcgtggtggganacagagtcaacgtcagttcggccgggcagtcgaggactagttaactaattatttacgcctaggtatcacgcacgctagtaccggaagggtaaacttccgtaagtccggtactagtactcgtatcgctcgccatcctacttcgactaacgtaccgacgggtccctagttccgtcggttacgacggtgggtacgggtagtacggttacggtagggacgtacggtacggtttacctacgttacctaccctaacctaacgtaccacggtacaccggtcctacggccgtaaccgtccggtaaggtaacggttagtacgttaaccgttaaccgttaaccgttttaacttaaccgttaacgttaaacttaaacggttaccttaccttacccgtttacccctcccccgttaacgttaccccgttaacccggtttacccgggaaacccgggtaaaccgggtaacccggtaacggtaacccggtaagggtaaaccgttaaacgggttaaaacccggtacggttaccgggg

SEQ ID NO: 56554 - DNA, 913 bp, Homo sapiens
  misc_feature: GYAE6OF01C0QC0.29.87.H10.1.454.CMB.1.raw
tcagatagagtactcacgaccggtgctcgatttagcagtactgcgttgggtttgggggcagaagtctctctcagtccagacacagcatggacatggacgggcccccgctcacgctccgtgggacctcctgctgctcgtcggcctcccagactaccagtatggtagaactactccagtactccgaccctacgtcctacctaccttcccctcccgttgtcctcgtacctacgttccggttagggacggggaacgaccgtaacggtaacgtaccgtaaaccggtccgtaacggttccggggacccggggtacggtaacgggttaccggaacggggttaaccttaaaacggtttaaaacttttaaaacgttttaacggtttaacccggtccggttttaacgggttaaccaacggtaaccgaaaaaccggaaaccggaaaccggggtaaaaccctacccccgtaaacttcgtacggtactaccgtaccgtcactacctacgttacctacgttcgaccggtacggtcgggttacccgggttcctaggttacggtacgcggtaccggacgagggcgtacgtcgggtacggtaactacgtttactacctcttaccgacactagccgtaacgcgtaaccgtccgtaaccgtggtaacccgtagtaaacgggactttacgtttaacggtaccttaaccgtttaaccgtttacttaaccgggtacttaaacccggtaaccgttaggtttaaacccggtttaacccgttaacccgggttcccgtttaacccggtttaaacggttccggggtaaacccggaccgggggttaaaggggtaaccccgtaaagggggtacgtaaaaccgaaccgtttaaacccggaacgttcgggtttcggaccgtaacccgttacacccgtttaaccg

SEQ ID NO: 56555 - DNA, 778 bp, Homo sapiens
  misc_feature: GYAE6OF01EGNCZ.29.87.H10.1.454.CMB.1.raw
  modified_base (214)..(214): a, c, t, g, unknown or other
  misc_feature (214)..(214): n is a, c, g, or t
tcagatagagtactcacgaccggtgctcgatttagcagtactgcgttgggtttgggggcagaagtctctctcagtccagacacagcatggacatgacgggcccccgctcagcctcctgggactcctgctgctctggctccagataccagtatgtgacatccagactcgacccagtcctccacttccctccctgtctcgctatcgtggtaggganacagtacgtacaacgttcctacgttcggccggggcacgtaccgagggactaattaactaattttagttacgtccgttaggtactcacgctagactacgtaccgtaaggggtaaacttccgaacgtccctaccgttaggtaacttcttagtccgtcgtcgtactacctttaccgtacttttacggaccgtaacgttaccgggacccggggtttccaagtttcccggttacggttcggtagggttcggggacggttaggtacgtacgggtacggggaactacggttacgttacgacctttacctaccgacgtatccgacgtccgacgtacccgtgaccgtacggttaccgtaagtacgtttacggtcttacgtaacgttaaacgtttttattaaccgttaacgttaacgtaaacgtttccttccgtttaacccgttaccccgaaccccttaaacgttccccgtaacccgggtttacgggaaaaccccggacggggttaaacctaaccccgggttaaggtaaccgggttaaaatttaaacccggttaaagggtcccgttaacggggg

SEQ ID NO: 56556 - DNA, 690 bp, Homo sapiens
  misc_feature: GYAE6OF01A1WNL.29.87.H10.1.454.CMB.1.raw
  modified_base (106)..(106): a, c, t, g, unknown or other
  misc_feature (106)..(106): n is a, c, g, or t
  modified_base (204)..(204): a, c, t, g, unknown or other
  misc_feature (204)..(204): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatcgacccagtctccatccctccctgtctgcatcgtgtggganacagacgtcaacgtcacgttggccggtcgagtcgagggcaagttaacaagtttattagccttaggtactacgagcagacagtaccggaaggggtaaactttccgaagtcctaccgtgattcgtatgcctgctactcctaacgtttcgacaaacgttccgggacgggttaccctagtccggttacggttacaagggttcgggacggggttagaagttaggtcgggaacgtaggtacgtttacgaccttcgtaacaccgtactccgagccaaccgtcccgagtaccacggtaccgttagaacgtagtttacgtacgtaaccttaagtttacgttaacttagttaacctaaacgttcgtaaccttaccgtttccgtaacccccttaacgttaccccgtacccggtttacccggaacggtaaacccgggtacgtaacccggtaacggttaacggtaaacgttaaaccgttaaaaggtacccgttaagggg

SEQ ID NO: 56557 - DNA, 695 bp, Homo sapiens
  misc_feature: GYAE6OF01BI3RG.29.87.H10.1.454.CMB.1.raw
  modified_base (108)..(108): a, c, t, g, unknown or other
  misc_feature (108)..(108): n is a, c, g, or t
  modified_base (451)..(451): a, c, t, g, unknown or other
  misc_feature (451)..(451): n is a, c, g, or t
tcagatagagtactcacgaccggtgctcgatttagcagtactgcgttgggtttgggggcagaagtctctctcagtccagacacagcatggacatggacgggcccccgntcagctccgtgggactcctgctgctctggcctcccagataccagatgtgacactccagatcgacccagtcctcctactccctccctgtctagctatcgtggtagggacacgagtacgtacctaaccgtcacgttcggccgggtacgaggtacgaggactaattaaacgtaatttacgttacgtcccggttaggttatccgtaagccgtacgacctacggtaacggtaaggggttaaaccttaccgtaacgtcccgttcgtagtacttcctagtctcgtcgacttaccttaccctacggttcaacgtaacgtcggtaaccgggtctacgtccgttcggttacgnggtcgggtacgtaggtacgtagggtacggtacgtaggtccttaccgtactccgtactaacgtcgtaaccgtcgaccgtacgtacgttcaccgtccgtaacgtaggaattcgtagttacacgtttacttaagttactagtaacgtacttactaccgtaccttcccgaacccttcgtacccgtaccgtaacgggccgtaaacggtacgacggttcgaacgtaaccgttaacgtaaccggtcgtacg

SEQ ID NO: 56558 - DNA, 806 bp, Homo sapiens
  misc_feature: GYAE6OF01B6MIK.29.87.H10.1.454.CMB.1.raw
  modified_base (105)..(105): a, c, t, g, unknown or other
  misc_feature (105)..(105): n is a, c, g, or t
  modified_base (158)..(158): a, c, t, g, unknown or other
  misc_feature (158)..(158): n is a, c, g, or t
  modified_base (250)..(250): a, c, t, g, unknown or other
  misc_feature (250)..(250): n is a, c, g, or t
tcagatagagtactcacgaccggtgctcgatttagcagtactgcgttgggtttggggcagaagtctctctcagtccagacacagcatggacatgacggcccccgntcagctccgtgggacctcctgctgctctggcctccagataccagactgtgacntccagatcgacccagtcctccacgtcctacctggtcctagaacgttcctaggtagggaacacaggacgtaccaacgtcacgttggcccgganagtcgacggtctaacgttaactatttaacgttacgccttaaggtacttacgaacggcctaacggccgtaacgtaccggtaaaagggttaacgttacccttaaaggtcccgttacccgtaggtaaccttaccggttatcgtacgttccacgtaacttcccgttattacgaccttaagtccggtaacggttccacgtttcgaccgttgaacggttggaccggtaggtatacggtacggtactacggtacgttcgtaaccttacctacgttaacccgaattacccgaacgtacccgtacggtacccgttacgaccgtaccggttaccctaaagggtaacttttaggtacgttttaaccgtaaaccttaaccgtttaacgtttaaccttaaacgttaaaccttaacggttacccgttaacccgttaaaccgtttccccgaaccctttaccggtaacccgttacccgtttaaccgggaacccggttaaacgggtacctaaacccggggttactaaccgggtaaacgaaaccgtttaaaacggccggttaacggttacccgg

SEQ ID NO: 56559 - DNA, 699 bp, Homo sapiens
  misc_feature: GYAE6OF01D06W4.29.87.H10.1.454.CMB.1.raw
  modified_base (106)..(106): a, c, t, g, unknown or other
  misc_feature (106)..(106): n is a, c, g, or t
tcagatagagtactcacgaccggtgctcgatttagcagtactgcgttgggtttgggggcagaagtctctctcagtccagacacagcatggacatgacgggcccccncgggtcagcctcctgggactcctgctgctctggctcccagataccagatgtgacatccagatcgacccagtctccatccctccctgtctgcatctggtggagacagagtcaacgtcacgttggccgggcgagtcgagggactaattaaactaatttatttagccttaggtactcagcaagccaataccggaaggggtaaacgttacctaaaggtcctccgtagtactactatgctcgacctacgtccttactttcgactaacgtacggacgggttccctagttccggttcgttacgagggtcgggtacgggtaggtacgttacggtacggggtaacgtaaggtacggttacctacgttaccttaaccgaccctaacgtaccgaacgtccgtaccggtcctacgacgtacgtaccgtaggaacgtagtttacgttacgtaacttaacctttatttacgtacgttaaactaaacgttactaccgttaccttacccgtaccctaccgttacccgttaacccgttaccggtaaacccggaacgggtaaccctaacggtacggttaacggaagtttaaacgtaaaccgacgttacggg

SEQ ID NO: 56560 - DNA, 817 bp, Homo sapiens
  misc_feature: GYAE6OF01BMAHH.29.87.H10.1.454.CMB.1.raw
  modified_base (210)..(210): a, c, t, g, unknown or other
  misc_feature (210)..(210): n is a, c, g, or t
tcagatagagtactcacgaccggtgctcgatttagcagtactgcgttgggtttgggggcagaagtctctctcagtccagacacagcatggacatgacgggcccccgctcagcctccgtgggactcctgctgctctggctcccagactaccagatgtgacatccagatcgacccagtcctccatccctcctgtctgcatcgtggtaggganacaggtacgtaccaacgtcacgttcggccgggacgagtccgaggtctaatttaaacgtaatttagtttacgccgttaggtactacgacggacacgtctactaccggaaaggggttaaacctttccgtaaacgtccttaccgtagacttacgttaagtcgtctacgactacttaccgtatttacgaccgtaacgtcggtaccgggttaccctacggttccggttacggttcgtaaggggttccggggtaccggttagggtaagtttaccgggtaggggtaaccttaacgggttaacctttaccgtaaccctttaccgttaaccccgtaaaccgtacgttacccggaaacgtacccgtaacccggttcccgtacggaacccgtacggtaccgtttaagggaaaccgtttggttaccggtttaaccgtaaacccgtttaacgttttaaacgtttaaccggttaacgttaaaccggttaaaaccttccgtttacccgttaacccggtttacccctaccccgttaacctacccggttaaccgttacccgggaaccgtaaacggtacccgaacggtacgttaggaaactttaaacgacccgttaagtaccggg

SEQ ID NO: 56561 - DNA, 896 bp, Homo sapiens
  misc_feature: GYAE6OF01DJSZX.29.87.H10.1.454.CMB.1.raw
tcagatagagtactcacgaccggtgctcgatttagcagtactgcgttgggttgggggcagaagtctctctcagtccagacacagcatggacatgacgggcccccgctcagctcctgggactcctgctgctctgctcccagataccagatgtgacatccagatcgacccagtcctccattccctccctgtctgcatcgtggtgggagacagacgtcaacgtcacgttggccgggacgagtcgaagggtactaagttaaactaatttagtttacgaccgttggtatcgaaggtcaaggcctaagtaacccggaaggggtaaaaccgtttccctaaagtccttaccgtacgtaactttccgtaagtacgccgtggtacccaactttaccgtaacgttttacgaaccgtaaccggttacggtaacccggggtttaccctaaccggttttcccgttaccgggtttaaccggtacggggttcgggggtaccggggttaagggtacgttaaacgggttaccgggggtaaccgttaacggttaccggttttaacccgtaacccggtttacccgttaccctaaaccccgtaacgttaccgaacccggtaccgtaccggtacccgttaccgggaccgtaccggtaccgttaacgggtaaacgttcgtttaacggtttaccgtaaccgttttaaaccgtttaacggtttaaccgttaacgttaaacggttaaaaccggtttaccttaaacccgtttaacccgtttacccgtaaccccccttacggtttaaccccgttaccccggggtttaaacccggtaaccccggggtaaaaccggtacccggtaaaccggtaaccggttaaacgggtaaacgttaaaaccgttaaaccggtacgggttaaacggg

SEQ ID NO: 56562 - DNA, 571 bp, Homo sapiens
  misc_feature: GYAE6OF01APP7K.29.87.H10.1.454.CMB.1.raw
  modified_base (226)..(226): a, c, t, g, unknown or other
  misc_feature (226)..(226): n is a, c, g, or t
  modified_base (390)..(390): a, c, t, g, unknown or other
  misc_feature (390)..(390): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggngagtcgagggcaattaacaattatttagcctggtatcagcagcatccagggaattcctaagctcctgatctatgactgcatcctactttgcaagtcgacgggtccatcgtcggtttcaggtggcggtggatagtcggggacaggtacgttcacctcgtacaccntacagcacggcctgacgacgccgtagaacgtgttcgttaacgaccgttaactttaacgttaacgtagtaactaaagttctaccgttacctttcccgaccccctagtccctacccgtttaccgggaccctaaacggggacctaacgtacgtacggtaaagtaacgttaaaccgacgttacgg

SEQ ID NO: 56563 - DNA, 632 bp, Homo sapiens
  misc_feature: GYAE6OF01B2DBK.29.87.H10.1.454.CMB.1.raw
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtaccaacgtcacgttggccgggagagtcgagggctaagttaaccaaatttattaagcctggtatcagcagcancagggaattcctaagctcngtatctatgctgcactccatttgacaatcgacgggtccacgtctcggttacgagtcggtcggtaggtagtagtgggtaacgaggtacgttacgtactcgtacctaccagtacgaacgcctacgtaccctggacaccggtacttacggaaggtacttaggttacgtactaaactttaacgtttaacgttagttaaccgtaaaggttacttaccgttaccgtttacccgtacccccgttaagttccctacccggttccgggaaccccgttaacggggaaccctacgggttaacgacgggtaaacgtaacgttaaaacccggtaacgttaccgggg

SEQ ID NO: 56564 - DNA, 772 bp, Homo sapiens
  misc_feature: GYAE6OF01BV350.29.87.H10.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctggtggganacagagtcaacgtcacttgccgggngagtcgaggcattaacaattattagcctggtatctagcagacactaccgaagggtaaacgttcctaagcctacctgtatctatgctgctactccctactttcgctaactccggtaacggggtccctaacgttccgttccggtttacgagggttcggggtaccgggttagggtaagttaggtacgggggtaaccgtaacggttaacggtttaccaccgtttacccgtaaccccttaacccgtaacttacccgaacgacccgtaaccggttccccgtacggtacccgtaacgtcccgttaagggaaacggttaacgttcggtttaaccggtaaccctttaaaacgtttttaaccgtttaaaccgtttaaggttaaaccgttaaaaacggttaccttacccgtttaacccgttttaccccgaccccccttaacgttccccgttaaccccggtttacccgggtaacccgtaaaaccgggtacccgtaaaccggtaccgtaacggggtaaaaccgtttaacgtaaaacccggttaaacggttaccgggg

SEQ ID NO: 56565 - DNA, 587 bp, Homo sapiens
  misc_feature: GYAE6OF01BDRGG.29.87.H10.1.454.CMB.1.raw
  modified_base (107)..(107): a, c, t, g, unknown or other
  misc_feature (107)..(107): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
tcagatagagtactcacgaccggtgctcgatttagcagtactgcgttgggtttgggggcagaagtctctctcagtccagacacagcatggacatgacgggcccccgntcagctcctgggactcctgctgctctggctcccagataccagatgtgacatccagatgacccagtcctccatccctccctgtctgcatctggtggganacagatcaacgtcacgttggccgggnagtcgaggcagttaacattattagcctgtatcagcagcactccgaagggtaaacttccgtaagctccgtgtactctatgctgcactccactttgcaagtccacgggtccctagtcctcggttcgagtggtcggtaggagtagtacgggacgtagtacgttcacttcgtacctacgactcgtacgccgagtccgtgacgacgtaccgtagaacgtagttgttacgacttaacttagttacgtagtaactaaacgttactccttaacgttccgaacccctacgtccgttacccgttaccggaccgtaacggaccgtaacgttacgtacggtaaacgtaacttaaaccgtacgtacggg

SEQ ID NO: 56566 - DNA, 626 bp, Homo sapiens
  misc_feature: GYAE6OF01A1K2Q.29.87.H10.1.454.CMB.1.raw
  modified_base (175)..(175): a, c, t, g, unknown or other
  misc_feature (175)..(175): n is a, c, g, or t
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
  modified_base (614)..(614): a, c, t, g, unknown or other
  misc_feature (614)..(614): n is a, c, g, or t
tcagatagagtactcacgaccggtgctcgatttagcagtactgcgttgggtttgggggcagaagtctctctcagtccagacacagcatggacatgagggccccccgctcagctcctgggactcctgctgctctggctcccagataccagatgtgacatccagatcgacccagtcnccatccctccctgtctgcatctggtggganacagagtcaacgtcacttggccgggcgagtcacggcctatttcctaattctttagcctggtatcagacaacgaacaggaccaaactcctacactctgtatctatntagtcgtccgtacctagttagaggtacggtccgggggtaccccagtacggtacggtttacgacggcggtacgtaggtggtacgtacgaaggggtaccaagggtacttcgtactccgtacctaaccgtacttaccgagtaccacggtccctgtaccgacgtccgtagtaaagttctttacgtacttaactttacgttactacgttacaacttaacttaacctaacttacctatagtaacgcgtaccggtcggaacccggtaacgggcccgtaagggtaccggaaacccgaaacgacggtaaacgnggttagctacgg

SEQ ID NO: 56567 - DNA, 764 bp, Homo sapiens
  misc_feature: GYAE6OF01BAT1A.29.87.H10.1.454.CMB.1.raw
  modified_base (108)..(108): a, c, t, g, unknown or other
  misc_feature (108)..(108): n is a, c, g, or t
  modified_base (221)..(221): a, c, t, g, unknown or other
  misc_feature (221)..(221): n is a, c, g, or t
tcagatagagtactcacgaccggtgctcgatttagcagtactgcgttgggtttgggggcagaagtctctctcagtccagacacagcatggacatggacgggcccccgntcagcctccgtgggacctcctgctgctctggctcccagactaccagatgtgacatccagactcgaccctagtcctccacttccctccctgtctcgctagtcgtggtagggaanacgagtactacaacggtctacgttcgggccgggagtacggtcgaagggtactaacgttaaactaatttattacgcgttaggtactacgagacgaacggaaaccgagggaaacctaccctaactcgtagtactctacgctacgccacttccgtacttcgactacgtaggtccgggtcctaggttacggtcgacggtcggacgacggcggtacgtacgggtacggactaacggttcttaccgacttacctaacctacgtacgtccgtaacggaccgtacgtccgtacgcgtaacgtacccgaaggttacgtacggtttcgttaacgtaactttaacgtttaccgttaacgttaccggtaaccttaaagttccgtttaaaccgttaaccggttaacccgttaaacccgtttacccggttaaacggtttccggtttaaacccggggacccgggttaaagggtaacccgggttaacgggtaacggtaaccgtaaaccgggttaaacgtaaacgggtacgtttacgggacgtaaccggtccgtaaaccc

SEQ ID NO: 56568 - DNA, 681 bp, Homo sapiens
  misc_feature: GYAE6OF01EQ86V.29.87.H10.1.454.CMB.1.raw
  modified_base (203)..(203): a, c, t, g, unknown or other
  misc_feature (203)..(203): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtctccatcctccctgtctgcatctggtggganacagagtcaacgtcacgttggccgggacgagtcgagggctaattaactaatttattagccgtaggtatcagcagctacgtaccgaagggtaacgttacctaagtcctaccgtagtactcgtatcgtctgacctactcctactttcgactaacgtcggtacgggtcctacgttcgtcggttcgtagggtcgggtacggtaggtagtaggtacgggtaactaggtacgttaccacgttacctacctaaccgtacgtacgaacgcctacggtcctcgaccgtacgtaccgtaaggtaacgtcgttacggttacgtaaccttaacgtttaacttaacgttaagttaaacgtaaagttaccttaccgttacccgtttaccccgaccccttaacgtaccccgtaacccggttacccggaacccgaacgggtaaccctaaccggtaacgtaggtaaaccgtaaacggttaaaccgacgttacggg

SEQ ID NO: 56569 - DNA, 789 bp, Homo sapiens
  misc_feature: GYAE6OF01EUDU9.29.87.H10.1.454.CMB.1.raw
tcagatagagtactcacgaccggtgctcgatttagcagtactgcgttgggtttgggggcagaagtctctctcagtccagacacagcatggacatggaccgggcccccgctacagcctccgtgggacctccgtgctgcttcgtcggcctaccgagtactaccgagtagttgtcgaacctacttaccgaagtacgtaccggaaccctaacttccctaccgtaccttccctcccttgtccttacgactcgtcggttagggacgggacacgtaacggacgtacctaaccggtctacggtcgggacccggagtacgacggacgtacttaacttaacgttaactttacgttacggtaccttaggtaactacacggtacacggtacgtaaaccgtacgggtaaacgggttaacttacccgtacgttccgttacggacttacgtacgttacgtcggtaactcgtactaccgttaccgtatttcgaacgtaccgcggtaccgtcctagttccggttaggacgtggggaggttcggaagttaggtacgcggtagtacgtacggtctctactaccgtaatcgagccgtcacggtccgtagacccgagtaccgttagtacgtacgttttcgaaccgttaagtttaactttaacgttacgtaacgtttaaaccttaacggtacctttacccgggttaaccctcctaaaccccgttcggttaccccggtaacggtacccggtaaccgggaacgtaaccgttacggtaagtaccggttaaaaagaccgttaaggtcgtaacggg

SEQ ID NO: 56570 - DNA, 941 bp, Homo sapiens
  misc_feature: GYAE6OF01AG61W.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagctcctgggactcctgctgctctcggctccagataccagatgtgacatccagatcgacccagtcctccatcctcctgtctgcagtcgtggtagggacacgagtacgtaccaaccgttcgacgtttcgggccggggacgtacggtaccgagggtaccttaagttaaactaaagttttacgtttaacgtaccgttaggtactacgagtaccacggtacctaacggtaaccggtaaacggggtaaacgtttacccgtaaacggtcccgttaccgttacggtaactttcgtaacgttcggtaccgttacgaccgttaaccgttacccgttaacgttttaccgaaccgtaaacgttacccgggtaaccgggggttacccctaagtttcccggttaaccgggttcggtaaacggggttcgggggtacggttacgggtaaacgtttaacggtacgggggtaaccgtacggttaccgtttacctaacgttccctaacccgtaaaccgttactaacccggaacggtacccgtaacggttacccgtacggtaccgtaaccggtacccgtaaggttaacgttacgtttcgggtttaacgtaaccgtttaaacgttttaaacgtttaaccgttaacgggtttaaacgttaaaacgtttccgtaaacccttttacccggtttaacccccgtaaccccgtttaacccgtttaccccggttaaaccccgggttttaaccgggaaacccccggttaaaccggggtaacccgttaaacccgggtaaaccggtttaacggggtaaaccggttaaaaccgggttaaaacccggttaacggttacccgggg

SEQ ID NO: 56571 - DNA, 575 bp, Homo sapiens
  misc_feature: GYAE6OF01DKHPU.29.87.H10.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtnacttgccgggnagtcaggcattaacaatattagcctggtatcagcagcatcgaggaaatcctaagctcctgatctaatgactgctatcctactttcgacaacttcgacggggtccctaatccgtcggttcagtcggcggtgaactagtagggacagattcgactcgtacaccagtcagctaacgccgtagctagaccgtagaacggtattttgaacgtaactttaacttactagtacctaaactacttaaactaaccttacccactaataaacgttcccgggttaaccggacccgtaaaacggggtaccgtaaccggggtaagaaaacccgaaaggaccgaaaacgttggtcgggtaacc

SEQ ID NO: 56572 - DNA, 718 bp, Homo sapiens
  misc_feature: GYAE6OF01BNK4V.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatcgaccctagtctccactccctccctgtctgcatcgtggtgggacacagacgtcaacgtccacgtcggccgggtcgacgtcgagggacctaagttaactaagtttagtttacgccttaggtatcgacgctaggactacgtaccggtaaggggtaaaccttaccgtaacgtccttacgtacgtacttcttagtcgcgttacgacctacttacccgtacgtttacgacctaaggtaccgggaccgggttaccctagttcccgtttacgggttcgtacgggttcgggtacggttggtaacgttacgggtagggtaccgtaagtacggttacctaaccttcgtaacccaaccgtactaccggactcgtaaccgtccgtcgaccgtaacgtaccgtaagtaacgttagttacgtacgtaacccgtttaattaccgttacttacggtaactaaacgttccttacccgtaccttcccgaccctactaccggttacccggttacggacccggtaaacgtaccgtacggtacggtacgtaacgtaaccgtaaacgtggtaccgg

SEQ ID NO: 56573 - DNA, 825 bp, Homo sapiens
  misc_feature: GYAE6OF01DC0QL.29.87.H10.1.454.CMB.1.raw
  modified_base (304)..(304): a, c, t, g, unknown or other
  misc_feature (304)..(304): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctcgtggcctcccagactaccagatgtgacactccgagtatcgacccagtcctcctactccctcctgtctcgctagttcgtggtagggaacacgaggtacgtcctaacgtctacgttcgggaccgggcgtacgtcggagggtacttaacttaatacgttattcgccgttagtacncgacgtcagtaccgtacgtaacggtaaggggtaaccttaccgtaatccgttacggtcgtaacttcttagnggtctacacgttcctaccgttnttacgactaacggtccggtaaccggtctacgttcgttcggttagtggtcgggtaggtacgtaaggttggtaccgggtaagaacgttcggttacctacccgtactacccgtactacgtacgccgtaacgtaccgtctcggtacgttaaaccggtcccggttaagtaacgttacggtttaccgtttaaccggtaacgtttttaaacccgttacgtttaaacggttttaactaaaaccgtttaacgttaacccccggtttacccttttaaccccgtttccccccggaacccctttaccggttaaacccccgggttttccccggggaaaacccggttaaccgggaaaacccccggttaaccggtaaccgggttaaaccgtttaaccggggaaaacgtttaaacccgggttttaaaaccggtccggtacggggg

SEQ ID NO: 56574 - DNA, 996 bp, Homo sapiens
  misc_feature: GYAE6OF01D7XXE.29.87.H10.1.454.CMB.1.raw
  modified_base (108)..(108): a, c, t, g, unknown or other
  misc_feature (108)..(108): n is a, c, g, or t
tcagatagagtactcacgaccggtgctcgatttagcagtactgcgttgggtttgggggcagaagtctctctcagtccagacacagcatggacatgacgggccccccgntcagcctccgtgggacctcctgctgctctggctcccagataccagatgtgacatccagactcgacccagtcctaccatccctccctgtctgctatcgtggtgggaacacgtagtacgtacctaaccggtctaccggttcgggcccgggtacgtaacggtccggaacgggtactaaacgttttaaaaccgtaaagtttttaacgtttacggtacccgttaggttaacttaccgacgaccgtacggtacctaaccggtacccggtaaacgggggttaaaccgtttacccggttaaacggtacccgttacccgttagtaacgttaccttaagtcgtccttacgtaccgtaaccttacccgttaccgtttacgtaacccgttaaccgttacccgggtaacccggggttaccccttaaccggttcccggtttacgggttacggtaacgggttccgggtacggttaggtaaacgttacgggtaacgggtaacgttaacggttaaccgttaccgtacccttacccgttaacccggtaacctacggttacgaacccggtaccgtaaccgggtccctaccggtaccgtaaccgttacccgggtaacgggtaacgttacgttaccggtttaaccgttaaccgtttaaaccgttttaacgtttaaccgtttaaaccggttaaaaccgtttaaaccggttaaacccctttacccggttaacccctttacccccggtaaccccccgtttaaacccgtttaaccccgggttacccccggttttaaacccggggaaccccggttaaaacccggggttaaaccgtaaccccgggttaaaccgggtaaccgggttaaaaccgggttaaaacccggttaaacccgggtaccggtttaaacccgggg

SEQ ID NO: 56575 - DNA, 713 bp, Homo sapiens
  misc_feature: GYAE6OF01CCH99.29.87.H10.1.454.CMB.1.raw
  modified_base (209)..(209): a, c, t, g, unknown or other
  misc_feature (209)..(209): n is a, c, g, or t
  modified_base (470)..(470): a, c, t, g, unknown or other
  misc_feature (470)..(470): n is a, c, g, or t
  modified_base (507)..(507): a, c, t, g, unknown or other
  misc_feature (507)..(507): n is a, c, g, or t
tcagatagagtactcacgaccggtgctcgatttagcagtactgcgttgggtttgggggcagaagtctctctcagtccagacacagcatggacatggacggcccccgctcagcctccgtgggactcctgctgctcgtggcctcccagactaccagatgtgactactccagactaccgaccctacgttcctaccctactccctttcccttncgactatcgtggtaggaacgacgagtactaccgtaaccgtctacggttcgggacccggagtaacggtcgaacgggtacttaaacgttaaacttaaagtttacgtttaaccgtccgtttagtactccagtccacgacctacgtaaccggtaaacggttaacgttaccgtaacgttccgtacctagtaacttcgtagtgtccacgtcaccttccttacgtacgactacgtacggtacccggtccttagttccgtcgttaacgngggttacggcggtagtagttacggaggtacgtacgtntaccgtacctacctaccacgactacgagtacaccgctacgcgtacgactaggtaagtctacggtacttaacgttattacgttagaacttagtaaactcttaacctaccttaccacccgttaccgtaccgttaccgtaccggtaacggtaaccggtaccgtaaaccggcgtaaacgttaacgtaacgtaaccgttaggaccgttacg

SEQ ID NO: 56576 - DNA, 837 bp, Homo sapiens
  misc_feature: GYAE6OF01BROJ9.29.87.H10.1.454.CMB.1.raw
  modified_base (108)..(108): a, c, t, g, unknown or other
  misc_feature (108)..(108): n is a, c, g, or t
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
tcagatagagtactcacgaccggtgctcgatttagcagtactgcgttgggtttgggggcagaagtctctctcagtccagacacagcatggacatgacgggccccccgntcagctccgtgggactcctgctgctctgcctccagataccagatgtgacatccagtactcgacccagtctcctatccctcctgtcngctacttcgtggtaggganacgaagacgtaccgaaccgttacgtccggttgggcccggggacgtaacggtcggaacgggtacctaagtttaaaacctaagttttaagtttacggtaccgttagggtaactaccggaaggtccaacggtactaaccgtaacccggaaaggggttaaaccgtttacctaaccggtacccgtttaccgtagtaactccttaagttcgccttacgtacctaaccgtttcccgtaaccgtttacggaaccgttaacgtaccggggtaccgggtaccctttacgttccggttacggtttacgaggggttcgggtacgggtaggtaagttacgggtacgggtaacctaggttaccgttccgaacctttaccgtacccaaccgtacgttaaccgacggtcctaacccggtccttacgggcacccggttaacgaggttaactacggtttgtaaccgtaacctttaacgtttaacgtacgtttaacgaaaccgtttaagtttccctaaccttacccggttaccgtaccccacggttttacccgtacccgttacccgggaaacggacccggtacgttaaaccgggaaggtttaaccgggaaagtttaaaccgtaaacgggtcgttaacccgggg

SEQ ID NO: 56577 - DNA, 946 bp, Homo sapiens
  misc_feature: GYAE6OF01DTG2L.29.87.H10.1.454.CMB.1.raw
tcagatagagtactcacgaccggtgctcgatttagcagtactgcggttgggttgggggcagaagtctctctcagtccagacacagcatggacatggacgggcccccgctcagcctccgtgggactcctgctgctctcggcctcccagactaccagatgtgacatccagtatccgaccagtcctccactccctccgtgtctcgctacgttcgtagggtacgggaacgacgaggtacgtacctaaccgttccgtaccggttcgggccggggacgtaacggtccggaacgggtaccttaaagttaaaaccgttaaagttttaacgtttaccggtacgtttacggtaactacgaacgtacgacgtaccgtaacgtaacccgggtaaaacgggttaaaacgtttcccgtaaacggtccttaccgtaggttacttaccttaagttcgacgttacgtactaccgttacccttaacgttcggtaacttaaccgggttaccgggtaacccgggttcccttacggttacccgggttacggtttacggggtaacgggggttccgggggttacgggttaacgggtaaggtttaaccggggttacgggggtaaaccgtttaacgggtaccctttaaccggttaaccgtttaccctaacccgtaaaccgtaacgtaccggtacccggaaccgtaccggtccccggtaggtaacgtacccggttaaccgggtagttaaacgggtttactttaaccggttaacgttaaaccttttaaccggtttaagttttaaacccgtaacgttaaacgtaacctttaacccggtaccctttaccgttaccccgtaccccgttaaccctaccggttaccccgggttaacggaaaccccggtaaagggaccccctaaagggttaaccgtaaacggtaaccgttaaaaccggttaacccggtggttaacccgg

SEQ ID NO: 56578 - DNA, 737 bp, Homo sapiens
  misc_feature: GYAE6OF01E1H3F.29.87.H10.1.454.CMB.1.raw
  modified_base (107)..(107): a, c, t, g, unknown or other
  misc_feature (107)..(107): n is a, c, g, or t
  modified_base (705)..(705): a, c, t, g, unknown or other
  misc_feature (705)..(705): n is a, c, g, or t
tcagatagagtactcacgaccggtgctcgatttagcagtactgcgttgggtttgggggcagaagtctctctcagtccagacacagcatggacatgacgggcccccgntcagctccgtgggactcctgctgctctggctcccagataccagatgtgaactatccaagactcgacccagtcctccatccctcctgtcctgctatcgtggtggagacaggtagtaccaacgtcgtacgttcgggccgggacgtagtacggacggactaaacgttaaactaaactttagttacgtaccgtggtaactaccgagtacacgtactacgtaaccggaaggggttaaaccttcgtaaacggccttaccgtagtacttacctaagtcgtacttgacctactaccgtcgtttacgacgtaacgtccgggtaaccggtccctagttaccggtcggtaacgtacgggtcgggtacggtagtacgtacgggtacggtaacgtacggtacttaccgtacttacccgtacaaaccgttacgtacaccggtacgtacggtacccacgaccgtacgtccgtaacggtaacttaaggttcgttacgtaaccttaacgttaaccttacgtaagttaaactaaagttaccgtactttacccggttacccacccgttaacgtaccgttaacccggttaccgaacggtaaccggaacctaacggtanacggtaaattaaccgttaaaggacgtaccggg

SEQ ID NO: 56579 - DNA, 801 bp, Homo sapiens
  misc_feature: GYAE6OF01AZCGR.29.87.H10.1.454.CMB.1.raw
  modified_base (162)..(162): a, c, t, g, unknown or other
  misc_feature (162)..(162): n is a, c, g, or t
  modified_base (227)..(227): a, c, t, g, unknown or other
  misc_feature (227)..(227): n is a, c, g, or t
tcagatagagtactcacgaccggtgctcgatttagcagtactgcgttgggtttgggggcagaagtctctctcagtccagacacagcatggacatggacgggcccccgctcagcctccgtgggactcctgctgctcgtcggctacccagactaccagatgtanacatccagatacgaccctagtcctccactcccgtcctgtactgacctactcgtaggtacgggganacgagtacgtaacgtaccgtccgtaccggttacgggccgggtacggtagaccggaacgggacttaaaattttaaacctaaattttacggttacgaccgttagggttactaccagcggaacgtaccgaacggtaccgggaaacgggttaaactttacccgtaacggtcccttcgtaagacctttgttacgtactactcggaacttcccttacgttactacgttacgaacggttccgggtaacccggtactttacggtttcccggtacggttacggtaagggtggggtttacggaagtaaccggttaagggtcgggtaacgtacgtttacccggttaccttaaccggacccttaaccgacttaccggtaccgtaaccgggcccgtaaccgtccggaccgtaaccgtacgtaaccgttaaggtacgttggtttaccctaacgttaacttaccgtttaagttaacgttaaccgttaaactagttaccttacctacccgtccctaacgcctaccgtaccgggtacgaactaaccggtaagacgtaacgtaggtaaccgttaaagtaaccggtgtaccgg

SEQ ID NO: 56580 - DNA, 727 bp, Homo sapiens
  misc_feature: GYAE6OF01D6MK6.29.87.H10.1.454.CMB.1.raw
  modified_base (107)..(107): a, c, t, g, unknown or other
  misc_feature (107)..(107): n is a, c, g, or t
tcagatagagtactcacgaccggtgctcgatttagcagtactgcgttgggtttgggggcagaagtctctctcagtccagacacagcatggacatggacggcccccgntcagcctcctgggactcctgctgctctggctacccagactaccagtatgtgacatccagatcgacccagtctccacttccctccgtgtcctgcctattccgtgggagggacacgagtacgtacctaaccggttcctacggtcggcccggggatagtccgaagggtactaattaactaagtttaagttcgtaccgtaggttactcgacgactacgactacgtacccggtaaaggtaacgttaccgtaacggtcctacccgtaggaacctttacgttaacggtcgtacctaggtacctaaccgtttacccgtacgtttacggtaacctaacgggttacccgggacccggttaccgtacgtttccggttacgtacgggtgggtacggtacggtagtaaggtcgtagggtacgtacgtacttacctaccgtaccttaccgaccgtataccgaccggtacctaccgtccggtacgacgacgtacgtacggattacgttcgtagtaacttacgttattacgtaacgtaacgttactacttcccgtaacttccccgtacctacgtaccggtcggaccgtacggaccgaccgtacggtactagtaactaacgttaacgcgttaaccgg

SEQ ID NO: 56581 - DNA, 788 bp, Homo sapiens
  misc_feature: GYAE6OF01A6G93.29.87.H10.1.454.CMB.1.raw
  modified_base (203)..(203): a, c, t, g, unknown or other
  misc_feature (203)..(203): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatcgtgtggganacagagtcaacgtcacgttgccgggcagtcgagggctagttaactaattattagccttaggtatcagcagcagtaccgaagggtaacgtttaccgaagtcctaccgtagactcttagtgtactgacctactccctactttcgactagtaccggacgggtccctagttcgtcggttacgtaggtcgggtacggtaggtagttacggagggtactacggtacgtttccgtaccttacccgtaccaaccgtacgtaccgacgtacgaaccggtccctacggaccgtaccggtaccgttaacggtaaacgggttacgtttacggttaacccgtaaccgttttaaaccgttttaacgttttaaaccgttacgggttaaaaccgttaaaagtttacccgtttaacccgtttaaccccgttttacccccgtaaacccccccgtttaacgtttacccccgttaacccccgggtttaaccccggggtaaaccccggaaaccgggggttaaacccctaaacccgggttaaccccgggttaaagggtaaaacccggtttaaaccgttaaaaacccggggtacggtttaacccgggg

SEQ ID NO: 56582 - DNA, 787 bp, Homo sapiens
  misc_feature: GYAE6OF01BCSKJ.29.87.H10.1.454.CMB.1.raw
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
tcagatagagtactcacgaccggtgctcgatttagcagtactgcgttgggtttgggggcagaagtctctctcagtccagacacagcatggacatgacgggcccccgctcagctccgtgggacctcctgctgctctcggctcccagataccagatgtgacatccagatcgacccagtcctccatcccgtcctgtctgcatcgtggtgganacgngacgtacacgtcacgtggccgggnagtcgaggacaattaaactaatttagttacgccgtgtatcgacgacgacgcgacgtaacggtaacgggtaacgttacccgtaacgtccttcgtagtacgttactatcgtctcgtaccttaccgtaccttacgttacgtactaaccgttccggtaccgggttacccttacgttacccggttcggttacggtacggggttacgggttacgggtacgggtactttacggggtaaccggtaacggtacggttaaccgtttacctaacccgttccgtacctaacccgtaacgtccgacgtaccgtaccggtccgtacctaccggacgtacccggtagaagttacgtacggtttacctacgtttaacgttaaccgttaaacgttaactaaacgttaacgttacccgttacctttaaccccggttaacccctaccccgttacccgttacccgttacccgggttaaacccggggaccggttaaacccgggaacccgttaaccgggtaacggttaacggtaaacgtttaaaccggttaaacggtccggttaaacccggg

SEQ ID NO: 56583 - DNA, 694 bp, Homo sapiens
  misc_feature: GYAE6OF01C88D3.29.87.H10.1.454.CMB.1.raw
  modified_base (144)..(144): a, c, t, g, unknown or other
  misc_feature (144)..(144): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (313)..(313): a, c, t, g, unknown or other
  misc_feature (313)..(313): n is a, c, g, or t
  modified_base (687)..(687): a, c, t, g, unknown or other
  misc_feature (687)..(687): n is a, c, g, or t
tcagatagagtactcacgaccggtgctcgatttagcagtactgcggttggggtttgggggggcagaagtctctctcagtccagacacagcatggacagtggacgggcccccgctcacgctccgtgggacctcctcgctcgctcnggcctcccagactaccagatgacgacactacagactcgaccctacgtcctcctactccctcctgtctcgcngtcgtacggacggganactaggtactaccgacgtacacggttcggacgggtacgagtcggaaggactaacttaactaagttacttacggtctaggtancgagacagtacacgtacggaacggtaactaccgtaacgtcttacgtatacgtactagtcgtacgtacacttacgttaccgtagtttaccacgtacgtccggtacggttccagttccggtacggtacgtacggtcgggtaacgttggtaacgtcggtaacggaccgtaagtcgttacccgacttacgaccctaagtaccgcggacaccgtacgcccgtagaccacggttcaagttacgtacttgtaacgttaacctaagttagtttaccgaattaacgtacgtaacctttccgaccttccccggaaccttaccggaccgttacgggaacggtaacccgaggtacctaacgtaggaaacgtaagtaacccgtaggngtaacgg

SEQ ID NO: 56584 - DNA, 867 bp, Homo sapiens
  misc_feature: GYAE6OF01CZ2TC.29.87.H10.1.454.CMB.1.raw
  modified_base (340)..(340): a, c, t, g, unknown or other
  misc_feature (340)..(340): n is a, c, g, or t
tcagatagagtactcacgaccggtgctcgatttagcagtactgcgttgggtttgggggcagaagtctctctcagtccagacacagcatggacatggacgggccccccgctcagcctcccgtgggcctcctgctgctcgtcggcctcccgagactaccagatgtgacactccagatcgacctgtcctccacgtccctcccttgtctcgactacgttcgtgggtagggaagaacgtagacgtaccgtaaccgtacctacggttccgggccggggacgaggtcggaagggtaccttaattaaaaccttaagtttacgtttacgtccgttaggtactacgacgnacgcctacgtaaccggtaagggtaaccttaccgtacgtcccgtacctaggtacttccgtagtccggtactacgacctacttcccttacgttacgaacgtaaccgggtacggtacccgggttacccttcggtttacccggttacgggtttacggacgggtttacggggtacgggtaaggttacggttaacgggtggggtaacccttaagggtttaacccgttacctaaccccggtttaccctaaaccccgtacgtaaaccgttaccgaaccggtcccgtaaaccgtccggttaccgaacgtaccgttaagacgggttaaagtcgtttacggttaaaccttaacgttttaaacctttagttaaaccgttaacttaaaccgttaacggtttaccctacccgtttaacccgtaccccgtcccttaaacggtttcccgtaacccccgggtaccggtaaacccggaacgggttaaccacccgggttaagggaaaccttagggttaaaaccccgttaacggtcggttaacccgg

SEQ ID NO: 56585 - DNA, 776 bp, Homo sapiens
  misc_feature: GYAE6OF01B2WJH.29.87.H10.1.454.CMB.1.raw
tcagatagagtactcacgaccggtgctcgatttagcagtactgcgttgggtttgggggcagaagtctctctcagtccagacacagcatggacatggacgggcccccgctcagctccgtgggacctcctgctgctctggcctccagtactaccagatgtgacactccagatcgacccagtctcctatcccgtccctgtcgtcgctatcgtggtgggacacgagacttcgaacgtcacgtttggaccgggcaagtcgagggactaattaactaatttacgtttagtccgtggtaactcgacgcagtacgactaccgaaggtaaaccgttacctaaacgtccttaccgtaggtattaccgtaagtcggcgttacgtacctaactacccgttacgtttacgaaccgaacgtttacccggacgggttaccctaggttcctttaaccggttcggtaacggttccgggtacgggtagtaagttaacgggtacgggtaacgttaaccggtaacgtttccgtaccttacccggttaacccgaactaaccttaacgaacggacctacggtccgtacgtacgtaccgtcggtaacgtaacgtacgttacgtaacgtacttaaacgtttacttaaccgtagttaaacgtaaacgttacgttaccgttaaccttccggtaacccccttaagtccccttaacggtacccgggtaaccggaaacccgggtaaaccgtaaccggaacggttacggaaaagttaaccggtttaaacggtaaccgttaccgggg

SEQ ID NO: 56586 - DNA, 817 bp, Homo sapiens
  misc_feature: GYAE6OF01BXEFC.29.87.H10.1.454.CMB.1.raw
tcagatagagtactcacgaccggtgctcgatttagcagtactgcgttgggtttgggggcagaagtctctctcagtccagacacagcatggacatggacgggcccccgctcagcctccgtgggactcctgctgctctcggcctcccagactaccagtatgtagaccataccgagacgtcgaacccagtcctcctaccgttccctcccgtgtctacgctatcgtagggtggatacagacgtacgtaacgtcctacggtcggccggacgtaggcgacggtactaataaacgttaatttaacgttacgtaccgttggtaactacgacgcaacggctaaccgtacggtaaacggttaaaccgtcctaaccggtccttaccgtcggtaactccttagtacgtcgttacgaccttacctccgttaacgtttacgaacctagttacccgggtaacggttcccgtaggtttaccgttaccgggttctaacgggggttcggtaacggggtaacggttacggttaacgggtaacggttaacggtaacggtttacggtttaacccctacggttttaccccaacgtacctaaccgtaccgtaccggtaccgtaccgttaccgaccggtacgtaacccgggtacgtttaacggacggttaacggtttaccttaacggttaacttaaaccgtttaacgttaaccgttaacttaaacggtaattacccgtttaaccttaccgtaccctaccccgttataaccccggtacggttaccggaaccggacgtaaccgacgttacggtaactaaaccggtaactaacggttagtccgg

SEQ ID NO: 56587 - DNA, 778 bp, Homo sapiens
  misc_feature: GYAE6OF01CDCUW.29.87.H10.1.454.CMB.1.raw
  modified_base (106)..(106): a, c, t, g, unknown or other
  misc_feature (106)..(106): n is a, c, g, or t
  modified_base (151)..(151): a, c, t, g, unknown or other
  misc_feature (151)..(151): n is a, c, g, or t
  modified_base (159)..(159): a, c, t, g, unknown or other
  misc_feature (159)..(159): n is a, c, g, or t
tcagatagagtactcacgaccggtgctcgatttagcagtactgcgttgggggttggggcaggaagtctctctcagtccagacacagcatggacatggacggccccntcagctcctggacctcctgctgcgtctcggctcccagactacagntcgagacnaccagtatcgaccctagtctaccgtctcccgtccgtatccgtagcctatcgtgtggggaaccagaactagtaccgaaacgtcacgttggccgggataggtacgaggtactaagttaactattacttacgacttaggaacctcaacgacacgttcaacacggtaaaggtaactttaccgaatcccttaccgtagtaacttcccgtagtcggtcgttactacttaacctccttaactttcaagtaaccggttcgaacccgggtaccctaggttccgtacgtttacggacggttcggtaccggttgaacgtagtacgggtacgttacggtactttaccgaacgttcctaaccggcgttaacgtaccgaagggtactaacccggttctaacggcccgtaaggtaccttaacgggaaactttaggtcttaaaccggaacttttaaacttacgttaacgtttaacgtaaagtttaacccgttacgtttaacccgtaccggttacccctaaacccgtcggtttaaccccggtaaccccggttaggttaccccggaacggtaaccgaaaccgttcgggtttaacccgaaaggtttaaaccccgttaccggggttacttaaccggggg

SEQ ID NO: 56588 - DNA, 824 bp, Homo sapiens
  misc_feature: GYAE6OF01AWR7S.29.87.H10.1.454.CMB.1.raw
  modified_base (107)..(107): a, c, t, g, unknown or other
  misc_feature (107)..(107): n is a, c, g, or t
  modified_base (405)..(405): a, c, t, g, unknown or other
  misc_feature (405)..(405): n is a, c, g, or t
tcagatagagtactcacgaccggtgctcgatttagcagtactgcgttgggtttggggcagaagtctctctcagtccagacacagcatggacatggacggccccccgntcagcctccgtgggacctcctgctgctcgtggcctacccgagactaccgagtatgtcgactatccagtactcgaccctagtcctacctacgttcccctcccgttgtccgtgcctagttcgtggtaggagacgagtacgtacaaccgtcgtacgttcggccgggactagtccgaaggtccttaattaaacgtatttagttacgccgtaggttaactcgaagccgagcgtaacgtacggaaacggttaacttaccacgtcctagtgtactctagtcgcgtacactacctccgttacgttnaacgtaacgtcggaccggtcctacgttccggtacggttacgaggggtcgacggtagtaacggtacgggtgtaacgtacgtaccgtcctacccgttaccgtacgtaccccgaggttaccaaccggaccgtacgttacccggtcgaaccgttaccgtaacggtaacgtaacgtttcggtaaccgttaaccggttaactttaaccggtttaacgtttaccgtttaaaaccggtaacttaaaccgttttaccaccccgttttacccggtaacccctttaaccccccgggttaagttccccccgggtttaaaccggtaccccggttaaacccggggtaaacgtaaacccgttaccgggtaaaacgggttttaacccgtaaaccggtttaaaacccggttaaaccggttcgggttaaacccgggg

SEQ ID NO: 56589 - DNA, 654 bp, Homo sapiens
  misc_feature: GYAE6OF01A4UU6.29.87.H10.1.454.CMB.1.raw
  modified_base (109)..(109): a, c, t, g, unknown or other
  misc_feature (109)..(109): n is a, c, g, or t
  modified_base (128)..(128): a, c, t, g, unknown or other
  misc_feature (128)..(128): n is a, c, g, or t
  modified_base (197)..(197): a, c, t, g, unknown or other
  misc_feature (197)..(197): n is a, c, g, or t
  modified_base (525)..(525): a, c, t, g, unknown or other
  misc_feature (525)..(525): n is a, c, g, or t
tcagatagagtactcacgaccggtgctcgatttagcagtactgcgttgggtttgggggcagaagtctctctcagtccagacacagcatggacatggacgggccccccgntcagcctcctgggactccngctgctctggcctcccagactaccagtatgtgacatccagatcgacccatcctccactccctcctgtcnacactcgtggagggatacagactaccaacgtcctacgtcggccgggtcgacggtacggaggtactaagttaaacttaatttacgttaccgtaccgttaggttacaccgacgaacgtacgtaacctaacggttaccggaaacggggtttaaaaccttcccgtaaacgtccttaccggtatagtctaagtcgtactcgtaccttactccttacgttgataaccggtcggtaccgtcctacggttcttcgggtatcgggtaggtcggtagtatcgggacggataccggtagtcctacgtcctacctacgacgtacagtaccgacgtccganccggtacgacgtagagtacgttgtaccttaacgttattacgttacgtactaagtacttacctactcccgttccaccctactcccgtacgtaccgaacgtaccgacgaactcgaagtataacgcgtgtcg

SEQ ID NO: 56590 - DNA, 807 bp, Homo sapiens
  misc_feature: GYAE6OF01B67ZT.29.87.H10.1.454.CMB.1.raw
tcagatagagtactcacgaccggtgctcgatttagcagtactgcgttgggttgggggcagaagtctctctcagtccagacacagcatggacatcggaccgggcccccgctcagcctccgtgggacctcctgcttcgctcgtcggcctacccagactaccagatgtacgaactactccgaagactccggaaccctgtcctaccctctccctcccttgtctgctatcgtaggtacgggacacaaggtacgtacctaacgtcctacggtcgggccgggacgacgtacgaggtaactaattaaacttagtttaactcgtccgttaggtactacgacgtacacgactaacggttaaccggaaagggttaaccttccaacgtccttacgtactactacgtctggctacacttaccttccgttataccgaactaccgtcggggtacccgttaccttacgttccgggtacggttaacggtcggggtcgggtacggtaggttaaacgtccggggtaacggtaacggttacgttaaccggtttccctaacccggttcaacccgtaaaccgtctaaccggtacgcccgtacgttaccgaccgaggtacctaacggtaggtaacttacgttcgtaaccttaaccggttaactttacgtaaccggttaaattaaccgtaacggtttcccttaacctaccccgtttaccccaacccgttaccgttcccgtaaacccgggtaccggtaacccgaaaccggggtaccctaaacggtttaacgggaaaccggttaaccgtaaaaccggtacggtccgggttacg

SEQ ID NO: 56591 - DNA, 816 bp, Homo sapiens
  misc_feature: GYAE6OF01EB5GK.29.87.H10.1.454.CMB.1.raw
  modified_base (320)..(320): a, c, t, g, unknown or other
  misc_feature (320)..(320): n is a, c, g, or t
tcagatagagtactcacgaccggtgctcgatttagcagtactgcgttgggtttgggggcagaagtctctctcagtccagacacagcatggacatgacgggccccccgctcagcctcctgggacctcctgcctgcttctggcctcccagactaccagatgtgacatccagatcgaaccctagtcctcctacttccctcctgtactgctacttcgtggtcgggagtaccgagtacgtactacgtctacggttcggaccggcaggtcgacgggtactaacttaaactaatttacgtttacgaccgttaggtaatacgacgtanacgacctaacggtacccggtaaaggggttaacccgtttacccgtaaccgtcgttaccgtagttactaaccgttgttcgacgtccgtaactaccgtttacccgttactttacggaacctaaggttacccggtaaccgggtacccttacgttacggtttcgttaccgggagggttcgggttacggtaagggttacgtaacgggtacggaacgtgttacgtaccgtaccgttccgaacccttaaccgaacttaccgacgaccgtaccgtcccgtaggacccgtaccgtagtaacgtaagtcgttggtaacttaccgttaatttaacggttcgtaaacgtttaacgttaacgttaccgttaaccgtacccgttacccccgtaaccccgtttagaacccccgggtttaacccggtacccggttaaacccgggaaccgttaaacgaaccggttaaccggtaaaggtaacccttttaaaacgggtaaccgtcgttaaaccggg

SEQ ID NO: 56592 - DNA, 786 bp, Homo sapiens
  misc_feature: GYAE6OF01D3GV4.29.87.H10.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagataccagatgtgacatccagatcgacccagtctccactccctcctgtctgcatctggtggganacagatacaacgtcacgtggccgggngagtcgaggctaattaactaatttagttacgccgttaggtatacgacgacgacgctacgtaccggtaaaggggtaaacgtttcccgtaaagtcccttaccgtagtactttacgttacgtcggtcctacgtacctacttacccgttacgttttcggaaccttaacggtcggtaccggggttacccttagttacccgggttccggttacgacgggggtttcgggtacggttagggtaacgttacgggttacgggggaacgttaaggttaaccggttcctaaccggttacccttaccctaaccgtacgttaccgacgtaccgaccgccgttaagacccgtacggtaaccgttaggaacgttcgtttaacggttaccgtaacgttaaacttttcgttaacggttaactaacgtaaacgtttacctaccctttaccgttaaccccgaccccttaacgttaccccgtaacccgggtaccggaaacccgggttaaaacggccgttaaccggtaacggtaacgggttaaacgtttaaacgtaaaccgggtagtttaccggggg

SEQ ID NO: 56593 - DNA, 739 bp, Homo sapiens
  misc_feature: GYAE6OF01CJ3DP.29.87.H10.1.454.CMB.1.raw
  modified_base (109)..(109): a, c, t, g, unknown or other
  misc_feature (109)..(109): n is a, c, g, or t
  modified_base (160)..(160): a, c, t, g, unknown or other
  misc_feature (160)..(160): n is a, c, g, or t
  modified_base (432)..(432): a, c, t, g, unknown or other
  misc_feature (432)..(432): n is a, c, g, or t
tcagatagagtactcacgaccggtgctcgatttagcagtactgcggttggggtttgggggcagaagtctctctcagtccagacacagcatggacatggacggcccccgntcagcctcctgggactcctgctgcctctggcctcccagactaccagatgtnacactccagatcgacccagtcctcctactcccttcctcgtactcgctacttcgtgggtacgggagacgtaggacgtactaaccgtctacggttcggccgggtcaggtacgaggactaagttaacttaattagtttacgtcgttggtatcaggcacgactacgtaccggtaaggtaacttaccgaacgtcctctagtacttcgtatcgtcgtacgacctacttaccgtattcgaactacgtccggtaccgggtcctacggttcgttcggtcgnggtcgggtacggtggtaagtgggtacggtacgtacggttaacgttcctaccgttaccaccgtactacgtacgtacggcctaccgtcgtccgacgtacgtacgtagtaacgttacgttcggtaacttaaccgttaacgtttacgtttaacgtaactttaaaccgtaacggtttaccttacccctttaccggttaccccgtaaccccttaccgtaccccggttaacccggacccgggttacggaaacccggttaaccgtacggttaaaccgtacgtaaaccggttaaccggtaaacggtcggtttacgg

SEQ ID NO: 56594 - DNA, 874 bp, Homo sapiens
  misc_feature: GYAE6OF01BOZKI.29.87.H10.1.454.CMB.1.raw
  modified_base (107)..(107): a, c, t, g, unknown or other
  misc_feature (107)..(107): n is a, c, g, or t
tcagatagagtactcacgaccggtgctcgatttagcagtactgcgttgggtttgggggcagaagtctctctcagtccagacacagcatggacatgagacgcccccgntcagctcctgggactcctgctgctctgcctcccagactaccagatgtgacatccagatcgaccctagtcctaccacttccctcccttgtactcgctacgttcgttagggtaggggaacgaaccgaaggtaacgttaaccgaaaccggttccgtaaccggtttccggggacccggggtacgtaacggttacccggaaggggtaaccttaaacgtttaaaactttaaagttttaacgttttaccggtacctttaagggtactaccgaacgtaccgtaacggaccgtaacggttaacccgggtaaaaggggtttaaaacccgttttacctaaacggtcccttaccggttagttaacgttaccttaagttccgtaccgttacgaaccttaaccttccgtttaactttacggaaccgttaacgtaccgggtacccgggttacctaaccgtttcgttaccgggttacggagggttacgggtacggttagggtaacggttcgggtaacggacgttaaccggtacgtttaccctacgttacccgtaaccacctacgtaccgacgtaccgtaccgtcgtacgaccgttacggaccttaagaacgttcgttaccggtaactaacttttaacgtttaactttacgtaaacgttaaactaaccgttacctacccgtttcctaccccgtacccgtaacgttaccccgacggtttaaccggacccggtaaacggaaccgtacggtaaggtaaacggtaaccgttaaacggtaacgtaacgg

SEQ ID NO: 56595 - DNA, 665 bp, Homo sapiens
  misc_feature: GYAE6OF01A071G.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatcgtgtggganacagtagtacaacgtcacgttcggccgggcgacgtacgagggctaagttaactaattaatttagccgtggtactcgagcagcatcgaggtaagtactaacgctctgatctatgactcgctaactcctacgttcgtactaacgtcgaacggggttcccaacttccgttcggttcgtaacggtcgggtcggtacgggtagtaggtacgggtacgagtaacgtctaacgtcctaccacctagactaacgaccgtacgccgtacgaccgacgtccgtaaggttaacgagttacgtacgtaccgttaaactttaacttacgttaacgtaactaaacgttaccgtaacttaccgtttacctaccccctaacgttcccgtaacccgtacccggttaaccgaaacccgggtacgaaaccggttaaccgaaacgggtaccgtaaaactttaaacgggtaaccgttaaccggg

SEQ ID NO: 56596 - DNA, 942 bp, Homo sapiens
  misc_feature: GYAE6OF01BVJZ3.29.87.H10.1.454.CMB.1.raw
  modified_base (108)..(108): a, c, t, g, unknown or other
  misc_feature (108)..(108): n is a, c, g, or t
  modified_base (585)..(585): a, c, t, g, unknown or other
  misc_feature (585)..(585): n is a, c, g, or t
tcagatagagtactcacgaccggtgctcgatttagcagtactgcgttgggtttgggggcagaagtctctctcagtccagacacagcatggacatggacgggccccccnctcagcctccgtgggacctcctgctgctctcggcctccagactaccagatggtcactactaccagactcgaccccgtagtccctacctaccgttcccttcccgttgtccgtacgtaccgtacttccggttagggtagggaacgaccgtaagtaccgtaacccgttaaccggtcccgtaccggttccgggggaccggggtacggtacggtaccgggtaacgggtaaccttaaaggttttaaaaccttaaagttttaccgttttacccggacgtttaaggttaccttacgaacgtcggacggaaacccttacggttaaccccgggaaaggggttaaaccctttaccgtaaccggttccgtaccgttagtaccgtttacctagttaccgcttaacgtaccttaccggttaccctttaacgttacggaacgttacccggtacggggttaacccggtacctaaccggtttcccggttaaggngggtaccgggttacggggtacggtaggtaacgtacgggtaacgggtaacgttcgttaacgtccgttaaccccctcggttaacaacccgtacgtacgaaccggtaccgtccggtacaccggtaacgtacggttagtaaaccgggtacttttacggggaattaaccgtttacccttaaacgttttacgggtaaacctttacggttaaaactacggtttcccttaaacccggttaaccctttcccccggaaacccctaggttccccgtaacccgggttaacccggaacggggttaaacccgccgtaacggttaaacgaaccgggtttaagtaaaccctttaagggggccgttaacccggg

SEQ ID NO: 56597 - DNA, 790 bp, Homo sapiens
  misc_feature: GYAE6OF01BB3YD.29.87.H10.1.454.CMB.1.raw
tcagatagagtactcacgaccggtgctcgatttagcagtactgcgttgggtttgggggcagaagtctctctcagtccagacacagcatggacatgaggcccccgctcagctcctgggactcctgctgctctggctcccagataccagatgtagacatccagatcgacccagtcctaccactccctccctgtctgctatctggtcgggagacagacgtacaaccgtctacgtcggcccgggcgacgtcggacgggactaacttaaactaagtttaacttacggcccgttaggtactaccgacgtacgaacgtccgtaacgtacccggaaaggggtttaaaccgttacccgtaaacgtcccggtttaccgtacggtaactttacgttacgtacgtccgttacgtacctacttcccgttaaccgtttacaccgtaacgtccgggtaaccgggttccctacgtttccgttacggttacgtagggtcggggtcggtaggtaacgttacggtaggggtaactaacggttacgttaccaccgtttaccgaccgtaaccctacgtaccacgtaccctacggccttacggacgaccggttccgtaaggtaacgtacgttcgtaacgtacctttaacgtttacttaagtaaccgttaagtaaaccgttcttaaccgttaccgtttacccgacccccttaacgtccccggttaacccggttaccccgggacgtaaaccccggggtactaaaccggtacggtaacggtaaaccgttaaacgtaaacccggttacggtacggg

SEQ ID NO: 56598 - DNA, 739 bp, Homo sapiens
  misc_feature: GYAE6OF01B7SU6.29.87.H10.1.454.CMB.1.raw
tcagatagagtactcacgaccggtgctcgatttagcagtactgcgttgggtttgggggcagaagtctctctcagtccagacacagcatggacatgacggcccccgctcagctcctgggactcctgctgctctggctcccagataccagatgtgacatccagatcgacccagtctccatccctcctgtctgctatccgtggtagggacgtacagacgtaccaacgtctacgttggccggacgacgtcgaggactaattaaactaagttacgttagacccgttggtactcgacgtcgagtaccgacgtacgtaacggtaaacttccgtaagtcctctagtactctagtgtctacgactacttacccgtgtttacgaaccgtagtaccgtaccggggtacctcgttaccggttaccggttacggcgggttacgggtcggttaggtacgttacggtacgggtaacgtacggtaaccgttctaccgttccgtaaccgtaccacgtacgacgtctaccggctaacgccgtaacgtacgtacgtaagtacgtacgtttacgaaccgtttaatttaacccgtagtttaacgtaaaccgttaagttaccttaacccgttaccgttccccgaacctttaaccgtaccccggttacccgttacccgggtaacccggaacgggtaaaccccggttaacgtaaccgtaacggtaaaaccgttttaaggtaaaccccgttaggttacccgggg

SEQ ID NO: 56599 - DNA, 698 bp, Homo sapiens
  misc_feature: GYAE6OF01EWTXO.29.87.H10.1.454.CMB.1.raw
  modified_base (107)..(107): a, c, t, g, unknown or other
  misc_feature (107)..(107): n is a, c, g, or t
  modified_base (127)..(127): a, c, t, g, unknown or other
  misc_feature (127)..(127): n is a, c, g, or t
  modified_base (144)..(144): a, c, t, g, unknown or other
  misc_feature (144)..(144): n is a, c, g, or t
  modified_base (156)..(156): a, c, t, g, unknown or other
  misc_feature (156)..(156): n is a, c, g, or t
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (334)..(334): a, c, t, g, unknown or other
  misc_feature (334)..(334): n is a, c, g, or t
tcagatagagtactcacgaccggtgctcgatttagcagtactgcgttgggtttggggcagaagtctctctcagtccagacacagcagtggacatggacggcccccgntcagctccgtggactcctgntgactctgacctccagntaccaggatgtnaccatccgagaactcgtaccagtcctccatcccgtcctgtctgactntcgtgagggactacagngtacaacgtcgaactggccggtanatcgaggacattaaccgattatacgcctggtatcgagcagactacgtaccgaaggtaataccgtaaacgcgtacctagtcgtactgtagntcgtacgtactccgtaacgtttgaacctaagtaccggtacgtaccccgtagttccgtacccggttagtacggttaggtaccggggtaagtaacgttacggtaggtaaccggaagtaacggttcctacgtacgttacccacgtaactctaacggcacggtaccgtcgaatcgtaacggttactaagtagttacgtaacgttcgtaaacctttaacgtttactacggtaaactaaacggttacttaccctaaccggtttccggtaaaccccttacggttacccgtaacggttaccggttaagaaaaccccggtttacaaccggtttaacgagtttaaaccggaagttaaacccgtaaggttaccgg

SEQ ID NO: 56600 - DNA, 719 bp, Homo sapiens
  misc_feature: GYAE6OF01CTG0I.29.87.H10.1.454.CMB.1.raw
  modified_base (212)..(212): a, c, t, g, unknown or other
  misc_feature (212)..(212): n is a, c, g, or t
  modified_base (353)..(353): a, c, t, g, unknown or other
  misc_feature (353)..(353): n is a, c, g, or t
  modified_base (403)..(403): a, c, t, g, unknown or other
  misc_feature (403)..(403): n is a, c, g, or t
tcagatagagtactcacgaccggtgctcgatttagcagtactgcgttgggtttgggggcagaagtctctctcagtccagacacagcatggacatggacgggcccccgctcagctcctgggactcctgctgctctggcctcccagataccagatgtagacatccagatcgacccagtctaccactccctccctgtctgctatcgtggtggganacagacgtcctaacgtctacgttcgggccgggagaacgtcggaggtactaacgttaaactaattttacgttacgccgttaggtatacgagtacagtctagtaccggaagggtaaccttccaacgtctccgtagtatcgtangtctcgactctacctacttgactagcgtacggtcctagttcgtcggtcgnggtacggtacggtgtagtacggtagacgtacgtacgtacctacctaccaccgtacctacgtaacacggtaccgtacgtccgtacgtaccgtacggtacgtaacgtacgttacggttaccgtaacgttaacctttaaaccgtttacgttaaccgtttaaacgtaaaccggttaacgtttaacccttacccgttacccttaccccgtacccgttaccgttaccccgtaacccgggttaacccggtaacgggtaaaccgtaacgtaacggtaacggttaaacggttaaacggttaaaccgttacgtaaccgggttacgg

SEQ ID NO: 56601 - DNA, 840 bp, Homo sapiens
  misc_feature: GYAE6OF01CHCXJ.29.87.H10.1.454.CMB.1.raw
  modified_base (107)..(107): a, c, t, g, unknown or other
  misc_feature (107)..(107): n is a, c, g, or t
tcagatagagtactcacgaccggtgctcgatttagcagtactgcgttgggtttgggggcagaagtctctctcagtccagacacagcatggacatgacgggcccccgntcagcctcctgggactcctgctgctcgtggcctcccagactaccgagtatgtgacatccagactcgacccagtcctcctacttccctccctgtcctagctacgttcgtgggtacgggaacgaacgaggtacgtacgtaaccgtctaccggttcgggccgggacgacggtacgaggtactaacgttaaactaattttactttacgaccgttaggtactacgacgacgtacgtacgtacgtaaccgggtaacggggttaaaccttacccgtaaacggtcctttacccgtaggttacttacgtaacgtcggtcctacgtacctaccgtttaccgttagttttacaaccgttaacggtaccggttaccgggttacccttaacggttccggttaccgggtttacggtacggggttcgggtacggggttacggtaacggttaacgggtacggggtaacgtacggttacggttaccgtaccttacctacccgtaactacgtaccgtacgcgtacgtccgtaccgacgtaccgtagtacggtaattagttacggtaacgtaacctttaacgtttacgttaaccgttaataaccgttaaacgttcccgttaaccgttaccccgtaccccgtaacccttaccgtacccggtttaacccgtacccgggtaaacccggtaaccggaacccggttacgtaaacgggttacggtaaaaccgttaacccgggtaaaggtaccttcggg

SEQ ID NO: 56602 - DNA, 805 bp, Homo sapiens
  misc_feature: GYAE6OF01BRFIS.29.87.H10.1.454.CMB.1.raw
tcagatagagtactcacgaccggtgctcgatttagcagtactgcgttgggtttgggggcagaagtctctctcagtccagacacagcatggacatggacgggcccccgctcagctccgtgggactcctgctgctctggcctccagtactaccgagatcgtgacactaccgagactcgaccctagtcctaccctacttccctcccgttgtctcgtctagttcgtagggtggaacgacgtagacgtaccaacgttccgtacgtcggggcccggagtacggtacggaacgggtacttaaaagtttaaaaccttaagttttaaccgtttacggtacccgtttaaggtactaccgaaggacctaaggtccctaaaccggtacgggtaaacggttaaaaccggtttaccctaaaccggtcccgttaccgttaggtaccttaccgttaagtcccggtcgtacgtacctacttacccgttacgttacgagtaaccgtcgggtaccggtccttacgtacgtggtacgtacgggtggtacggtagttacgtaacggtcggagttacgtacgttaacctaccgttactaccaacgtacgtacgacggtctaccggtactcgaacgtcggaacgtacggtaacgttagttcgttaaccgttaactttacgtttaacttacggttaacgttaacgttaactaacgtaccctaccgttccctaaccctacgtttaacccgaccgtaacccggtacggtaaaccgtaacgtaccggtttaacgaaacgggttaaccttaaaggtaacccggttggtaccgg

SEQ ID NO: 56603 - DNA, 883 bp, Homo sapiens
  misc_feature: GYAE6OF01CI8MX.29.87.H10.1.454.CMB.1.raw
  modified_base (108)..(108): a, c, t, g, unknown or other
  misc_feature (108)..(108): n is a, c, g, or t
  modified_base (239)..(239): a, c, t, g, unknown or other
  misc_feature (239)..(239): n is a, c, g, or t
tcagatagagtactcacgaccggtgctcgatttagcagtactgcggttgggtttgggggcagaagtctctctcagtccagacacagcatggacatggacgggcccccnctcagctccgtgggactcctgctgctcgtggcctcccagactaccagtagtgtacgactatccgaagactcggaaccctaggtcctccctaccttcccgtcccgttgtccgtaggcctattcggttagggnggggaacgacgaggtacgtacgtaaaccgtcgtacggttaccgggccggggacggtacggtaccggagggtacctaagttaaacttaagtttaattcggtaccggttggtaactccgagaccgagtaccgtacggtaaccgggaaacggggttaaaccgttaccgtaacggtccgttacgtaggttactcgttacgtacggtccttacgtaccgttaccttaccgttacgttttacccgggaacttaaacgggtccccgggttaccgggtaccccgttaacgttccgggtttacggttaacgggtacggggttcggggtaccggggttaaggttaaacggtcgggttaaccggggtacgttaagggttacccgttaaccgtaccgttacctacgaactccggtaaccgacggtacccgcgtaccgtacgaccgtacgtaccgggttaataacggttgttaacgtaaccgttaactttaaccgtttacgttaacgtaacccgttaactaaacccgttttaaactaaaccttaaccgttaccctaaacggttaacctaacccgggttacccgggtaacccggaaacggttaacccggtaacgacggtaaaccggaacggtaagggtaccgtacggtcggtaaccgg

SEQ ID NO: 56604 - DNA, 754 bp, Homo sapiens
  misc_feature: GYAE6OF01ERB11.29.87.H10.1.454.CMB.1.raw
  modified_base (162)..(162): a, c, t, g, unknown or other
  misc_feature (162)..(162): n is a, c, g, or t
  modified_base (331)..(331): a, c, t, g, unknown or other
  misc_feature (331)..(331): n is a, c, g, or t
  modified_base (537)..(537): a, c, t, g, unknown or other
  misc_feature (537)..(537): n is a, c, g, or t
tcagatagagtactcacgaccggtgctcgatttagcagtactgcgttgggtttgggggcagaagtctctctcagtccagacacagcatggacatgacgggccccccgctcagcctcctgggacctcctgctgctcgtggcctcccagactaccagatggtanacatccgagatcgaccctagtcctccactccctccctgtctgctatcgtggtagggacacgagacgtacaaccgtcgtacgtcgggaccggtacgtacggtacggacggtactaaacgttaacttaattttaacgttacgtacccgttaggtacttaccgacgtaccgngtacctacggtaaccggtaaacgggtaaccgtttacgtaaccgtaccgttcctaagtagttacttacgtcgtctcaccgttaaccttccgtactttagaccgtaacgtacggtacgtccctacttccggttcggtacgtagggtacggtacggttagaggttacggtacgggaattaccggtacttacgtaccctctaccacctanagtaccgactaccggcctagaccgtaccgtaagtacgtacgttaggtgtaccgttaactacctttagttaacgttaagtaaccgttaatttaccgttaccgttacccgtacccctacccgtaacccgtttaccccgtacccggtaaccgggtacccgtaagggttaaccctaagggtaaccgtaggtaaaaccctacggttaaactcggttaccggg

SEQ ID NO: 56605 - DNA, 708 bp, Homo sapiens
  misc_feature: GYAE6OF01BLH97.29.87.H10.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (474)..(474): a, c, t, g, unknown or other
  misc_feature (474)..(474): n is a, c, g, or t
  modified_base (558)..(558): a, c, t, g, unknown or other
  misc_feature (558)..(558): n is a, c, g, or t
tcagatagagtactcacgaccggtgctcgatttagcagtactgcgttgggtttgggggcagaagtctctctcagtccagacacagcatggacatgacgggccccccgctcagctcctgggactcctgctgctctggctcccagactaccagatgtgacatccagatcgacccagtcctccactccctccctgtcctgactntcgtggtacggganacgaggacgttaccaaaccgtctacggttcgggcccgggcgagtccgagggacttaattaactaagttttacttacgccgttagggttactaccgaacggaccaggtacctacgtaacccgggtaaaggggtaaaccgttacccgtaaggtccctttaccgttaacgtacgtttacttcgtacgtctacggacctaacgttacccttacgttacgaccgtaagttccggtaccgggtcctacgttccggtcggttacgngggtcgggtacggtggtacgttacgtacgggacgtagtcgttaccacgtacctaccactagtccgacgacgtccggctacgacncggtactagaacgttcgtacgttcaacgtttaccgtttaattacgtacgtaactaacgttctacccttacgttccccacctacgtacccgttacggaccggtacgaccggtaactacggtataccggtaaagtacttaaaggtcgtacgg

SEQ ID NO: 56606 - DNA, 836 bp, Homo sapiens
  misc_feature: GYAE6OF01DQNRC.29.87.H10.1.454.CMB.1.raw
  modified_base (108)..(108): a, c, t, g, unknown or other
  misc_feature (108)..(108): n is a, c, g, or t
  modified_base (178)..(178): a, c, t, g, unknown or other
  misc_feature (178)..(178): n is a, c, g, or t
  modified_base (251)..(251): a, c, t, g, unknown or other
  misc_feature (251)..(251): n is a, c, g, or t
tcagatagagtactcacgaccggtgctcgatttagcagtactgcgttgggtttgggggcagaagtctctctcagtccagacacagcatggacatggacgggcccccgntcagcctccgtgggacctcctgctgctcgtggcctcccagataccagatgtgacactccagatcgacccngtcctcctatccctccgtgtctgcatcgtggtggggacacgagacgtactaacgtctacgttcgggaccgggngagtcgaggactaagttaactaattacttacgccgttaggtactcgacgtacgacgtacgtaccgtaaccgggtaaacggggtaaaaccgtttacccgtaaacggtcccctttacccgttacgtaactttaccgttaagttcggtacttacggacccttaacctttccctacgttttacgaacgttaaccgtaccggggttacccgggttaccctacggtttaccgttaccgggttcgtacggggttacgggtcgggttaacgtaggttaggtacgggaacgttacgtcgtttaacctacccttacctaccgtaccgtacgtaccgaccgggtaaccgtaccggttcccggtaactcccgggaacggttacccgtaagggttaacggtacgtttacggttaacccttaaacgtttaaacctttaccgtttaacgttaagttaaaccttaacggttaccttaacccggttacccttaccccgaccccttaacccgtacccggttaacccggtacccggttaacccggaacgtacccgtaaacggtcgtaaaggtaacggtttaaaacggtaagttaccgggtacgg

SEQ ID NO: 56607 - DNA, 712 bp, Homo sapiens
  misc_feature: GYAE6OF01CLEUP.29.87.H10.1.454.CMB.1.raw
  modified_base (106)..(106): a, c, t, g, unknown or other
  misc_feature (106)..(106): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (238)..(238): a, c, t, g, unknown or other
  misc_feature (238)..(238): n is a, c, g, or t
tcagatagagtactcacgaccggtgctcgatttagcagtactgcgttgggtttgggggcagaagtctctctcagtccagacacagcatggacatgacgggcccccnctcagctcctgggactcctgctgctcgtgctcccagactaccagatgtgacatccagatcgacccagtcctccatccctccctgtctgcatcgtggtggganacagagtacaacgtcacgttggccgggngngtacgaggactaagttaactaatttagttacgccgttagtatcaagcacgactacgtaccggtaaggtaaacttccgtaaacggtctcccgtagtacttactagtcgtcgtacgtctaccgttccttaccgttttgaaccgtaacgttccgggaacccgggttccctacgttccggttacggtttacgtacgggttaccgggtcgggttagtaacggtttggaacggggaccttaggttaccgttacctaccgttaccctaccgaaccgtacttaccgacggtaccaccggttacgcgtaccgtacgtccgaaggtaacgtgttcgttaacctacttaaagttttactacgtaactaacgttaactaccgttaccctttacgtacccctaccctacgtccccgtaaccggttacgaccgggaaacgacccgttaacggacgttaacggaagtttaaaccgtacgtaggtaccgg

SEQ ID NO: 56608 - DNA, 708 bp, Homo sapiens
  misc_feature: GYAE6OF01DBAFL.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatcgacccagtcctccactccctccctgtcctgccattcgtggtagggaacacgaggagttaccaaaccgtctacgttcgggcccgggagacggtcgaagggactaattaaacgtaatttaatttacgccgttaggtatcgagcacgcacgtaccgtaaggtaaacgttccgtaagtcctaccgtgacttctacgtgtctcgactacttcctactttgactaacgtacggaccgggttccacgttccgtcggttcgaggtcgggcggtaggtacgtagggtcgggaacgtacggacgttccgtactcgtacctaccgtatacgaccgactacgtccgtacgccgtacgtccgtaaggaagttacgttcggttacgttaaccgttaaacgtttaacttacgttaacgttaaacttaacgttaacttcccgttaacccgtttacccgaccccgttaaccgttacccgtaccggttacccggaaccggtaaccgggtaaccgacgtacgtaaacgggttaacgtaaaacgttaacggtaacgttacggg

SEQ ID NO: 56609 - DNA, 903 bp, Homo sapiens
  misc_feature: GYAE6OF01BTP58.29.87.H10.1.454.CMB.1.raw
  modified_base (106)..(106): a, c, t, g, unknown or other
  misc_feature (106)..(106): n is a, c, g, or t
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatccctcctgtctgcatctggtgganacagagtcaaccgtcacgttcggccgggacgagtcgagggcaagttaactaatttagttagccgttaggtactcacgcacgactaacgtaccgaagggtaaacgttcctaacgccgttacctagacttcgtatgtactgtactactcctacttacgactacgtaccggtacgggtaccctacgtaccgttcggttcgtacgggtcgggacggttaggtacgttaggtacggggtaactaacggtaccgtttaccgtaaccgttaccctaacccgtaaccctacggttaccgaaaccggtacccgtaaccggttccccggtaccgggtaccccgtaaccggttaccccgggttaaaccgggttaaagttacgggtttacggtttaaaccgggttaaacccttttaaaacgttttaacccgttttaaacccggttttaaacggttaaaaccggtttaaaaaccgttttaacccgtttaacccgttttaaaccccccggtttttaccccggtaaccccccccgtttaaaccgtttaaccccccggggtttaaccccgggttaaacccccggggttaaacccccgggtaaaaccggggtaaaaccccgggtttaaacccgggtaaacccgggtttaaaacggggttaaaccggtttaaaaacccgggttttaaaaaccgggtaaccccgggttttaacccgggggg

SEQ ID NO: 56610 - DNA, 721 bp, Homo sapiens
  misc_feature: GYAE6OF01EF0OV.29.87.H10.1.454.CMB.1.raw
  modified_base (239)..(239): a, c, t, g, unknown or other
  misc_feature (239)..(239): n is a, c, g, or t
  modified_base (530)..(530): a, c, t, g, unknown or other
  misc_feature (530)..(530): n is a, c, g, or t
tcagatagagtactcacgaccggtgctcgatttagcagtactgcgttggggtttgggggcagaagtctctctcagtccagacacagcatggacagtggacgggccccccgctcacgtccttccgtgggacctccgtgcctgctcgtcggcctcccagactaaccagtactggtcaacctactccagtactcgacctacgtcctccactccctcctgtctgacctatcgtggtacggganacgagtcgtaccaacgtcgtacgtcggccgggtcgtagtacgacggtactaacttaacgttatttacgtaccgtaccgttaaggtactacgacgtacgagacctaacgtaccggtaaagggttaaccgtttaccgtacgtccttcgtacgtacttcgtatcgtactacgtacctacttacccttacgttacgaccgtacgtacggtaccggtccttacggttcggttacgtaggtacggtcgggtacggttagtagttacgggacgtacctagttcttaccgacgttaccncaacgtatcgacgactccgtctcgactcgtactaaggtacttgttacgtaattactttattaccgttaacgttaacgtaagttactccgttacttacccgtaccctaccgtaacgttcccgtaacgggtaccgtaccggtaaccgcttaacggtacgtaaacgtaactttaaacgtacccggtgttaccgg

SEQ ID NO: 56611 - DNA, 864 bp, Homo sapiens
  misc_feature: GYAE6OF01EQUEQ.29.87.H10.1.454.CMB.1.raw
  modified_base (159)..(159): a, c, t, g, unknown or other
  misc_feature (159)..(159): n is a, c, g, or t
  modified_base (669)..(669): a, c, t, g, unknown or other
  misc_feature (669)..(669): n is a, c, g, or t
tcagatagagtactcacgaccggtgctcgatttagcagtactgcgttgggtttgggggcagaagtctctctcagtccagacacagcatggacatgacgggcccccgctcagcctcctgggactcctgctgctcgtcggcctcccagataccagatggtnacatccagctcgacccagtcctccatccctccctgtctgcactgtggtacgggagaccagtacgtactaaccgtcgtacgttccgggaccggggctacggtacggaacgggtactaaacttttaaaaccgtaaagtttttaacttttaccggtacccgttagggttaaccttacgacggaccgttaacggaccgttaaacgtaaccccgggtaaagggggtaaaaccgttttaccccggaaaacggtacccttcccggtaaggttaaccttacgttaacgtcggtaccttcggtaccttaacccgtttaacccttacggttttaccgaaccgttaaaaccggtcccggggttaacccgggtttaaaccctcgttacccgggttttacggtacggggtacgggtacggggtcggttaagggtaaggtaacgggttacggggtaacctaacgggttaacgttccgttaccgttaccttacccgaaaccgttaactcgtaaccggtacccggngtacccgtcgaaccgtacggtaccgtaagagtagtttacgtacgttaacccttaagtttactaacgtttaccggtaaattaaacgttccttaccgttaccgtttacccgcccttaaccttcccggtaacgttaccggaccggtaacggaccctaaaggtaccgttaacggaataaacgtacgttaacggtacggg

SEQ ID NO: 56612 - DNA, 788 bp, Homo sapiens
  misc_feature: GYAE6OF01DLG5K.29.87.H10.1.454.CMB.1.raw
  modified_base (244)..(244): a, c, t, g, unknown or other
  misc_feature (244)..(244): n is a, c, g, or t
  modified_base (514)..(514): a, c, t, g, unknown or other
  misc_feature (514)..(514): n is a, c, g, or t
  modified_base (568)..(568): a, c, t, g, unknown or other
  misc_feature (568)..(568): n is a, c, g, or t
  modified_base (687)..(687): a, c, t, g, unknown or other
  misc_feature (687)..(687): n is a, c, g, or t
tcagatagagtactcacgaccggtgctcgatttagcagtactgcgtttggggtttgggggcagaagtctctctcagtccagacacagcatggacatgacgggcccccgctcagcctcccgtgggacctcctgcttgctcgtcggcctcccgagaactaccagtatgtacgactactccaagactcgaacccctagttcctcctacttcccctcccttgtctcgactcttcgtgggtacgggganaacgaaggtacgtactaaccgtccgtacgttcgggccgggacggacgtacgacgggtataaacttaaacgttaactttaacgtttaccgtccgttaggttaactccgacgtacgacgtaccgtaacgtaaccgggtaaacgggttaaaccgttaccgtaacgtccgttaccgttgttacttacgtagtctccgtctactaccttacgttacgttcgaacgtacggtaccgggtaccggttactcgttaccgttcggttcgagggttgggnggtagtagtacggtgtacgtagtacgttactactccgactactacgactcgacncggtaccgcgtacgaccgtacgtagtacgttacgttacgtacgttaaccttaagtttacgttaacgttacgttaaaccgttacgtaacctttacccgttaacccttaccccgttacccnccggttaacccgtacccggtaacgggccgttaaaacccgggtccgtaaccgggttaaccgtaagggtaaccgtttaaaaccggttaacggtgttacccggg

SEQ ID NO: 56613 - DNA, 701 bp, Homo sapiens
  misc_feature: GYAE6OF01EOJGL.29.87.H10.1.454.CMB.1.raw
  modified_base (158)..(158): a, c, t, g, unknown or other
  misc_feature (158)..(158): n is a, c, g, or t
  modified_base (259)..(259): a, c, t, g, unknown or other
  misc_feature (259)..(259): n is a, c, g, or t
  modified_base (456)..(456): a, c, t, g, unknown or other
  misc_feature (456)..(456): n is a, c, g, or t
  modified_base (517)..(517): a, c, t, g, unknown or other
  misc_feature (517)..(517): n is a, c, g, or t
  modified_base (532)..(532): a, c, t, g, unknown or other
  misc_feature (532)..(532): n is a, c, g, or t
  modified_base (617)..(617): a, c, t, g, unknown or other
  misc_feature (617)..(617): n is a, c, g, or t
  modified_base (693)..(693): a, c, t, g, unknown or other
  misc_feature (693)..(693): n is a, c, g, or t
tcagatagagtactcacgaccggtgctcgatttagcagtactgcgttgggtttgggggcagaagtctctctcagtccagacacagcatggacatgacgggcccccgctcagctcctgggacctcctgctgctcgtggctcccagactaccagatggtnactatccaagatacgacccagttcctacctacttccctcccgtgtctgctatcgtggtagggacgacaggtacgtaccaaccgttcacgttcgggccgggntaacggtcgaaggactaattaaactattttattacgacgttgttatcgaagacacggactaacgtaccggtaacggggtaacgtttaccaacggtcccttacgtagtacttccttaagtcgcgtctactactaccttacttacaaccgtagtccgtaacgggtccctaagttccggttacggtcgtagggttccggnggttaaggtacgttagggacgggtaactaagttacgtacttaccgtacgtacccaccgtanaccgaactccggacnccgttgacgtacgactaggaagttgtactactactttaattaacgttaccgaattaaacgtacgttcgtaccttccgttaacccncccgttactacccggttaccgaaccggtacgggaaccctacgtaaccggttataacgggtaccttaaaacgttccngggtaccg

SEQ ID NO: 56614 - DNA, 890 bp, Homo sapiens
  misc_feature: GYAE6OF01AWNCH.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctcgtggcctcccagactaccagtatgtgacatccagatcgacccagtcctccatccctccctgtctgcatcgtggtagggactacgagacgtaccgaacgtcctacggttcgggcccggggtacggtagtccggaaggggtaccttaaactttaaaccgtaaagttttacgtttaacggccgtttagggtaactcgaaggtccgaggtcctaacgtaccggtaaacgggggttaaaactttcccggtaaacgtcccgtaccgttaaggtaacctttacgttacgtacgggtcccttacggtacctttaaccttaccccgtttaacgtttaccggaaccttaaaccggggttaccccggggtaacccggggttacccccgttaacgtttcccgggtttaccggggttacggtaacgggggttcggggtaccggggtttaggtaacgttacggggttaaccgggaacgttaggttacccggttacctaccgttcccgactaaaccgtctaacgtaccgccgtaacggtcccgtacgccgtaacggttaccgaaggtaaacgttcgttaacggttacgttaaaccttaacggttttaaccgttaacgtaaacgttaaaccgttaaagttcccgttaaccgtttacccgttacccgtaaccccttacgttaccccggtaccgttaacccgggaaccgtaacgggtaacccgtaacggttaaccggtaaggtaaaaccgtttaaaccggtaacgggtgttaccggg

SEQ ID NO: 56615 - DNA, 805 bp, Homo sapiens
  misc_feature: GYAE6OF01BON5A.29.87.H10.1.454.CMB.1.raw
  modified_base (373)..(373): a, c, t, g, unknown or other
  misc_feature (373)..(373): n is a, c, g, or t
  modified_base (445)..(445): a, c, t, g, unknown or other
  misc_feature (445)..(445): n is a, c, g, or t
tcagatagagtactcacgaccggtgctcgatttagcagtactgcgttggggtttgggggcagaagtctctctcagtccagacacagcatggacatggacgggcccccgctcacgcctcccgtgggacctcctgctgctctggcctcccagactaccagatgtacgactactccaagactacgaccctacgtcctacctactccctcccgtgtcctcgcctacttcggtagggtacgggaacgtaaccgtaggtaccgttaccgtaaccgtaccgttaccggttaccgggcccggggaccgtacggttacggaacgggtcttaaacttaaaccgtaattttacgttacggtccttaggtacctacgacgcgtancctacgtaccgggtaaagggtaacctttacccggtaacgtcccgttacgtatacgttacttacgtaccggtntaccgtacctaccttccctagttaccgacgttacgtcccgggtaaccggtccctaggttcccggttggttacggaggtcgggtcggttagtacttacgggacgggtaccgtagttaccgttcctacctccgactccgtactcgaccgtacgtccgtacctcggaactccggtatacgggtaacgtttgtccgtaaccttacgttacgtttaacgtccttaaacgtactaacttcccttaacccttcccggttaaccccacccttaaccgttaccccgggtacccgttaaccgggaccggtaacccgaccggtaacgggtacctaacggttaaacgaccgtttaaacggcggttaaccggg

SEQ ID NO: 56616 - DNA, 822 bp, Homo sapiens
  misc_feature: GYAE6OF01EEPYJ.29.87.H10.1.454.CMB.1.raw
tcagatagagtactcacgaccggtgctcgatttagcagtactgcgttggggtttgggggcagaagtctctctcagtccagacacagcatggacatgagggcccccgctcagctcctgggactcctgctgctctggctccagataccagatgtgacatccagatcgacccagtcctccactccctcctgtctgcatcgtgtgggagacagagtcaacgtctacgttggaccgggcgagtcgaggctaattaaactaatttacttacgccgttaggtactcgacgactagacctaagtaccggtaaggggtaaaaccgtttaccgtaacggtccctttacccggttaggtaaccttacttaacggttcgtaccgttacggtaccctaaccttacccgttaaccgttttacggaacccgttaaacggtttcccggggaaccggggttaccccctaaggtttcccggtttaacgggttacgtaacgggggtttcggggtcggttaacgggtaacgtttacggggtaacggggtaacgtaacggttaccggtttaccctacccggtttaacccctaacccgaacgtacgtaacggaccgtacccgtacggtacccgtacgacgtaaccggtacgttaagtacgttaacggtttcgtaaccgttaactttaaccttacgttaacgtttaacggtaaaacttagttacccttacctaccgttccccgaacgttcccgtaacccgttcccgggtaacccggaaccgtaaaccggtaccgaaaccgggtttacgtaaacggaaacctttaaacggttacgtcggttaccgg

SEQ ID NO: 56617 - DNA, 767 bp, Homo sapiens
  misc_feature: GYAE6OF01EZ8FT.29.87.H10.1.454.CMB.1.raw
  modified_base (107)..(107): a, c, t, g, unknown or other
  misc_feature (107)..(107): n is a, c, g, or t
  modified_base (760)..(760): a, c, t, g, unknown or other
  misc_feature (760)..(760): n is a, c, g, or t
tcagatagagtactcacgaccggtgctcgatttagcagtactgcgttgggttggggcagaagtctctctcagtccagacacagcatggacatggacgggccccccgntcacgcctccgtgggacctcctgctgctctggcctcccagactaccagactgtcgacactccaagactcgaccccagtcctccactccctccctggtctgctagtcgtgtggggactacagacgtccaacggtcacgtcggccggtacgagtccgagggactaattaaactaagtttacttacgcccgtaggtactaccgaggccaacgccagttaccccgaaaggggtaacctttaccgtaacgtccttacccgtagtaacgttccgttataccggtctacggtacctaccttaccccttactttacggaccgtaaacgttaccgggtaacccggggttacccctaaggtttcccggttaccgggttactacggggtacgggttacggtagggtaacgttacggtacggggtactaacggttaacgttcgtaaacccttcctacctaacccgtacgtaacgtaacccggccgtaacgtccccgtagtacccgacgtactaacgggaaattcgttagttacctacttaacgtttacttacctagttaaacccgaattccctacgttccttaacccgtaccctcgttacccgttaccgttaccgaacggaacgtaacccgacgttaaccggagaaccggtaacgtttaaaacgnggttacg

SEQ ID NO: 56618 - DNA, 800 bp, Homo sapiens
  misc_feature: GYAE6OF01EVGNJ.29.87.H10.1.454.CMB.1.raw
  modified_base (107)..(107): a, c, t, g, unknown or other
  misc_feature (107)..(107): n is a, c, g, or t
  modified_base (172)..(172): a, c, t, g, unknown or other
  misc_feature (172)..(172): n is a, c, g, or t
  modified_base (253)..(253): a, c, t, g, unknown or other
  misc_feature (253)..(253): n is a, c, g, or t
tcagatagagtactcacgaccggtgctcgatttagcagtactgcgttgggttgggggcagaagtctctctcagtccagacacagcagtggacatgacgggcccccgntcagctccgtgggactcctgactgctcgtggcctccagactaccagtatggtcactatccaaggntcggaccctagttcctcctatccctcctgtctcgcattcgtagggacgggatcaagcttcgaacgtctaccgtggccgggngtacgcgaggtctaacttaacgttatttacgttacgcgttaggtactcgatcgagtacgtacgtaccggaaagggttacctttaccggagtcccttccggattataccgtttgcgtcttacggtacctacgttacccgttattaccgaactaacgggtccggggttaaccccggtcttttaacccggttgggtttacccggttaaggtccggggttacggggtacgggtacttaaacggggttaccggtaagggacgtttaaacccggtttcgtttacctaaccgttcccttaacggtactacgtacgtaacccggtgacccgttacgggactcccggtaagtaccggtttaagaacgtttacggttacttaccggtaactttaacgttttaccgtaaggtttaaccgaacgtttaaaacgtttcccttaaaccgttccccgttaccccgtaaccttaaccggttccctaaaccggtcccggtaacggaaacccggttcgaccggtaacccggagttaaaacccgtacgtaaccgttacggttccgg

SEQ ID NO: 56619 - DNA, 770 bp, Homo sapiens
  misc_feature: GYAE6OF01BF373.29.87.H10.1.454.CMB.1.raw
  modified_base (524)..(524): a, c, t, g, unknown or other
  misc_feature (524)..(524): n is a, c, g, or t
  modified_base (726)..(726): a, c, t, g, unknown or other
  misc_feature (726)..(726): n is a, c, g, or t
tcagatagagtactcacgaccggtgctcgatttagcagtactgcgttgggtttgggggcagaagtctctctcagtccagacacagcatggacatggacgggcccccgctcagcctccgtgggactcctgctgctctggctcccagactacagatgtgacactcagatcgacccagtcctaccacttccctccgtgtctcgctattcgtggtagggaacacgaggtacgtaccaacggttccgacggttgggccggggtagtacggacgacggtaactaattaaacgttaatttattacggcgtagtactacgaccgtcgacacgtaacgttaccggaacgggttaacttccgtacgtccttcgtagtacgttacttcgtaccgtcgacgttactaccttccttacgttacgaccttacgggtcgaccggttccctagttaccggttcgtacgtaggggtcggtaggtaggttacgttacgggtagtacgttacgtccgttaaccgtcctaactaccctagtacncgtaacggactaccgtccgtacggacgtaccgtaacgtaggtaacttacggttcgttaaaccgtacgtttaacttaaccgttaacggttaaccttaaacgtaaccgtttcctaaccggtttaccacccgttaacccttcccgggtaaccctaaccggggtttaaccccgggaacgttaaacccggtaacggttaaacccggnggtttaaacccgaaacggtttaaccgtaaacgtcggttaccggg

SEQ ID NO: 56620 - DNA, 729 bp, Homo sapiens
  misc_feature: GYAE6OF01BLHVE.29.87.H10.1.454.CMB.1.raw
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
tcagatagagtactcacgaccggtgctcgatttagcagtactgcgttgggtttgggggcagaagtctctctcagtccagacacagcatggacatgagggccccccgctcagctcctgggactcctgctgctctggctcccagataccagatgtgacatccagatcgacccagtcctccactccctccctgtctgcatcgtggtggganacagtacgtaccaacgtctacgttcggcccgggngtacgtcgacggactaattaaactaatttatttagccgtaggtatcgagcacgctactacgaagggtaaacttaccgtaagtccttccgtagtacttacgttacgtcgcctagtacctacttacccgttacgtttacgaactaacgttaccggtaccggtaccctacttccgttcggttacgtaggtcgggtcggtaggtagtacggtgggaacgtagtacgttactacgttacctacctacctagtccgtacgacgtccggtcctacgaccgtacgtacgttacggtaagttacggttgttaaccgtaacgttttaacgtttaacgttacgttaaacgttaacgtaaaagttccttacccgttaacccgtttcccaaccccgttacgttacccgttaaccccgttacccgggaccggtaaaccggtacctaaccgggtaccggttaaacggtaaaccgttaaacggttaaacccgtcggttacggg

SEQ ID NO: 56621 - DNA, 943 bp, Homo sapiens
  misc_feature: GYAE6OF01BZUJT.29.87.H10.1.454.CMB.1.raw
  modified_base (329)..(329): a, c, t, g, unknown or other
  misc_feature (329)..(329): n is a, c, g, or t
tcagatagagtactcacgaccggtgctcgatttagcagtactgcgttgggtttgggggcagaagtctctctcagtccagacacagcatggacatgacgggccccccgctcagccttccgtgggacctcctgctgctcgtggcctcccagactacagatgtagacatccgagactcgacccagtcctacctactccctccctgtctgactattcgtgggaggacacgtagacgtacaaccgtctacgttacgggccgggacgtacggtacggacggaacttaacgttaaacgttaagttttacgttaacggcgtttaggtaactcggacncgaacggtctaaccgtaccggtaaagggttaaccttaccgaacggtcctacgtacgtattcgtagcgtactacggctacgttaccttacttacggaacttacgtccgggaccgttaccccttcgttcggttcccggtagggtacggtttacgggtacggtaagggttacgttaagggttaccgggaacggttacgttaacccggtttctaacccgtttaaccgacccgttaactaccggtaccggtaaaccgaccggtacccggtacccgtaaccgtccgtaaccggtaaaccggtttagggtaaaccgtttacgggttaaccgtttaacccgtaacgttttaaacggttttaacccttaacgggtttaaacgtttaaacccggtaaactttttaacccgtttaacccccgtttacgggtttaaccccccccgttaacgttaaccccgggttaacccccgttttaaacccccggggggtaaccggtttaaaaccccggggaaccccgggtttaaaacccgggaacccggtttaaaccgggtttaaacgggggtttaaaaaccccgttttaaacccgggttaaaaacccgggtttaaccggttaaccccgggggg

SEQ ID NO: 56622 - DNA, 755 bp, Homo sapiens
  misc_feature: GYAE6OF01DGFHR.29.87.H10.1.454.CMB.1.raw
  modified_base (163)..(163): a, c, t, g, unknown or other
  misc_feature (163)..(163): n is a, c, g, or t
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
  modified_base (707)..(707): a, c, t, g, unknown or other
  misc_feature (707)..(707): n is a, c, g, or t
  modified_base (742)..(742): a, c, t, g, unknown or other
  misc_feature (742)..(742): n is a, c, g, or t
tcagatagagtactcacgaccggtgctcgatttagcagtactgcggttggggtttgggggcagaagtctctctcagtccagacacagcatggacatggacgggccccccgctcagcctccgtggggactccgtgctgctctcggcctcccagactaccgagtntgtgacatccagatcgaccctatcctccacttccctcctagtccgtgctagtcgngggtagggagacctaggacgtacgtaccgttntacgggttcggcccgggtagtaaggtacgtaaggttgttacgtttacccgttacttaacggttacggccgttacggttacaccgaagtaaccccgaaacgggaaaaccggtaccggggaaaccctacccggtagttacccttaacgtttaccgttccgtacggtttcctctacggttacggtcaaccggtagggaaccgtcgtacccggttatacggtcgttacggtacgacggtcgtaggtaggtcggttagtcgggtaacggcgttaagttcgtacgttactacctacgaaccgttaacgacctaacgtaccccgttagtacgacttacgtaagtaacgtttacgtacctttaagtaccttagttagtacggtagaacggtcgtagttaaccctcggttaccccttcgtacccggtaagggtaccgggccgggttacgacgggtagtaacccggngtaaacgaacggtgtacggtccgagtaccgtaccncgttctcgttacc

SEQ ID NO: 56623 - DNA, 923 bp, Homo sapiens
  misc_feature: GYAE6OF01BOJU4.29.87.H10.1.454.CMB.1.raw
  modified_base (686)..(686): a, c, t, g, unknown or other
  misc_feature (686)..(686): n is a, c, g, or t
tcagatagagtactcacgaccggtgctcgatttagcagtactgcgttgggtttgggggcagaagtctctctcagtccagacacagcatggacatggacgggcccccgctcacgcctccgtgggacctcctgctgctcgtcggcctcccagtactaccagtagtgtacgaccactaccgaagtacgttaccgaacccgtacgttaccctaccctaccttccccttccccgttcgttacctcggtacctacgttcggttagggtacgggggtaacgtaaccgtaagtaccggttaaccgtaaccggttccgtaccgggttccggggacccggggacggtacggtacgggtacgggtaaccttaaactttaacgttaaatttacggttaccgtccgttaaggttaccgtacgtacgacgtacgtaccgtaaccggttaaccggtaaacgggttaaaccgtttacccgttaacggttcccgtttaaccgtacggttacctttacggttacgtacgtcggttacgtaacccttaccctttaccgttaccgtttaccggaacgttaaccggtaccgggttaacccgggtccttaccggtttccggttacggttacggtacggggtcggtacgggtacggtaaggtagggtacggtacgtacgttaccgtaccgtactacgtaccaccgtacnccgtacgtacgtaccgtacggtcgaccgtacgtacgtaacgtacgttacgttacgttaacgttaacctttacgttaaacgtttacgttaaactaacgttaacgttacccgtttaccgttacccgttaccccgtaaccccgttacgtaccccgtaccggttaacccggaacggtaaccggtacgtaacccggtagggtaaaccgttaacggttaaccttaaccgggtcgttaaccggg

SEQ ID NO: 56624 - DNA, 480 bp, Homo sapiens
  misc_feature: GYAE6OF02FHH3P.29.87.H10.1.454.CMB.1.raw
  modified_base (423)..(423): a, c, t, g, unknown or other
  misc_feature (423)..(423): n is a, c, g, or t
  modified_base (466)..(466): a, c, t, g, unknown or other
  misc_feature (466)..(466): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcaggggtcccatctcggttcagtggcggtggatatgggacagagttcactctcaccatcagcagcctgcagcctgaagatgtgcaacttattactgtcaaaagtntcactttgccccatccaccttcggcctaaggacacgactgganacttaacgatacgg

SEQ ID NO: 56625 - DNA, 481 bp, Homo sapiens
  misc_feature: GYAE6OF02I5W2E.29.87.H10.1.454.CMB.1.raw
tcagatagagtactcacgaccggtgctcgatttagcagtactgcgttgggtttggggcagaagtctctctcagtccagacacagcatggacatgagggccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatcactttgcaatcagggtccatctcggttcagtggcggtggatatgggacagagttcactctcaccatcagcagcctgcagcctgaagatgttgcaactttattactgtacaaagttatctactttgccccatctaccttcggccaacgggacacgactaggagacttaacgactagg

SEQ ID NO: 56626 - DNA, 481 bp, Homo sapiens
  misc_feature: GYAE6OF02F4X4T.29.87.H10.1.454.CMB.1.raw
  modified_base (468)..(468): a, c, t, g, unknown or other
  misc_feature (468)..(468): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaaacgtcacttgccgggcgagtcaggcattaacaattatttagcctggtatcagcagcatccagggaaagttcctaagctcctgatctatgctgcatccactttgcaatcaggggtccatctcggttcagtggcggtggatatgggacagagttcactctcaccatcagcagcctgcagcctgaagatgttgcaacttattactgtacaaaagtatacactttgccccatccaccttcggaccaaggacacgactgganattaacgatacgg

SEQ ID NO: 56627 - DNA, 490 bp, Homo sapiens
  misc_feature: GYAE6OF02JA5ST.29.87.H10.1.454.CMB.1.raw
  modified_base (391)..(391): a, c, t, g, unknown or other
  misc_feature (391)..(391): n is a, c, g, or t
tcagatagagtactcacgaccggtgctcgatttagcagtactgcgttgggtttgggggcagaagtctctctcagtccagacacagcatggacatgagggccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccaggaagttcctaagctcctgatctatgctgcatcactttgcaatcagggtccatctcggttcagtggcggtggatatgggacagagttcactctcaccatcagcagcctgcagcctgaagntgtgacacttattactgtcaactactttaacattacctcataacgccgttacggacctaagggaccctaggtacggaaaccaagacgaaccgtgtacgg

SEQ ID NO: 56628 - DNA, 506 bp, Homo sapiens
  misc_feature: GYAE6OF02I1B43.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcagtcaggcattaacaattatttagcctggtatcagcagcatccagggaaagttcctaagctcctgatctatgctgcatccactttgcaatcaggggtccatctcggttcagtggcggtggatatggggacagagttcactctcaccatcagtcagcctgcagccctgaagtatgttagctaacttattactgttacaaaagttatactactttacgcccctatcctacccttcggaccaacgggacaaccgacgtggaagtaacgttaaacgaattacgg

SEQ ID NO: 56629 - DNA, 486 bp, Homo sapiens
  misc_feature: GYAE6OF02GP5QH.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcaggggtcccatctcggttcagtggcggtggatatgggacagagttcactctcaccatcagcagcctgcagcctgaacgatgttgctaacttattactgtacaaaagtatcactttcgcccctatccaccttcggaccaaggaccacgactggagattaacgatacgg

SEQ ID NO: 56630 - DNA, 484 bp, Homo sapiens
  misc_feature: GYAE6OF02I7D3Y.29.87.H10.1.454.CMB.1.raw
  modified_base (435)..(435): a, c, t, g, unknown or other
  misc_feature (435)..(435): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcaggggtccatctcgttcagtggcggtggatagtgggacagtagtcactctcaccatcagcagctgcagcctgaagatgtagctaactttattactgtacaaagttatctactttcnccccatccaccttcggaccgacggacacgactggagattaacgatacgg

SEQ ID NO: 56631 - DNA, 476 bp, Homo sapiens
  misc_feature: GYAE6OF02FSLNE.29.87.H10.1.454.CMB.1.raw
tcagatagagtactcacgaccggtgctcgatttagcagtactgcgttgggtttgggcagaagtctctctcagtccagacacagcatggacatgagggccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcaggggtcccatctcggttcagtggcggtggatatgggacagagttcactctcaccatcagcagcctgcagcctgaagatgttgcaacttattactgtcaaaagtatacactttgccccatccaccttcggccaagggacacgactggagattaacgatgg

SEQ ID NO: 56632 - DNA, 511 bp, Homo sapiens
  misc_feature: GYAE6OF02F9LI5.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggggcattaacaattattagcctggtatcagcagcatccagggaaagcccctaaatcctgatctacgctgcatccactttgcacagtcggggtccctctaggttcagcgcagcggatcgtgggacagatttcgactctcaccatcagcagcctgcagcctgaagatgttgctaacttattactgtacaacgtagtcttagtacgtaaccctccgtactacgttttcggaccgtacggggaccctaaggtggacgtataccgaaacgacgtagtggtacg

SEQ ID NO: 56633 - DNA, 515 bp, Homo sapiens
  misc_feature: GYAE6OF02JNOMD.29.87.H10.1.454.CMB.1.raw
  modified_base (423)..(423): a, c, t, g, unknown or other
  misc_feature (423)..(423): n is a, c, g, or t
tcagatagagtactcacgaccggtgctcgatttagcagtactgcgttggatttggggcagaagtctctctcagtccagacacagcatggacatgagggccccgctcagctcctgggactcctgctgctctggctcccagataccagatgtgacatccagatgacccagtctccatcctcctgtctgcatctgtgggagacagagtcaacgtcacttgccgggcagtcaggcattaacaattattagcctggtatcagcagcatccaggaaagttcctaagctcctgatctatgctgcatccactttgcaatcagggtcccatctcgttcagtggcggtggatatgggacagagttcactctcaccatcagcagcctgcagcctgaacgatgttgctaaactttattaacctgtactaaaagtntactactttgaccccctagttacctacccgttacggacctaaacggggtaaccctacggtaccttagggaacgtaacgttaaaacgtaaccg

SEQ ID NO: 56634 - DNA, 505 bp, Homo sapiens
  misc_feature: GYAE6OF02J0HP6.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccaggaagttcctaagctcctgatctatgctgcatccactttgcaatcagggtcccatctcggttcagtgcggtggatagtgggacagagttcacgtctcacatcagcagcctgcacgctgaagattgttgactaacttattacttgtactaaaagtatactactttcaccccgtattccaccttcggacccaacgggaccaccgtactacggaagaacgttaaccgacttacggg

SEQ ID NO: 56635 - DNA, 516 bp, Homo sapiens
  misc_feature: GYAE6OF02HTM0F.29.87.H10.1.454.CMB.1.raw
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggnagtcaggcattaacaaattatttagcctggtatcagcagcatccagggaaagttcctaagctcctgatctatgctgcatccactttgcaatcagggtcccatctcggttcagtggcggtgagtagtgggacagagttcaactctcaccatcagcagcctgcagctgagatgttgactaacttattactgtcaacagtacttagtacgttaaccctaccgttactaaccgttttcggaccgtaacggggaccgtaacgggtggagtaacgtactaaaccgtaacttacggg

SEQ ID NO: 56636 - DNA, 502 bp, Homo sapiens
  misc_feature: GYAE6OF02HYVZT.29.87.H10.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagatagagtactcacgaccggtgctcgatttagcagtactgcgttgggtttgggggcagaagtctctctcagtccagacacagcatggacatgagggccccgctcagctcctgggactcctgctgctctggctcccagataccagatgtgacatccagatgacccagtctccatcctccctgtctgcatctgtggganacagagtcaacgtcacttgccgggngagtcaggcattaacaattattagcctggtatcagcagcatccagggaaagttcctaagctcctgatctatgctgcatccactttgcaatcaggggtcccatctcggttcagtggcggtggatatgggacagagttcactctcaccatcagcagcctgcagcctgaagatgttgctaacttattactgttacaaaagtattacacttttcgacccccatcctaaccttcggacctaacgggaccacggacttcggaagaacttaacggaacttacgg

SEQ ID NO: 56637 - DNA, 482 bp, Homo sapiens
  misc_feature: GYAE6OF02GEEGW.29.87.H10.1.454.CMB.1.raw
  modified_base (200)..(200): a, c, t, g, unknown or other
  misc_feature (200)..(200): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctgtggganacagagtcaacgtcacttgccgggcgagtcaggcattaacaattatttagcctggtatcagcagcatccagggaaagttcctaagctcctgatctatgctgcatccatttgcaatcaggggtcccatctcggttcagtggcggtggatatggggacaggagttcactctcaccatcagcagcctgcagcctgaagatgttgctaacttaattacttgtacaaaagtatacactttgaccccatcaccttcgccaaggacacgactggagattaacgatacgg

SEQ ID NO: 56638 - DNA, 514 bp, Homo sapiens
  misc_feature: GYAE6OF02IWK2X.29.87.H10.1.454.CMB.1.raw
  modified_base (201)..(201): a, c, t, g, unknown or other
  misc_feature (201)..(201): n is a, c, g, or t
  modified_base (400)..(400): a, c, t, g, unknown or other
  misc_feature (400)..(400): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcgagggcattaacaattatttagcctggtatcagcagcatccagggaaagttcctaagctcctgatctatgctgcatccactttgcaatcagggtcccatctcggttcagtggcggtggatagtgggacagagttcactctcaccatcagcagcctgcacgcctagaagntgttgactaacttattactgtaacaaagttactactactttcgacccctagtcctaccgttcggaccgaacgggacctacggacgtaggtaacgtaacttaaccgtacgtacgg

SEQ ID NO: 56639 - DNA, 484 bp, Homo sapiens
  misc_feature: GYAE6OF02HPKEB.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcagtcaggcattaacaattatttagcctggtatcagcagcatccagggaaattcctaagctcctgatctatgctgcatccactttgcaatcagggtcccatctcggttcagtggcggtggatagtgggacagagttcactctcaccatcagcagcctgcagcctgaagatgttgacaactttatacttgtacaaagtatcactttcgcccctatccaccttcggccgaaggacacgacgtaggagtacttaacgatcgg

SEQ ID NO: 56640 - DNA, 488 bp, Homo sapiens
  misc_feature: GYAE6OF02GTGGG.29.87.H10.1.454.CMB.1.raw
  modified_base (401)..(401): a, c, t, g, unknown or other
  misc_feature (401)..(401): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattatttagcctggtatcagcagcatccagggaaagttcctaaagctcctgatctatgctgcatccactttgcaatcaggggtccatctcggttcagtggcggtggatatggggacagagttcactctcaccatcagcagcctgcagcctgagatgttncaacttattactgtacaaaagttatcactttgcccctagtcaccttcggaccaacgggacacgacgtggaagattaacgaattacgg

SEQ ID NO: 56641 - DNA, 482 bp, Homo sapiens
  misc_feature: GYAE6OF02JGIGE.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggnagtcaggcattaacaattattagcctggtatcagcagcatccagggaagttcctaagctcctgatctatgctgcatccacttgcaatcagggtccatctcggtcagtggcggtggatatgggacagagttcactctcacatcagcagctgcngcctgaagntgttagcaacttattactgtactaaaagtatactactttcgcccagttccaccttcggccgaaggaccacgactcggatacttaacgacgtacgg

SEQ ID NO: 56642 - DNA, 552 bp, Homo sapiens
  misc_feature: GYAE6OF02IB0R2.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggngagtcaggcattaacaattatttagcctggtatcagcagcatccagggaaagttcctaagctcctgatctatgctgcatccactttgcaatcgagggtcccatctcggttcagtggcggtggatagtgggacagagttcactctcaccatcagcagcctgcgacgccgtagaagtagttggttagaccgtaaactttattacttagttactaaaaagttacttacctaccttttcgaccccctaatccctaacccgttccggacccgtaaacgggtacctaccggtaacgttacgggaacgtaactttaaaccggaacttaacggg

SEQ ID NO: 56643 - DNA, 499 bp, Homo sapiens
  misc_feature: GYAE6OF02HEHEV.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (357)..(357): a, c, t, g, unknown or other
  misc_feature (357)..(357): n is a, c, g, or t
  modified_base (395)..(395): a, c, t, g, unknown or other
  misc_feature (395)..(395): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggngagtcagggcattaacaattatttagcctggtatcagcagcatccagggaaagttcctaagctcctgatctatgctgcatccactttgcaatcagggtccatctcggttcagtggcggtggatagtggganagagttcactctcacatcagcagcctgcagcctgaagntgttgactaacttattactgtacaaagtactactactttcgacccctactctaccttcggcctaacggacaaccgacgtaggtaacgaattaacgaacttacgg

SEQ ID NO: 56644 - DNA, 510 bp, Homo sapiens
  misc_feature: GYAE6OF02J1TOH.29.87.H10.1.454.CMB.1.raw
  modified_base (200)..(200): a, c, t, g, unknown or other
  misc_feature (200)..(200): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctcatcctccctgtctgcatctgtggganacagagtcaacgtcacttgccgggcgagtcaggcattaacaattattagcctggtatcagcagcatccagggaagttcctaagctcctgatctatgctgcatcctactttgcaatcagggtcccatctcgttcagtggcggtgatagtgggacagtagttcactcgtcacactcgagcacgtctgcacgcctgaacgtatgttagtactaacttattactagtactaaagtatactacttacgccctacgtcctacccgttcgacccgaacggactacgacgtacggaacgtaagtaacgtacgttacgg

SEQ ID NO: 56645 - DNA, 507 bp, Homo sapiens
  misc_feature: GYAE6OF02JCVO8.29.87.H10.1.454.CMB.1.raw
  modified_base (106)..(106): a, c, t, g, unknown or other
  misc_feature (106)..(106): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctccctgtctgcatctgtggganacagagtcaacgtcacttggccgggngtttagcagggcagttaacaattatttaagcctggtatcagcagcatccaggaaagttcctaagctcctgatctaatgctgcatccactttgcaatcagggtccatctcggttcagtggcggtggatgtgggacagtgtcactctcaccatcagcagctgcagctgaagatgttgcgtaacttattactgtacaaagtactactactttcgacccctatacctaccttccggacctaacgggacctacggtactaggacgtaacgttaacgacttacggg

SEQ ID NO: 56646 - DNA, 521 bp, Homo sapiens
  misc_feature: GYAE6OF02FZSIN.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcaggggtcccatctcggttcagtggcggtggatatgggacagagttcactctcaccatcagcagcctgcagcctgaacgatgttgacaacttattactagtacaaaagttactactactttcgacccctatcctacccgttcggacccgtaacgggacctaccggaaccttagggaacgtaacgtttaaaccggaattacggg

SEQ ID NO: 56647 - DNA, 600 bp, Homo sapiens
  misc_feature: GYAE6OF02JLATW.29.87.H10.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcgagggcattaacaattattagccttaggnttcgagcagcagtacaggtaacggtacgtaactcgacgtctagtactactgcgtcgtctatcctacttcgtactagtactaggtccgacgttactggtcgtcgtggcggtggtacgtagtaggacgagaagttcgtacgtactcgtaccactactacgcacgcgtacgactacgacctacgtagacgtagttcgtacgtaacgttacttaacgttagtaacgttaaacggtaacttacgtacctttacgtaccctaccgtaccttaaccgttaccggtacccgaacggtaaccgtaccgtaacgtacgtaacggtacgttaaacggtaaccgttaacgg

SEQ ID NO: 56648 - DNA, 486 bp, Homo sapiens
  misc_feature: GYAE6OF02HQ7HL.29.87.H10.1.454.CMB.1.raw
  modified_base (387)..(387): a, c, t, g, unknown or other
  misc_feature (387)..(387): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcagtcaggcattaacaattatttagcctggtatcagcagcatccagggaaagttcctaagctcctgatctatgctgcatccactttgcaatcaggggtcccatctcggttcagtggcggtggatagtgggacagagttcactctcaccatcagcagcctgcngcctgaagatgttgactaacttattactgtacaaatatctacttcgaccccatcaccttcggccaaggacacgacgtcggagtaacttaacgaactcgg

SEQ ID NO: 56649 - DNA, 496 bp, Homo sapiens
  misc_feature: GYAE6OF02F6Z11.29.87.H10.1.454.CMB.1.raw
  modified_base (330)..(330): a, c, t, g, unknown or other
  misc_feature (330)..(330): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagttgacccagtctccatcttccctgtctgcatctgtaggagacagagtctccatcacttgccgggccagtcagggcattagaagttatttagcctggtttcagcagaaaccaggaaagcccctaaactcctgatctacgctgcatccactttgcacagtggggtcccgtntaggttcagcggcagcggatctgggacagatttcactctcaccatcagcagcctgcagcctgaagatgttgcaacttattactgtacaacagctttaagtagtaaccctccgtactacttttggccgaggggaccaaggtggagatcaacgacgtgtggctgcacc

SEQ ID NO: 56650 - DNA, 490 bp, Homo sapiens
  misc_feature: GYAE6OF02JWS7S.29.87.H10.1.454.CMB.1.raw
  modified_base (201)..(201): a, c, t, g, unknown or other
  misc_feature (201)..(201): n is a, c, g, or t
  modified_base (428)..(428): a, c, t, g, unknown or other
  misc_feature (428)..(428): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattattagcctggtatcagcagcatccagggaaattcctaagctcctgatctatgctgcatccactttgcaatcagggtcccatcgtcgtcagtggcggtggatagtggggacaggagttcacgtctcactatcagcagcctgcagcctagaagattgtcgactaacttagtactgtacaaagtntactacttcgaccctatcctacttcggaccaaggacacgactaggaatacgtaacgatacgg

SEQ ID NO: 56651 - DNA, 531 bp, Homo sapiens
  misc_feature: GYAE6OF02JIGDQ.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcaggcattaacaattatttagcctggtatcagcagcatccagggaagttcctaagctcctgatctatgctgcatccactttgcaatcaggggtcccatctcggttcagtggcggtggatatggggacagagttcactctacaccatccagcagcctgacacgcctagaacgtatgttgactaacgttattaacgttgtacgtaaaagttatactaactttcgacccctattcccaaccgtttcggaccctaacgggaccaccggtaccgttacggtacgaagtttaaccgaacgttacggg

SEQ ID NO: 56652 - DNA, 486 bp, Homo sapiens
  misc_feature: GYAE6OF02G583M.29.87.H10.1.454.CMB.1.raw
  modified_base (394)..(394): a, c, t, g, unknown or other
  misc_feature (394)..(394): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattattagcctggtatcagcagcatccagggaaagttcctaagctcctgatctatgctgcatccactttgcaatcaggggtcccatctcggttcagtggcggtgatatgggacagagttcactctcaccatcagcagcctgcagcctgaagntgttgacaacttatactgtacaaagtatactacttcgcccctatcctaccttcggaccaacgggacacgactggagacgttaacgacttagg

SEQ ID NO: 56653 - DNA, 487 bp, Homo sapiens
  misc_feature: GYAE6OF02JHXD2.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (473)..(473): a, c, t, g, unknown or other
  misc_feature (473)..(473): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggngagtcagggcattaacaattatttagcctggtatcagcagcatccagggaaagttcctaagctcctgatctatgctgcatccactttgcaatcaggggtcccatctcggttcagtggcggtggatatgggacagagttcactctcaccatcagcagcctgcagcctgaagatgttgctaacttattactgtacaaaagtatctactttcgcccctatccaccttcggaccaagggacacgactgganattaacgactacgg

SEQ ID NO: 56654 - DNA, 512 bp, Homo sapiens
  misc_feature: GYAE6OF02I5QHF.29.87.H10.1.454.CMB.1.raw
  modified_base (201)..(201): a, c, t, g, unknown or other
  misc_feature (201)..(201): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcaggggcattaacaattatttagcctggtatcagcagcatccaagggaaagttcctaagctcctgatctatgctgcatccactttgctaatcacggggtcccatctcggttcagtggcggtgagtagtgggacagngttcactctacnccatnagcagcctgcagcctgaagnttgttgactaatttatacttgttaacaaagttatctactttccgacccctactcctaccgttcgaccgaacggaccacgacgtaggtaacgtaacgttaacgattacgg

SEQ ID NO: 56655 - DNA, 511 bp, Homo sapiens
  misc_feature: GYAE6OF02JELV3.29.87.H10.1.454.CMB.1.raw
  modified_base (427)..(427): a, c, t, g, unknown or other
  misc_feature (427)..(427): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcagggtccatctggtcagtggcggtgatatgggacagacgttcactctcacgatcagcagcctgcagcctgaagatgttgactaactttattactgttacaaaacgttntactacgtttcgacccctagtcctaccgtttcggacccgaaggtaccaccgtacgtacggacgtaacttaaaccggacttacgg

SEQ ID NO: 56656 - DNA, 519 bp, Homo sapiens
  misc_feature: GYAE6OF02H4AK4.29.87.H10.1.454.CMB.1.raw
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggngagtcaggcattaacaattattagcctggtatcagcagcatcccaagggaaagttcctaagctcctgatctatgctgcatcctactttgctaatcgagggtcccatctcggttcagtggcggtggatagtgggacaggtagttcactctcaccatcagcagcctgcagctagaagattgtagctaacttattactagtactaaagtatactacttcgccccctatcctaccgttcggacccgtaacgggaccacggtaacgtacggtaacgtaacgttaaccgaacttacggg

SEQ ID NO: 56657 - DNA, 499 bp, Homo sapiens
  misc_feature: GYAE6OF02G4HGW.29.87.H10.1.454.CMB.1.raw
  modified_base (386)..(386): a, c, t, g, unknown or other
  misc_feature (386)..(386): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattattagcctggtatcagcagcatccagggaagttcctaagctcctgatctatgctgcatccactttgcaatcacgggtccatctcggttcagtggcggtggatagtgggacagagttcactctacaccatcagcagcctgcngcctagaactatgttcgactacttattactgtactaaagtatctacttcgaccctatctaccttacggacccgtaaggaccacgtaccgtaggagtaacgttaacgactacgg

SEQ ID NO: 56658 - DNA, 494 bp, Homo sapiens
  misc_feature: GYAE6OF02IBPKW.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcaggggtcccatctcggttcagtggcgggtggatatgggacagagttcactctcaccatcagcagcctgcagcctgaagatgttgctaacttattactgtacaaagtatcacttttcgacccctatcctaccttcggacccaacgggacacgactggaagaattaaccgattacgg

SEQ ID NO: 56659 - DNA, 512 bp, Homo sapiens
  misc_feature: GYAE6OF02IGRC9.29.87.H10.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (346)..(346): a, c, t, g, unknown or other
  misc_feature (346)..(346): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggngagtcaggcattaacaattatttagcctggtatcagcagcatccaaggaaagttcctaagctcctgatctatgctgcatccatttgacatcgagggtccatctcgtcagtgcggtgatntggacagatcactctcaccatcagcacgcctagcacgcctagaagtattgttacgactaaactttataacttagtaacgtaaaagtactactacctttacgacccctagtccctaccgttccggaacgaacggacacgacgtcggaagtaacttaacgacttacgg

SEQ ID NO: 56660 - DNA, 520 bp, Homo sapiens
  misc_feature: GYAE6OF02HYPTT.29.87.H10.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagatagagtactcacgaccggtgctcgatttagcagtactgcgttgggtttgggggcagaagtctctctcagtccagacacagcatggacatgagggccccccgctcagctcctgggactcctgctgctctggctcccatataccagatgtgacatccagatgacccagtctccatcctccctgtctgcatctgtggganacagagtcaacgtcacttggccgggngagtcagggcattaacaattattagcctggtatcagcagcatccgagggaaagttccaagctcctgacttctatgctgcatccacttttgaccaattccgaggggtcccattcgtacggttcagtggcggtgagtagtgggacagtagttcactctcacctatcgagcacgcctgcacgcgtagagatgtgactaacttatactagttacaaattctactcttacgaccctatcctaccgttacggaccgtacggaccacgaccgtaggaacgtaacgttaaccgagtacgg

SEQ ID NO: 56661 - DNA, 484 bp, Homo sapiens
  misc_feature: GYAE6OF02IQ10N.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaagttcctaagctcctgatctatgctgcatccatttgcaatcaggggtccatctcgttcagtggcggtggatagtgggacagtagttcactctcaccatcagcagcctgcagcctgaagatgttagactaacttattactgtacaaaagtatctactttcgcccatcctaccttcggaccaaggacacgactgacgaattaacgatcgg

SEQ ID NO: 56662 - DNA, 479 bp, Homo sapiens
  misc_feature: GYAE6OF02HN59R.29.87.H10.1.454.CMB.1.raw
tcagatagagtactcacgaccggtgctcgatttagcagtactgcgttgggtttgggggcagaagtctctctcagtccagacacagcatggacatgagggccccgctcagctcctgggactcctgctgctctggctcccagataccagatgtgacatccagatgacccagtctccatcctccctgtctgcatctgtgggagacagagtcaacgtcacttgccgggcagtcagggcattaacaattatttagcctggtatcagcagcatccagggaaagttcctaagctcctgatctatgctgcatccactttgcaatcaggggtccatctcggttcagtggcggtggatatgggacagagttcactctcaccatcagcagcctgcagcctgaagatgttgcaacttattactgtacaaaagtatacactttgcccctatcaccttcggccaagggacacgactggagattaacgatacgg

SEQ ID NO: 56663 - DNA, 495 bp, Homo sapiens
  misc_feature: GYAE6OF02HV5NK.29.87.H10.1.454.CMB.1.raw
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattattagcctggtatcagcagcatccagggaaagttcctaagctcctgatctatgctgcatccactttgctaatcaggggtcccatctcggttcagtggcggtggatagtgggacaggtagttcactctcacctatcagcagcctgcagctgagntgtnctaacttatactgtacaaagtntactactttcgcccctaatcctaccttcggaccaagggaccaacgacgtaggagaacttaacgactacgg

SEQ ID NO: 56664 - DNA, 533 bp, Homo sapiens
  misc_feature: GYAE6OF02HI1IU.29.87.H10.1.454.CMB.1.raw
  modified_base (107)..(107): a, c, t, g, unknown or other
  misc_feature (107)..(107): n is a, c, g, or t
  modified_base (174)..(174): a, c, t, g, unknown or other
  misc_feature (174)..(174): n is a, c, g, or t
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
tcagatagagtactcacgaccggtgctcgatttagcagtactgcgttgggtttgggggcagaagtctctctcagtccagacacagcatggacatgacgggcccccgntcagctcctgggactcctgctgctctggctcccagataccagatgtgacatccagatgacccagtcnccatcctccctgtctgcatctggtggganacaggagtcaaacgtcacttggcccgggnagtcgaggcattaacaattattagcctggtatcagcagcatccgaagggaaattcctaaagcctcctgattctatgcttgctatccactttgacaatcgagggtcccatctcggttacaggtggcggtgatgtagggacaggtattcacgtctcgaccatcgagcacgcctgcgacgtctagaacgtatgttgactaacttattactgtaactaaagtctactacttcgaccctacgtcctaccgttcgaaccgaacggacctacggtacgtacgtaacggtaacgttaacgacgttacgg

SEQ ID NO: 56665 - DNA, 577 bp, Homo sapiens
  misc_feature: GYAE6OF02GB4EN.29.87.H10.1.454.CMB.1.raw
  modified_base (200)..(200): a, c, t, g, unknown or other
  misc_feature (200)..(200): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctgtggganacagagtcaacgtcacttgccgggcgagtcagggcattagaagttattagcctggttcagcagaaaccagggaaacgcccctaaactcctgatctacgctgcatccactttgcacaggtcggggtcccgtcgtaggttcagcggcaggcggatcgtggggacagtactttcactctcacatcagcacgcctgcacgcctagaagatgttcgactaactttattactgttacaactacgtacttaagtaaccgttaacccgttaccgttacgttaaccgttttcgggacccgtaacgggggtaacctaagggtacgggtaacggtaacgttaccgaaaacggtaacggttacggtacgggacgttacgacctaacccg

SEQ ID NO: 56666 - DNA, 535 bp, Homo sapiens
  misc_feature: GYAE6OF02GNGRO.29.87.H10.1.454.CMB.1.raw
  modified_base (209)..(209): a, c, t, g, unknown or other
  misc_feature (209)..(209): n is a, c, g, or t
  modified_base (407)..(407): a, c, t, g, unknown or other
  misc_feature (407)..(407): n is a, c, g, or t
tcagatagagtactcacgaccggtgctcgatttagcagtactgcgttgggtttgggggcagaaggtcttctctcagtccagacacagcatggacatagagggccccgctcagctcctgggactcctgcgtgctcctggctcccgagatacccagatgtgacatccagatcgacccagtctccatcctccctgtctgcactctgtgggancagatcaacgtcacttgccggcagtcaggcattaacaattagttagcctggtactcagccgaggcagtccagggaagttccaagctcctgatctatgactgtcatcactttgcaatcagggtccatctcgtcagtgcggtgactagtgggactagtacgttcactcgtcacactcagcagcctgacagcctagtaagnttgttgactaacgtttattaacttagtaactaaaagttgtactactttacgacccctagtcctaaccctttcggaccgtaacggtaccaacgtacgttacgggaataacgttaacggaacgtaacggg

SEQ ID NO: 56667 - DNA, 509 bp, Homo sapiens
  misc_feature: GYAE6OF02H3VS7.29.87.H10.1.454.CMB.1.raw
  modified_base (386)..(386): a, c, t, g, unknown or other
  misc_feature (386)..(386): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcagggtcccatctcgttcagtggcggtggatatgggacagagttcactctcaccatcagcagcctgcngcctgaagatgttgctaacttattactagtacaaaagttactctacttttcgacccctattcctaccgttccggacctaacgggaccaacggtaccgtaggacgtaacttaaacggattacgg

SEQ ID NO: 56668 - DNA, 522 bp, Homo sapiens
  misc_feature: GYAE6OF02IKC3G.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccaagggaagttcctaagctcctgatctatgctgcatccatttgactaatcgacgggtcctatctcggttcagtggcggtgatagtgggacagtagttcactctcaccatcagcagcctgcagctgaatatgttagactaacttattacgtagttactaaagtacttcgtactttccgaccccttatccctacccgttcggaccgtaacgggacccgacgtaccgtaggaacgtaacttaaccgtaagtacgg

SEQ ID NO: 56669 - DNA, 667 bp, Homo sapiens
  misc_feature: GYAE6OF02JWWM8.29.87.H10.1.454.CMB.1.raw
  modified_base (205)..(205): a, c, t, g, unknown or other
  misc_feature (205)..(205): n is a, c, g, or t
  modified_base (315)..(315): a, c, t, g, unknown or other
  misc_feature (315)..(315): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagataccagatgtgacatccagatgacccagtctccatccctccctgtcctgcattctgtggganacagagtcaacgtcacttggccgggcgagtccagggcagttaacaatttattagccttagggtatctagcagctaatcccgagggaaattccaagtctacctgatctatnactgcactcctacgtttcacaattcgacggggtccctatccttcggttcagttcggtcggtgtatagtaggacgtgtaggttactacgtcttaccacctacttacgagtaccaggcccttggaccgagtacccgtagaacggtaactttcggttacgacgttaaaccttttaagtttaaccgttacggttaaacctaaaacggtttaccttaccgttaaacccgtttcccgtaccccgttaactaaccccgttaacccgtttacccgggtaaccccgtaacggggtaaccctaaccgggtacgttaaccgggtaacgttaaacggttaacccgggtaaaccgtttaaccggg

SEQ ID NO: 56670 - DNA, 502 bp, Homo sapiens
  misc_feature: GYAE6OF02HR7X7.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggngagtcaggcattaacaattattagcctggtatcagcagcatccagggaaagttcctaagctcctgatctatgctgcatccactttgcaatcagggtccatctcgttcagtggcggtgatagtggganagtagttcactctcacatcagcagcctgcagctgaagntgtagactaacttattactgtaacaaagtntactacttcgacccctatctacccgttcggaccgaacgggacctacggacgtacggaacgtaacgttaaaccgagttacgg

SEQ ID NO: 56671 - DNA, 610 bp, Homo sapiens
  misc_feature: GYAE6OF02HUGMI.29.87.H10.1.454.CMB.1.raw
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
tcagatagagtactcacgaccggtgctcgatttagcagtactgcgttgggtttgggggtcagaagtcgtctcgtcaggtccagacacagcatggacatgagggcccccgctcagctcctgggactcctgctgctctggctcccagataccagatgtgacatccagatgacccagtctccatcctccctgtctgcatctgtgggagacagngtcaagtcacttgccgggnagcaggcattaacaattatttagctggtatcagcagcatccgaagggtaaacgttcctaagctcctgatctatgctgcatcctattgcaatcagggtccatctacgtcagtggcggtgagtagtggacaggtagttacactcgtacacctaatcaagcacggcctacgacgtacgccgtagaaagtgtagtttagaactaacgttttaactttaaccgtaggttaaacctaaaaacgttagttacccgttaaccggtttttacccgacccccttaacggttaccccttaacccgtttaccgggtaaccccgaaaggtaacccgtaaccggaaccggttaacgggtaaacggttaaactttaaaccgggtaacttaaccggg

SEQ ID NO: 56672 - DNA, 502 bp, Homo sapiens
  misc_feature: GYAE6OF02FT4X9.29.87.H10.1.454.CMB.1.raw
  modified_base (201)..(201): a, c, t, g, unknown or other
  misc_feature (201)..(201): n is a, c, g, or t
  modified_base (387)..(387): a, c, t, g, unknown or other
  misc_feature (387)..(387): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcagtcagggcattaacaattatttagcctggtatcagcagcatccagggaaagttcctaagctcctgatctatgctgcatccactttgcaatcaggggtcccatcttcggtcagtggcggtggatatgggacagagttcactctcaccatcagcagcctgcngcctgaagatgtgcatttatactgtacaaagtatactactttcgacccctagtcctaccgttaccggcctaagggaccgacgtacgtacggtaagtaacttaaaccggattacgg

SEQ ID NO: 56673 - DNA, 519 bp, Homo sapiens
  misc_feature: GYAE6OF02HDAUL.29.87.H10.1.454.CMB.1.raw
  modified_base (202)..(202): a, c, t, g, unknown or other
  misc_feature (202)..(202): n is a, c, g, or t
  modified_base (355)..(355): a, c, t, g, unknown or other
  misc_feature (355)..(355): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtggganacagagtcaacgtcacttgccgggcagtcaggcattaacaattattagcctggtatcagcagcatccagggaaagttcctaagctcctgatctatgctgcatcctacttgcaatcagggtccatctcggttcagtggcggtggatagtggganagagttcactctcaccatcagcagcctgcacgctagaagatgttagactaacttattactagttaactaaaagtactactacctttcgtacccctacgtacctacccgttacgaccgaacggtacacggtacgtaggtaacgtaacgttaaccggaacttacgg

SEQ ID NO: 56674 - DNA, 662 bp, Homo sapiens
  misc_feature: GYAE6OF02I7NAM.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtggganacagagtcaacgtcacgttggccgggcgagtcgaggcattaacaattattagcctggtatcagcagcagtaccgaagggtaacgttccgaagtcctcctagacttctatcgctcgctacttcctactttcgactaacgtcgacgggtccctagttccgtcggttcgtaggtcgggtcggtaggtagttacggtacggggtactaggtacgttctactcctaccacctactcgacgtccacgtcctcgaccgaccgtaccgtaggtaacgttgttacgttacgtaaccttaaacgtttaacgtttaccgtaagttaaacctaaaacgttccttaacccgttaccgtttacccgacccccttaacgttacccgtaacccggttaccggaacccgtaaccgggtaccgtaacggtaccggttaagggtaaccgttaaacggttaaacccggtacgttaacggg

SEQ ID NO: 56675 - DNA, 505 bp, Homo sapiens
  misc_feature: GYAE6OF02F6XMS.29.87.H10.1.454.CMB.1.raw
  modified_base (201)..(201): a, c, t, g, unknown or other
  misc_feature (201)..(201): n is a, c, g, or t
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcaggcattaacaattatttagcctggtatcagcagcatccagggaaagttcctaagctcctgatctatgctgcatccactttgcaatcagggtcccatctcggttcagtggcggtggatagtgggacagagttcactctcaccatcagcagccngcagcctagaacgtatgttnctaacttattactgtactaaagtactctactttcgcccctattccaccttacggaccctaaaggaccgacgactaggacgtaacttaacggacttacggg

SEQ ID NO: 56676 - DNA, 506 bp, Homo sapiens
  misc_feature: GYAE6OF02I9D6C.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccagggaaagttcctaagctcctgatctatgctgcatccactttgcaatcaggggtcccatctcggttcagtggcggtggatagtgggacagagttcactctcaccatcagcagcctgcagcctgaagatgttgctaactttattactgtacaaaagttatactacctttcgcccctatccacccttccggaccgaacgggaccacgacgtaggagtaacttaaaccggacttacgg

SEQ ID NO: 56677 - DNA, 543 bp, Homo sapiens
  misc_feature: GYAE6OF02F8PTY.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcgaggcattaacaattattagcctggtatcagcagcatccagggaaagttcctaagctcctgatctatgctgcatcctactttgtaatcgacgggtcccagtctcggttcaggtggcggtggatagtggacagagttcactctacacatcagcagcctgcagcctagatagttgttagactaactttattaactagttactaaaagttactacttactttccgtacccctattacccgtaccgtttaccggacccgtaacgggtaccgtaaccgacgtacggaacgtaacgttaaaccgtacgtaggtaccgg

SEQ ID NO: 56678 - DNA, 616 bp, Homo sapiens
  misc_feature: GYAE6OF02IBSX9.29.87.H10.1.454.CMB.1.raw
  modified_base (207)..(207): a, c, t, g, unknown or other
  misc_feature (207)..(207): n is a, c, g, or t
tcagatagagtactcacgaccggtgctcgatttagcagtactgcgttcgggtttggggcagaagtctctctcagtccagacaccagcatcggacatgacgggccccgctcagctccgtgggactcctgctgctctggctccagataccagactgtgacatccagatgacccagtctcgatcctccctggtctgcagtctggtggganacagtacgtcaacgtcacttggccgggcgacgtcgagggctaattaactaattacttacgcctggtactcagcagctagtccgaagggaacgttcgaagctctgactcgtatgctgacactcctagtttcgactaagtcgtacgggtccagtccgtcggttcgaggtcggcgggtagactagtagggacaggtacgttcgactctacaaccagtaccaggacctaacgtcctaggacacgtccgtagaaacgtcttaggtacacttaaacgtttctttaactacgttaacgaaaacgttctaccgttacgttacccgaccctagttaccgtaacccgtttaccgggaacccgtaacgggtacctaacggttacctacggaacgttaaccgttaacccggacgttacggg

SEQ ID NO: 56679 - DNA, 519 bp, Homo sapiens
  misc_feature: GYAE6OF02GPRYW.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcaggcattaacaattatttagcctggtatcagcagcatccagggaaagttcctaagctcctgatctatgctgcatccactttgcaatcagggtccatctcggttcagtggcggtggactagtgggacagagttcactctcaccatcagcagcctgcagcctagaagatgttagctaacttattacttgtactaaaagtatactactttcgacccctatcctaccgttaccggtacccaacgggtaccaacggtacgtacggaacgtaacgttaaacgtaacgttacggg

SEQ ID NO: 56680 - DNA, 523 bp, Homo sapiens
  misc_feature: GYAE6OF02IMBX2.29.87.H10.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagatagagtactcacgaccggtgctcgatttagcagtactgcgttggggtttgggggcagaagtctctctcagtccagacacagcatggacatgagggccccgctcagctcctgggactcctgctgctctggctcccagataccagatgtgacatccagatgacccagtctccatcctcctgtctgcatctgtggganacagagtcaacgtcacttggccgggngagtcagggcattaacaattattagcctggtatcagcagcatccagggaagttcctaagctcctgatctatgctgcatccactttgcaatcagggtccatctcggttcagtggnggtggatagtgggacagtagttcactctcaccatcagcacgctgcagcctgaagntgttnacgtaacttattactataacaaagttactactactttccgacccctacttctaacccgttccggaacccgaagggtaacccacggtaaccgtagggtaagtaacgttaaaccgaagttacggg

SEQ ID NO: 56681 - DNA, 491 bp, Homo sapiens
  misc_feature: GYAE6OF02IM23L.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggngagtcgagggcattaacaattatttagcctggtatcagcagcatccaggaagttcctaagctcctgatctatgctgcatccactttgcaatcacgggtccatctcggtcagtggcggtggatagtgggacagtagttcactctacacatcagcacgcctgcagcctagaagatgtgactaacttattactagtactaaatattactacttcgaccctactctaccttcggaccaggacacgacgtggaagtacgtaacgatacgg

SEQ ID NO: 56682 - DNA, 612 bp, Homo sapiens
  misc_feature: GYAE6OF02H9C9K.29.87.H10.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatgacccagtcctccatcctccctgtctgcatctgtggganacagagtcaacgtcacgttggccgggngagtcgaggcattaacaattattagcctggtatcagcagcatccaggaagttcctaagctcctgatctatgctgcatcctactttcgacaactcgtacggggtaccctattcgtcggttcgagttgggcgggtggactagtggggtacaggtagttcgactccgtacaccactcgaggcacgccgtcgcgtacgcccgtaggaagtacgttggttacgacctaaactttaacttaacgttacgttaaaccgtaaaagttacttaccttaccgtttccgtaaccccctattacccgtaacccgtttccggaacccggtaaacgggtaccgtaaccggtaccgttagggtaacggtaaacgttaaaccggtaacgttaacgggg

SEQ ID NO: 56683 - DNA, 560 bp, Homo sapiens
  misc_feature: GYAE6OF02JZPUU.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttggggcgagaagtctctctcagtccagacacagcatggacatgagggcccccgctcagctcctgggactcctgctgctctggctcccagataccagatgtgacatccagatgacccagtctccatcctcccgtgtctgcatctgtgggancagagtcaacgtcacttgccgggcgagtcgagggcattaacgaattattagcctggtatcagtcagcatccagggaacgttcctaagctcctgatactatgtctgcatacctacttgcaatcacgggtccatcgtacggtcagtggacggtgatagtcggactagtagttcacgtctacgtaccaattcgaacgcaaggtcctagcgacgtcctagaagtaactcgttcgacgttaaactttacgttacttagtactaaaacgttcttactacgtttcgacccctagtcccgtaacctttcggaccctaacgggtacctacggtaccgtagtacggaactttaaccggaccttaaggg

SEQ ID NO: 56684 - DNA, 587 bp, Homo sapiens
  misc_feature: GYAE6OF02H9629.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacgttggccgggcgagtcgagggcaattaacaattattagcctggtatcagcagcatcccgaagggaaacgttcctaagctcctgatctatgctgcatcctatttgctaatcgacggggtcccatcgtcggttcagtgggcggtggatagtgggacaggtacgttcactctacaccatcagcacgcctgctagtctagtaaagttattttaactaatttttattacgttgtactagtacgtaagtacgttacgtaagtcggtaaccgtttacccgggtacggttttaccgggaacccgtaaacggggtaaccgtaaaggggttacgggtaaacggtaaccgaaaaccggtacggttacgggtggtaacccgg

SEQ ID NO: 56685 - DNA, 772 bp, Homo sapiens
  misc_feature: GYAE6OF02GHR7V.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtacaacgtctacgttcggccgggcgagtcgaggctaataactaatttattacgccgttaggtatccgagcagactactaccggaaaggggtaaaccgtttaccgtaacgtccttacccgtagtacttacttaagtcgtcgtacgacctaccttacccttacgtttcgaaccttaaacgtcccggggtaaccgggggttacccctaagtttcccggtttaccgggtttacgtaagggtcgggggtccggggttaaggtaacgttagggtacggggtaactaacgggttacgtttaccgtaccgttcctaccaacctactaccgacgaccgacgtccgtacgacgaccggtccgaaggtaagttacgttcgggttacaaaccgttttaacgtttaactttacgttaacggttaaaacttaaaacgttaccttaccgtttacccgtttaccccgaccccttaaccgttacccgttaaccccggttaccgggaaacccggtaacgggtaacccaaccggttacggtaacgggtaacgtaaaaccggtttaaaccgtacggttaaccggg

SEQ ID NO: 56686 - DNA, 604 bp, Homo sapiens
  misc_feature: GYAE6OF02F2SP5.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcgagggcattaacaattatttagcctggtatcagcagcataccgaagggtaaacttcctaagcctcctagatctatgctgcactcctactttgactaagtcgacggggtcccagttccgttacggttcgaggtcgggtcgggttaggtataggtaggggactaaggtacgtttcacttccgtacacctatccacgcacgcctgcacgtcgtaggaagtagttgtacgaccttaaactttagttaacgtagttaactaaaagttactaccgttacctttaccgaccccctaacgttccctaacccgtttaccggaaccgtaacgggaacctaccggtacgtacggtaacgtaacgtttaaaccggacgttacggg

SEQ ID NO: 56687 - DNA, 517 bp, Homo sapiens
  misc_feature: GYAE6OF02GJMCT.29.87.H10.1.454.CMB.1.raw
  modified_base (278)..(278): a, c, t, g, unknown or other
  misc_feature (278)..(278): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtaggagacagagtctccatcacttgccgggccagtccaggcattagaagttattagcctggtttcagcagaaaccagggaaancccctaaactcctgactctacgctgcatccactttgcacagtcgggtccctcgtaggttcagtcggcagcggatcgtgggacagtatttcactctcaccatcagcagcctgcagctagatatgttgactaacttattactagtactaacagtcgttaagtactaaccgtccgtactactttcggaccgtagggacctaaggtggacgtactacgaacggacgtaggtcggtctgtaccg

SEQ ID NO: 56688 - DNA, 628 bp, Homo sapiens
  misc_feature: GYAE6OF02IOREO.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacgttggccgggcgagtcgagggcattaacaattattagcctggtatcagcagcagtccgaagggtaacgttccaagctcctgatcgtatgctgcacttcctactttgactaactcgtacgggtcctattcgtcggttacgaggtcggtcgggtaggtaattacgtggggactaggtacgtttcacttcgtacaccgtatcgacgtcacggtcctacgcctacgccgtaaggaacgttagttggttacgaccttaaactttacgttaaccgttagttaaaccgttaaaagtcgttaccttaccgtttacccggacccccttaagtccccgttaacccgttccgggacccggtaaacgggtaccgtaaccggtaccggtagggtaaccgtaaacggttaaccgtacgttacggg

SEQ ID NO: 56689 - DNA, 503 bp, Homo sapiens
  misc_feature: GYAE6OF02HTVIM.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggnagtcaggcattaacaattattagcctggtatcagcagcatccagggaagttcctaagctcctgatctatgctgcatccactttgcaatcagggtccatctcggttcagtggcggtggatagtgggacagtagttcactctcacatcagcagcctgcagcctgaagntgttnactaacttattactgttaacaaagtatctactttcgcccctatcctacccgttccggacctaacgggaccacggtacgtaggaacgtaacttaaacgacttacggg

SEQ ID NO: 56690 - DNA, 634 bp, Homo sapiens
  misc_feature: GYAE6OF02HJFLQ.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagcccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcagtcaggcattaacaattatttagcctggtatcagcagcatccaagggaaagttcctaaagctcctgactctatgctgctatcctactttcgcaatcacggggtaccctagtcttcggttcagtgggcggtggagtagtaggggacaggtagttcgaactccgtaccaccactacagcaacgcctgccacgccctagaacggtatacggtttagtaccgttaaacgtttaacgtttaacgttacgttaaacgtaaaaacggtttaacttaccgttaaccttttaccggtacccccttaacgttacccttaacccggtttaccgggtaccccgtaaacgggtaacccgtaaccggtaaccggttacgggtaaacggttaaacgttaaaacccggtaaccgttaacgggg

SEQ ID NO: 56691 - DNA, 523 bp, Homo sapiens
  misc_feature: GYAE6OF02F7QOT.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcaggcattaacaattatttagcctggtatcagcagcatccagggaaagttcctaagctcctgatctatgctgcatccactttgcaatcacggggtccatctcggttcagtggcggtggatagtgggacagagttcactctacacctatcagcagcctgccagccctagaagtatgttacgactaactttattactgtaactaaagttatctacttcgacccctagtcctaccttccggacctaacgggaccaaccggtacgtacggtaacgtaacgttaacgacgttacggg

SEQ ID NO: 56692 - DNA, 482 bp, Homo sapiens
  misc_feature: GYAE6OF02FREEL.29.87.H10.1.454.CMB.1.raw
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcatcaggggtcccatctcggtcagtggcggtggatatgggacagagttcacgtctcaccatcagcagcctgcngcctgaagntgtgcacttattctgtacaaatatacactttcgccccatccaccttcgaccgaacggacacgactggagtacttaaacgagtacgg

SEQ ID NO: 56693 - DNA, 637 bp, Homo sapiens
  misc_feature: GYAE6OF02F62VI.29.87.H10.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagatagagtactcacgaccggtgctcgatttagcagtactgcgttgggtttggggacagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttgccgggngagtcgaggcattaacaattattagcctggtatcagcagcatccgagggaaagttcctaagcctcctgattctatgctgcactcctactttgctaagtcgacggggtaccccagttccgttacgggttcaaggttcgggcgggttggaacgttagtggggactaggtacgtttacaccttctacctaccacgtacacgcgtacgtcctgcacgtccgtagaacgtagttgttacgtacctaaacttttaacgttaccgtttacgttaaactaaaaacgtttacgtaccttaacccgttttacccgacccccgtaattacccgtaaccccgtttacccgggtacccgtaaacgggaacccgtacggaacgttaaccggaaacgttaacgttaaaccggtaacggttaacgg

SEQ ID NO: 56694 - DNA, 883 bp, Homo sapiens
  misc_feature: GYAE6OF02IE3PT.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcattcgtggtgggagacagagtaccaaacgtcctacgttcggcccggggacgacggtcgaaggggactaaagtttaaactaaatttagtttacgccgtaggtaactcgacgcgagactaacgtacccggaaggggtaaaaccgtttaccgtaaagccttacccgttagtacttacttagtacggtcttcgtacctacttacccctaacgttttcgaaccttaaacgtccgggtaaccggggttacccctaagtttcccggtttaccgggttaccgtaacgggttcgggggttaccggggttaggtaaacggttttacgggtacgggggtaaaccgtaacgggtttaaacgtttacccggtaacccgtttacccttacccgtaaacccctaacgttacccgaacggtacccgtaaccgacccgtttacgaccgtacggtaccgtaaggaaacggtagtttacgggttacaaaccgtttaaacgttttaacgttaccgtttaaacgtaaaccgttaaaacgttaccttaaccctttaacccgttttacccgaaccccccttacgttaaccccgtttaaccccggtttacccggggtaaaccccggtaaaaccgggttaccccgtaaccggtaacccgggttaagggtaaaaccggtttaaaaccggtttaaacccgggtaaggttttaaccgggg

SEQ ID NO: 56695 - DNA, 710 bp, Homo sapiens
  misc_feature: GYAE6OF02I0RN6.29.87.H10.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (313)..(313): a, c, t, g, unknown or other
  misc_feature (313)..(313): n is a, c, g, or t
tcagatagagtactcacgaccggtgctcgatttagcagtactgcgttgggtttgggggtcgagaagtctctctcagtccagacacagcatggacatgagggcccccgctcagctcctgggactcctgctgctctggctcccagataccagatgtgacatccagatgacccagtctccatccctcctgtctgcatctgtgganacagatcaacgtcacgttgccgggnagtcagggcataacattattagcttggtatcagcagcatcgaaggaatcctaagctacgtgactctatcgctgactatcctacttnctaatccgacgggtaccctagtcgtcggttctacgtcgggtaccggtaggtaacgttacggtacggggtacgtaacggttacggtttcctaacccgttcgtaccgtaacccgtaacgtaccgacgggtacctaaccgggtacccttcgggaacctaccgggtacccttacgggaaacgttacgtttcggttaaacgtaccttaaaccgttttaacgtttacccgtaggttaaaccctaaagttttaacgtaaccctttaccgttttacccgacccctttaacgttaccccgtaaccccggtttaccggtaacccctaaacgggggtaaccccgtaaccggttaaccggttaggaaaccgtttaaacccggttaaacccggttaacggttaacccggg

SEQ ID NO: 56696 - DNA, 540 bp, Homo sapiens
  misc_feature: GYAE6OF02HUGJB.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccggngagtcgaggcattaacaattatttagcctggtatcagcagcatccgaagggaaattcctaaagcctacctgatctatgctgcatccatttgcaatcgagggtcccatcgtcggttcagtcggcggtgatagtggacagagttcactctcacatacagcacgcctgcacgcctaggaaacgtgttagttacgactaaactttaacgttaacttagtaaccgtaaaaagttactactaccgtttcaccccctagtcctaccgttccggaccgaacggaccgacgtacgtagggaactaacgttaaccgtagtacgg

SEQ ID NO: 56697 - DNA, 789 bp, Homo sapiens
  misc_feature: GYAE6OF02ICLZ1.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatcgacccagtcctccatccctccctgtctgcatctggtgganacagagtcaacgtcacttgccgggacgagtcgagggctaattaactaattatttacgccgtaggttatcgacgtacagcactccggaaagtaacgttacctaaggtcctccgtagtactactagtcgcgtagacctacgtccttacgttttagacctaaacgtccgtacggggttaccctacgtttaccgttacgggtttacgaacgggttcggggtaccgggtacggtaagttaacggtacggggtaacctagggtaaccgtttaccaaccgtttactaccctacccgtacgtaccaacggtacgaaccggttcctacggtacctacggtaccgttaggtaaacgtattcgggtttaacgtaaccttaaacggttttaacttaacccggtttaagttaaaccgtaaaacggtttacttacccgtttaacccgttttcccggaacccccctttacggttaaccccgttaacccgggttaacccggaacccggttaaaccggggtaaccccgtaagggttaaacccgggtttacgggggtaaaccgtttaaaccgttttaaaccgggtaaccccgtttaacgggg

SEQ ID NO: 56698 - DNA, 540 bp, Homo sapiens
  misc_feature: GYAE6OF02H1X1E.29.87.H10.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagatagagtactcacgaccggtgctcgatttagcagtactgcgttggggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttgccgggngagtcgagggcattaacaattatttagcctggtatcagcagcatccagggaaagttcctaagctcctgatctatgctgcatccactttgcaatcacggggtccatctcggttcagtggcggtgatagtgggacaggtagttcactctcaccatcagcacgtcctgcgacgacctgaagtatgttacgactaaactttattacttagttaactaaaagttactactacctttaccgacccctagtcctaccgttcggacccgaacgggaccgtaacggtacgtacggtaacgtaacgttaaacggagttacgg

SEQ ID NO: 56699 - DNA, 572 bp, Homo sapiens
  misc_feature: GYAE6OF02I6MD1.29.87.H10.1.454.CMB.1.raw
  modified_base (201)..(201): a, c, t, g, unknown or other
  misc_feature (201)..(201): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
tcagatagagtactcacgaccggtgctcgatttagcagtactgcgttgggtttgggggcagaagtctctctcagtccagacacagcatggacatgagggccccgctcagctcctgggactcctgctgctctggctcccagataccagatgtgacatccagatgaccccagtctccatcctccctgtctgcatctgtggganacagagtcaacgtcacgttgccgggcgagtcagggcattaacaattatttagcctggtactcagcagcatccgaagggtaagttcctaagctccgtgattctatgctgcatccactttgacaatcgacgggtccattcgtcggtntagtggcggtgatntaggggacagtagtcacgtctacacctatcgagcagtccngtacacggtcctagaaggtatggttagacttaacttagttacttagtaactaaaagtacctactaccgtttaccgaccctagttccctaacccggtttaccggaccgtaaacgggtaccctaaacggtaccgttaaggaaacgtaaaccggtttaaaccggaacgttacggg

SEQ ID NO: 56700 - DNA, 710 bp, Homo sapiens
  misc_feature: GYAE6OF02HIJLP.29.87.H10.1.454.CMB.1.raw
  modified_base (229)..(229): a, c, t, g, unknown or other
  misc_feature (229)..(229): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctggtgggagacagagtcaacgtcacgttgccgggngagtcgaggcattaacaattatttagcctggtatcagcagcagtaccgaaggggtaaacgttacctaaggccttccgtagtacttcttaagtgtacgtgcctacgttccctacgttttacgaccgtaacgttccggtaaccggggttccctaagttcccgtttaccgggttacgtacgggttcggggacggttagggtaagttaggtaggggaacgtaaggttacgttaccgtaccgtcgttaccaaccgtactacgacgtaccacgtccgtgaccgtcgtaccgtaggaagttacgttggttacgtaaccgttaactttaacgttaaccgttacgtaaactaaaacgttacttacccgtttaaccgtttcccgtacccccgttaacgttcccgttaaacccgttcccgggaaacccgtaacggggtaccctaacgggtaaccgtacggaaacgttaaacgttaaaccggtacgttacggg

SEQ ID NO: 56701 - DNA, 538 bp, Homo sapiens
  misc_feature: GYAE6OF02IIZRK.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttggggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccagggaaagttcctaagctcctgatctatgctgcatccactttgcaatcacggggtccatctcggttcagtggcgggtgagtagtggacagtagttcactctcacatcagcagccgtgcagccgtgaaagtgtacgttagacttaacgttatttactacgttaactaaagttacttactaccgtttacaccccctagttccctaccgttaccggaccgtaacggaaccacggaacgtacggtaacgaacgttaaccgaagttacggg

SEQ ID NO: 56702 - DNA, 506 bp, Homo sapiens
  misc_feature: GYAE6OF02F3LXU.29.87.H10.1.454.CMB.1.raw
  modified_base (105)..(105): a, c, t, g, unknown or other
  misc_feature (105)..(105): n is a, c, g, or t
  modified_base (201)..(201): a, c, t, g, unknown or other
  misc_feature (201)..(201): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
tcagatagagtactcacgaccggtgctcgatttagcagtactgcgttgggtttggggcagaagtctctctcagtccagacacagcatggacatgagggcccccgntcagctcctgggactcctgctgctctggctcccagataccagatgtgacatccagatgacccagtcctccatcctcctgtctgcatctggtggganacagagtcaacgtcacttgccgggcagtcaggcattaacaattattagccttggtatcagcagcatccagggaaattccaagctcctgatctatgctgcatccactttgcaatcgacgggtcccagtctcgttcagtggcggtagatgnggganagntcactntcacntcagcacgctagcancctagagntgtacgctaacttactacttagtaacaaagttactacgttacctttacgacccctaattccgtaaccttccggaccaaggtaccacgtaacgtagacgtaattaaccgatacgg

SEQ ID NO: 56703 - DNA, 657 bp, Homo sapiens
  misc_feature: GYAE6OF02JTQWH.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctccagataccagatgtgacatccagatgacccagtctccatcctccctgtctgccatctgtgggancagacgtcaacgtcacttggccgggcgagtccgaggctagttaacaattattagcctaggtatcagcagcatccgaggaacttctaagctacctgtactctatcgcttcgactactctacttcgactaaacgtcgaaccgggtcctagttccgtcggttctaggtcggtcggtaggtacttacggtacgggacgtacggttacgttactacgtaccgttacaccgtacgttacacggtaccacgttcctacgaccgacgtcgtacgtaagtagttacgtacgtacttactttaaagttaccgttaacgttaacgttaaacgtaccgtttactaaccgtttaccgtaacccccgttagtaacccgttaacccgtttccgggaacccgtaaaaccgggtaccgtaacccggtacggtaaacggtaccgtaaaccgttaaacggtacggttaacccgg

SEQ ID NO: 56704 - DNA, 813 bp, Homo sapiens
  misc_feature: GYAE6OF02HOKQZ.29.87.H10.1.454.CMB.1.raw
  modified_base (106)..(106): a, c, t, g, unknown or other
  misc_feature (106)..(106): n is a, c, g, or t
  modified_base (206)..(206): a, c, t, g, unknown or other
  misc_feature (206)..(206): n is a, c, g, or t
  modified_base (229)..(229): a, c, t, g, unknown or other
  misc_feature (229)..(229): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctccctgtctgcatctgtgggagacagngtacaacgtcacgttggccgggngagtcgagggacaattaacaattattacgcctggtatcgagcagacactaccgtaaggggtaaacgttaccgtaaacggtcctcctagtacttctaagtggtactcgacctacttaccctacgtttcgtacctaaacgtaccggtaccggggttacccctaagttccgtaccgggtttacgtaacgggtcggggtaccggggttagggtaaggtttacgggttacgggggtaaaccggtaacgggttaaccggttttaccgtaacccgttaccgttaacccgtaaccgtaacgttacccgaacggtacccgaaccggttcccgtacggaccgtaaccggtacccgttaacgggtaaacggttacgttacgggtttaaccgaaccgtttaaacgttttaaaccgtttaacgttaacggttaaaaccgtaaaaacgtttacttaaccccgttaccgttttaccccgacccccgttaacttaaccccggttacccggtttaaccgggaacccgtaaaccggggtaacccgtaaccggtaaccggtacggtaaaccggttaaaccgttaaaccggtaacgttacgggg

SEQ ID NO: 56705 - DNA, 682 bp, Homo sapiens
  misc_feature: GYAE6OF02I2NMW.29.87.H10.1.454.CMB.1.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctgtgganacagagtcaacgtcacttgccgggngagtcaggcattaacattattagcctggtatcagtacagcagtaccgaagggtaaacgttcctaaggcctccgtgacttctatcgctagctacttccgtacttttcgactaacgttccgacggggttccctagttccgttcggttacgtaagggttcgggtcgggtagtagttaggtcgggaacgtaaggtacgtttcgacttccgtaccacctactcgacgcgtacgtccttacggaccgtacgtcccgtagtaacggttagttacgttacgtaccttaacgttttacgtttacgttaacgtttaaacgtaaaacgtttaccttaccgtttacccctttacgtacccccttacgtttaaccccgtacccggtttaaccgggacccggttaaacgggacccgtaaccggttaccggtacgggtaaacgttaaccgtttaaaccggtaccggttacggg

SEQ ID NO: 56706 - DNA, 528 bp, Homo sapiens
  misc_feature: GYAE6OF02I4Z0C.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccagggaaagttcctaagctcctgatctatgctgcatcctactttgcaatcacgggtcccatctcggttcagtggcggtggatagtgggacagagttcactctcaccatcagccagcctgccagccctagaagagtgttacgactaacttatttactagttaactaaaagtactactactttcgaccccctatcctacccgttccggaccgtaacgggaccaacggacgttacggaacgtaacttaaacgacgttacgg

SEQ ID NO: 56707 - DNA, 571 bp, Homo sapiens
  misc_feature: GYAE6OF02GDC9E.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcgaggcattaacaattatttagcctggtatcagcagcatccaagggaaacgttcctaagcctcctgatctatgctgcactcctatttcgactaagtcgacggggtcccagttcgtcggttcgagtggcggtgatagtgggactagtacgttcactccgtacaccactacgacgcacgtccgtgcctagcctaggaagtagtggttacgactaactttattacgtacgtaactaaagttactaccttacgtttaccgaccccttacgtcctaacccgttccggaacccgaacgggtaccgaaccgtacggtacggtaacgtaacgttaaccgtacgttacgg

SEQ ID NO: 56708 - DNA, 549 bp, Homo sapiens
  misc_feature: GYAE6OF02IN509.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (445)..(445): a, c, t, g, unknown or other
  misc_feature (445)..(445): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctcctgtctgcatctgtggganacagagtcaacgtcacttgccgggnagtcaggcattaacaattattagcctggtatcagcagcataccgaagggtaaagttacctaagcttacctagattctaatcgtctgacactcctactttcgactaatcgacggggtacccagttctcggttacgaggtcgggtcgggtaggacgttagtagggactagtacgttacactcctacaccatcagactacgcctgacgagtcctagaacgtntgtatacgtacttattactgtaactaaatactactacttccgaccctagtcctaccgtcgaccgtaacggacgacgtacgtacgaagtaacgtaacgagtacgg

SEQ ID NO: 56709 - DNA, 559 bp, Homo sapiens
  misc_feature: GYAE6OF02JC0TV.29.87.H10.1.454.CMB.1.raw
  modified_base (106)..(106): a, c, t, g, unknown or other
  misc_feature (106)..(106): n is a, c, g, or t
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctccctgtctgcatctgtggganacagagtcaacgtcacttcggccgggtcgagtcgagggcagttaacaattattagcctggtatcgagcagcatccgaagggtaattccgtaagctcctgactcgtatgctgctactcctactttgactaatcgacgggtcctatccgtcgtacaggtggcggtggtataggtggactaggtacgtcactctacaccgatacagtcacgctagctacgcctagtaagtcttgtgacctaatttacgtactagtaactaaagttctaccttacttaccgaccctacgttcccgtaaccgttaccggaccgtaacggacctaacggtacgtacggtaactaacgttaaccgtagttacggg

SEQ ID NO: 56710 - DNA, 549 bp, Homo sapiens
  misc_feature: GYAE6OF02GLGUZ.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccgagggaaagttcctaagctcctgatctatgctgcatccactttgacaatcgacggggtcccagtctcggttcagtggcggtggatagtgggacagtagttcactctcaccatcacgcacgcctgcacgcctagaagattggttacgtactaacgtttattacgttagtaactaaaagttacttacctaccttttaccgaccccctaactcctaacccgtttccggaaccgtaacgggaccaccgtacgtacggaagtacgtttaaacgacgttacggg

SEQ ID NO: 56711 - DNA, 582 bp, Homo sapiens
  misc_feature: GYAE6OF02HJMH7.29.87.H10.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggnagtcaggcattaacaattatttagcctggtatcagcagcatcccgaagggaaacgttcctaagctcctgatctatgctgcatcctactttgcaatcgacgggtccatcgtcggttcagtggacggtggatagtgggactaggtacgttcactctaccacctaatcacgtcagtcccgtagccgacgtcctagaagtattcggttacgtactaactttactttaccgtacgttaaacgtaaaacgtacttacctactttacccgacccccttaagtcccgtacccgttaccggaacccgaacggggtaaccaccggtaaccgtacggtaacgtaaccgttaaacggacgttacggg

SEQ ID NO: 56712 - DNA, 670 bp, Homo sapiens
  misc_feature: GYAE6OF02IF2NZ.29.87.H10.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctggtggganacagagtaccaacgtcacgttggcccgggngagtcgagggctaattaaactaatttatttacgctggtatcagcagcactaccgaagggtaaacgttaccgtaacgcctccgtagtactccttatcgtctcgactactcctactttcgactaagtccgtacgggtccctagttccgttccggttcgtagtcggggtcggtggtagttaggtacgggactaggtacgttactactaccttacaacctactcgacgacaacgtcccgtagcgtacgtaccgtagaacgtagttcgttacgacttaaactttacttaacgttacgttaaacgtaaaacgtactttaccgttacctttaccccgaccctaccgtacccgtaacccgttaccggaacccggtaaacgggtaacccgtaaccggttaaccggtaaccggttaacggtaaacggttaaccgtacggttaccggg

SEQ ID NO: 56713 - DNA, 634 bp, Homo sapiens
  misc_feature: GYAE6OF02H3PVH.29.87.H10.1.454.CMB.1.raw
  modified_base (200)..(200): a, c, t, g, unknown or other
  misc_feature (200)..(200): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgganacagagtcaacgtcacttgccggcagtcaggcattaacaattattagcctggtatcagcagcatccgaggaagttccaagctcctgattctatgctgcatcctactttgactaatcgagggtcccatcgtcgttcagtggcggtggatagtgggacagtacgttcactcgtcaccatcagcgacgccgtgcacgccgtagaaacgtacgttgttacgtactaaacttttacgttaaaccttacggttaactaaaaaacggtttaccttaaccgttaacccgtttttaccccgtaccccccgttaacgttaccccgtttaaccccggtttacccggggtaaccccggtaaaccggggtaaccccgtaaccgggtaacccggttacgggtaaaaccggtttaaaccggtttaaaacccggtaacgtttaaccgggg

SEQ ID NO: 56714 - DNA, 741 bp, Homo sapiens
  misc_feature: GYAE6OF02IMEV7.29.87.H10.1.454.CMB.1.raw
  modified_base (210)..(210): a, c, t, g, unknown or other
  misc_feature (210)..(210): n is a, c, g, or t
tcagatagagtactcacgaccggtgctcgatttagcagtactgcgttgggtttgggggcagaagtctctctcagtccagacacagcatggacatggacggggccccccgctcagcctcctgggactcctgctgctctggcctcccagataccagatgtgacatccagatgacccagtctccatccctccctgtctgcatcgtggtggganacgagtcgtacaacgtctacgttcggccgggcgagtcgagggacctaatttaaactaatttactttacgccttaggtactcgagcagcaacgtaccgaaggggtaaacgtttcctaagtccttaccgtagacttcgttaatcggcttacgactacttccctaacgtttcgacctaaacgttccggaccggggttacccacgtttccggttacgggtttacgacgggtttcggggtacggttaggaagtttaacgggtacgggtaacgtaagggttaccgtttccgtaacctccttaacctaacctaacgttccgaacgtaccgtaacggtcccgttacgacctaccggtcctaaggaagttacgtgtaacgtacttaactttattacgttagtaacttaaagttaccgtaccttacgttacccgacccctaacgttcccgttaaccggtccggaaaccgggttaacggaaacccgtaccgggtaacggttacgggtaaagttaaaacctttaaccggtaacggttaccggg

SEQ ID NO: 56715 - DNA, 635 bp, Homo sapiens
  misc_feature: GYAE6OF02IY168.29.87.H10.1.454.CMB.1.raw
  modified_base (106)..(106): a, c, t, g, unknown or other
  misc_feature (106)..(106): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatccctcctgtctgcatctgtggagacagagtcaacgtcacgttgccgggcagtcagggcattaacaattattagcctggtactcagcagcagtccgaagggtaaacgttcctaagctcctgatctatcgctgactatcctactttgactaagtccgacgggtccctagttcgttcggttacaggtcggcggtaggtagttagtcgggaactaggtacgttacacttctaccacctatacacgacgtacgccgtgaccgacgtaccgtaggaaagtagttcggttacgacttaacgtttaactttacgtacgttaaactaaaggttaactaccgttaccgtttccgaaccccttaacgttacccgtaacccgtttacccgggaccgtaaaccggggtaaccctaaccgggtaaccggttacgggaaccgttaaaacggtttaaaccggtacggttacggg

SEQ ID NO: 56716 - DNA, 698 bp, Homo sapiens
  misc_feature: GYAE6OF02I9JPI.29.87.H10.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctgtggganacagagtcaacgtcacttgccgggnagtcgaggcattaacattattagctggtatcagcagcactacgaaggaagttcctaagcctactgatactatcgctcgctactccactttgactaaagtcgtacggggtaccctagttccgttaccggttacgtaacggttcgggtacgggtacggtaagttaacggtcgggtaacgtaacggttacggtttaccaaccgtttccgtacctacctaacgtaccgacggtaccgtacgggtacccttaggaccgtacggtacccgtagtaaacggtcgtttacgttaccgtaacgttaaccgtttaacgttaaccgtttagtaaaccgttaaaagttccgtttaacgtacccgttttacccgtaccccgtaaccgtttcccgtaaccccgttttaccggaaccccgtaaacgggttacccaaccggttacggtacggttaaaccggtaaaccgttaacggtaacccgttcgggg

SEQ ID NO: 56717 - DNA, 930 bp, Homo sapiens
  misc_feature: GYAE6OF02HCX7P.29.87.H10.1.454.CMB.1.raw
  modified_base (107)..(107): a, c, t, g, unknown or other
  misc_feature (107)..(107): n is a, c, g, or t
  modified_base (857)..(857): a, c, t, g, unknown or other
  misc_feature (857)..(857): n is a, c, g, or t
tcagatagagtactcacgaccggtgctcgatttagcagtactgcgttggggtttgggggcagaagtctctctcagtccagacacagcatggacatgagggcccccgntcagctcctgggactcctgctgctctggctcccagataccagatgtgacatccagatcgacccagtcctccatccctccctgtctcgacactcgtggtagggagtactaaggaggttaccaaaccgttcctaaccggttttcgggaccccgggggtaccgtaggttaccgaacgggggtaccttaaacgttttaaaaaccgtaaaatttttaaccgtttttaaacgggcccccgttttaagggggtttaaacttaccccggaaaggggttaccaaaccggttaccgttaaaaccggtttaacccccgggtaaaaggggggggttaaaaaaccctttttacccccgtaaaaccgggtcccgtttaccccggtttaagggtaaccctttaccgttttaaagttccggtaccgttaacggtccctaaaccgtttccccttaacggttttacggaccgtaaaacgttccggggaacccggggtttcccctaatttcccggtttacgggttaccgtacgggtttacggggaccggggttaggtaacggtttaccggtacgggggtaaccgtaacggtacggtttaaccaacccgtttaccctccgtaaaccgtcggttaaccacgtcctaaccggtcccgttaccgcgtaacggttacccgtaaggtaacggttaacgtttcgggttactaccgtttaaaccgttttgttaaccgttaacgtaaacgtaaaacttccgttactaccgtttacccncccgtaactcccgtaccgttacgacccgtaacggtactaccgtaggtaccgttaagtaacgttacggattcgg

SEQ ID NO: 56718 - DNA, 745 bp, Homo sapiens
  misc_feature: GYAE6OF02JGHUU.29.87.H10.1.454.CMB.1.raw
tcagatagagtactcacgaccggtgctcgatttagcagtactgcgttgggttgggggcgagaagtctctctcagtccagacacagcatggacatgagggccccgctcagctcctggactcctgctgctctggctcccagataccagactgtgacatccagatgacccagtctccatccctccctgtctgacatctgtgggacacagagttccaaacgtcacttgccgggacacgttccgaggggctagtttaaaccaaagtttacgtttaagcccgttaggtacttcagtacaggtcacgttaccgagggtaaacgttccgtaaagccgttacctggaacttactaacttcggacttggacttaacctccgtacttttacgacctaaacgttccgtaaccgggggttacccacgtttaccgtccggtttactaaccgggttggtaccggggttaggtacgttaagtcggggtaaccgtaaggtacggtttaccgtaacccgtttccgttacccgtaacccggtaacttaccgtaacgccccgtaaagtccccggttagtaacccgtacggtacccgtaggtaaaacgtcgtttacgttaacgtaccgttaaacgtttaccgtttaacgttacgtaactaaaaggttactaaccgtacttttcggacccctaacttcctacccgtttacggccgtaaacgggtcccaacgtaccggttagaacccggtaacttaaccgtactacgg

SEQ ID NO: 56719 - DNA, 579 bp, Homo sapiens
  misc_feature: GYAE6OF02I4C6W.29.87.H10.1.454.CMB.1.raw
  modified_base (106)..(106): a, c, t, g, unknown or other
  misc_feature (106)..(106): n is a, c, g, or t
  modified_base (199)..(199): a, c, t, g, unknown or other
  misc_feature (199)..(199): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctcctgtctgcatctgtgganacagatcaacgtcacgttggccgggcgagtcgagggcattaacaatttattagcctggtatcagcagcataccgagggaaattcgaagctcctagatctatgctgctactcctactttgactaatcgagggtccctagtctcggttacaggtggcggtgatgnggactagtatcactctcactntacgacgcacgtccagcacgtccgtaagacgtgttacggttnaacttaacgttatttaaccgtaggttaacctaaaagttctaccgttaccgtttccgaccccttaagtcccgttaaccgttccgggaaacccgtaacgggtaacctaaccggtaccgttaacggaacggtaaacgttaaccggtaacgttacggg

SEQ ID NO: 56720 - DNA, 551 bp, Homo sapiens
  misc_feature: GYAE6OF02HMO0G.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggnagtcaggcattaacaattattagcctggtatcagcagcatccaggggaaacttcctaagctcctagactctatgctgcatcctactttgcaatcgacgggtcccattcgtcggttcaggtggtcggtggtatagtgggacaggtagttacacgttctcacctatcgaagcagcctgcacgcctagaacgtattgttacgactaacgtttacttattacgtaactaaaagtatacttacgtttccgacccctaagttcctacccgttacggaacccgtaacgggacctacggacggttaaggaacgtaacgttaaccgagttacgg

SEQ ID NO: 56721 - DNA, 645 bp, Homo sapiens
  misc_feature: GYAE6OF02JUGDC.29.87.H10.1.454.CMB.1.raw
  modified_base (198)..(198): a, c, t, g, unknown or other
  misc_feature (198)..(198): n is a, c, g, or t
  modified_base (523)..(523): a, c, t, g, unknown or other
  misc_feature (523)..(523): n is a, c, g, or t
tcagatagagtactcacgaccggtgctcgatttagcagtactgcgttgggtttgggggcagaagtctctctcagtccagacacagcatggacatgagggccccgctcagctcctgggactcctgctgctctggctccagataccagatgtgacatccagatgacccagtctccatcctcctgtctgcatctgtggganacagagtcaacgtcacgttggcccgggtagagtccgaggggacctaatttaaaccgaagtttaactttacggcccttaggtatacgtagcagcctagtaccgaagggtaacttaccgtaagtccgtacctaggacttctagttcgacttagacctacttcctactttagactaacgttcgtacggtccctacgttcgttcggttacgtacggtcgggtacggttacgagtacggttacggggactaggttacgttacgtacctcgtaccacgtacgtacgacggtacctacggtccgttaggacctacggtacttaggaacgttntaacgtcgaactttaacttatcgttaactagtaaagtcttactaccgttcacccttaagtccgttaccggttacgaacgtaacggaccgcgtaacggcgttaacgtaacgttacacgttcgg

SEQ ID NO: 56722 - DNA, 570 bp, Homo sapiens
  misc_feature: GYAE6OF02HICVS.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcgaggcattaacaattatttagcctggtatcagcagcatccgagggaaagttcctaagctcctgactctatgctgcatcctactttgactaatcgacggggtcccacttcgtcggttcagttgggccgggtggatagtagggacgagtacgttcacgtctaccacctatcacgcacgtcgtcgcacgccgtcgaagtagttggttacgtactaactttactttaacgttacgttaaccgtaaaagttactactaactttccgacccctacgtacctacccgttcgaacccgtaacggaacctacggtaccgtacgtaaggtaacttaacggacttacggg

SEQ ID NO: 56723 - DNA, 496 bp, Homo sapiens
  misc_feature: GYAE6OF02GPXAJ.29.87.H10.1.454.CMB.1.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
  modified_base (422)..(422): a, c, t, g, unknown or other
  misc_feature (422)..(422): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttgccgggcgagtcagggcagttaacaattattagcctggtatcagcagcatccagggaagttcctaagctcctgatctatgctgcatccactttgcaatcacggggtccatctcgttcagtggcggtgatagtggganagagtcactctcacatcagcagcctgcngcctgaagatgtgctaacttatacttgtactaaagtntactactttcgacccctagtctaccttacggacctaacgggactacggactaggacgaattaacggacttacgg

SEQ ID NO: 56724 - DNA, 661 bp, Homo sapiens
  misc_feature: GYAE6OF02IZ9VF.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatcagtatgacccagtctccatcctccctgtctgcatcgtgtggagacagacgtacaacgtcacgttgccgggtcagtcaggacaattaaactaattattagccgttaggtatacagtccagcagtcgaagggtaaacgttcctaagctcctagactcgtatgtctgactactacctactttcgactaagtcgacgggtccctacgttcggttcggtacgtaggtcggtcgggtagtaagtaggtagggactaaggtacgttcacgttacctaccactagtaccgagccgtacgtaccttcgaccgtaaccgccgtaagtaacggtagttccgttacgtaaacctttaactttaacgttaacgttaacgttaaaacgttaaaccgttacttaccttaccgttttacccacccttaacgttacccgtaacccgttacggaacccgtaaacggtaccgtaaccgtaggttaaccggaagttaaaccggttaaacggtacgttaccggg

SEQ ID NO: 56725 - DNA, 657 bp, Homo sapiens
  misc_feature: GYAE6OF02GDA7G.29.87.H10.1.454.CMB.1.raw
  modified_base (106)..(106): a, c, t, g, unknown or other
  misc_feature (106)..(106): n is a, c, g, or t
  modified_base (316)..(316): a, c, t, g, unknown or other
  misc_feature (316)..(316): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctcctgtctgcatctgtgggatacagatcaacgtcacttggccgggcatcaggcattaacaattattagcctggtactcagctagcatccgaagggtaattccaagtctacctgaatctatgtctgcatcctactttnactatcgacgggtacctagtcgtcggttcagtggccggtggatagtgggactaggtacgttcacgttccacgtaccacttcaacgtcacggttaccctgaccgtacggtacccgtaggaaacgttacgttcggttacgtaaccgttaaccttttaagtttacgtaacgttaaacgtaaaacgtttaccgtaaccgttaaccgttttaccgacccccgttaacgtttacccggtaaccccggttttacccgggaaaccggttaaacccgggtaacctaacccgggtaacgttaaccggggtaaaaccgttaacggtttaaaacccggaggttttaacccggg

SEQ ID NO: 56726 - DNA, 584 bp, Homo sapiens
  misc_feature: GYAE6OF02HRBW3.29.87.H10.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (366)..(366): a, c, t, g, unknown or other
  misc_feature (366)..(366): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtggganacagagtcaacgtcacttggccgggngagtcgagggcattaactaattattagcctggtatcagcagcactaccgaaggggtaaacgttaccgtaagccttcctgactctatgctgcactcctactttgcaacgtcgacgggtccagtcgtcggttcaggtggngggtgagtagtgggacagtagtcactctacaccatcacgcacgtcctgccgtagccgtagaacgtagttaggttacgactaactttagttaacgttacgtaaataaaacgtacttactacgtttaccgacccctacgtacccttacccggttacggtaacccgtaacggtaaccgacggtaccgtacggtaacgtaacgtttaacggaacgttacggg

SEQ ID NO: 56727 - DNA, 710 bp, Homo sapiens
  misc_feature: GYAE6OF02G41BU.29.87.H10.1.454.CMB.1.raw
  modified_base (208)..(208): a, c, t, g, unknown or other
  misc_feature (208)..(208): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagataccagatgtgacatccagatgacccagtcctccattccctccctgtctgcatcgtggtaggganacagagtaccaacgtcacgttcggccgggacagtcgagggacctaattaactaatttagtttacgccgttaggtactacgacgcacggacacgtaccggaagggtaaacgtttaccctaagtccttaccgtagtacttacgttatcgtactgacctactcctacgtttacactacgtccggacgggtaccctagttccgttcgttacgacggttcgggcggtaggtatacgggtacgggaactaggtacgtttacctaccgttacctaccctaacctacgttaccgaacgtcctaccggtcctcggacctacggtccgtaaggtaacgtcgttaggttaccgtaactttacgtttaacttaacgtgttaaacgttaaacgttacttaccgttaccgtttacccgaccccttagttccccgttacccgttaccgggaaccgtaacgggtaccctaacgggttaaccgtacggttaaacgtaacgttaaccggtacgttccggg

SEQ ID NO: 56728 - DNA, 632 bp, Homo sapiens
  misc_feature: GYAE6OF02IS0KQ.29.87.H10.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctgtggganacagagtcaacgtcacttggccgggnagtcgaggcattaacattatttagcctggtatcagcagcataccaggggaaagttcctaagcctccgtagatctatcgctgccactctactttgactaactcgacgggtacccagtcgttcggttctaggtgggcggtggtatagtacgggacaggtagttccactctacacctactcacgcagcctgcacgcgtagaagtattgttacacttaaacgttactttaacgtacgttaaactaaaacgtttaacgttaccttaccgttttacccggaacccccttaacgttccccgtaacccgttttacccggggaaaccccgtaaacggggtaacccgttaaccggtaacggtttaaccgggggaaacgtttaaaccggttttaaaaccggacgtttaaccgggg

SEQ ID NO: 56729 - DNA, 668 bp, Homo sapiens
  misc_feature: GYAE6OF02G96YS.29.87.H10.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtggganacagagtcaacgtcacttggccgggngagtcgaggcattaactaattatttagcctggtatcagcagcacgtaccgaagggtaaagttccgtaagcctacctgtactctatcgtctgcactcctactttacgactaagtcgaccggggttaccctagttccgttcggttcgtacggttggggccgggttaggacgttaggtggggacgtaagtacggtttaccaccgttacctaccgtaacctacttaccgacgtccgacgtcccgtcgacaccgtacgtaacggtaacgttacgttacggttacgtaccgttaaacttttacgttaacgttaacgttaaacttaaaacggtacttacccgttaccttttacccgaccccttaaccgttccttacccgttaccgggaacccgtaaccggaaccgtaccgacgttaggtaaccgttaacgttaaccgtagttacggg

SEQ ID NO: 56730 - DNA, 788 bp, Homo sapiens
  misc_feature: GYAE6OF02HO52I.29.87.H10.1.454.CMB.1.raw
  modified_base (106)..(106): a, c, t, g, unknown or other
  misc_feature (106)..(106): n is a, c, g, or t
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (298)..(298): a, c, t, g, unknown or other
  misc_feature (298)..(298): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtcctccattccctccctgtctgcatctggtggganacagagtcaacgtcacgttggccgggnagtcgagggctaattaacaatttattagcctggtactcgagcagcatccgaagggtaacttccaanctcctgatctatgctgctactcctactttgactaagtccggaacgggttcccaagttccgtaccgggtttacgagggttcgggtacgggttaggtaactttagggtacggggtacgtaacggtacggtttaccgtaaccgttacccttacccgtaacccgtaacttaccgaacggtaccgtaacggttcccgttacgggacccgtaaccggtaccgttaacggtaaacggttaacgtttaccgggttttacggtaacccgtttaaaaccgtttttaactttaaccggtttaaacggttaaaccgttaaaaaacggtttacgttaacccgtttaacccgttttaccccgtacccccgttaaaccgttcccggtttaacccccggtttacccggggtaaaccccggtaaaccgggggtaaccgtaaacccggttaacgggttaacgggtaaaccggtttaaaacgtttaaaccgggtaaccgtttaccgggg

SEQ ID NO: 56731 - DNA, 645 bp, Homo sapiens
  misc_feature: GYAE6OF02I93SL.29.87.H10.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (463)..(463): a, c, t, g, unknown or other
  misc_feature (463)..(463): n is a, c, g, or t
tcagatagagtactcacgaccggtgctcgatttagcagtactgcgttggggtttgggggcagaagtctctctcagtccagacacagcatggacatgagggcccccgctcagctcctgggactcctgctgctctggctcccagataccagatgtgacatccagatgacccagtctccatccctccctgtctgcatctgtggganacagagtacaacgtcacttgccggnagtcaggcataacaattattagcctggtatcagcagcataccgagggaaattcctaagctctgaatctaagtgctgcatccgtactttcgacaatcgtacgggttcccagtcgtccggttacagttgggccggtaggaactaagtcggggaacaaggtagttaccaacgtccttaccaaccgtatccgaagtaccaacgccttagacaccgtaccgtagaaacgtattcggttanaccttaaaacctttattaaccttaagttaacgtaaaaacgtttactacttaacccgttttaccccgaacccccttaagttacccccgtaaaccggtttcccgggaaacccgttaaccgggaaccttaacccgggaacgttaacggggaacgttaaacttaaaacccgggaaccctttagggg

SEQ ID NO: 56732 - DNA, 606 bp, Homo sapiens
  misc_feature: GYAE6OF02IMVJD.29.87.H10.1.454.CMB.1.raw
  modified_base (103)..(103): a, c, t, g, unknown or other
  misc_feature (103)..(103): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagatagagtactcacgaccggtgctcgatttagcagtactgcgttgggtttggggcagaagtctctctcagtccagacacagcatggacatgaggccccgntcagctcctgggactcctgactgctctggctacccagataccagatgtgacagtccagatgacccagtctccatccctcctgtctgcattctgtgganacagagtcaacgtcacttggccggngagtcgaggcattaacattattagcctggtatcgagcacgctactccgagggtaacttccgtaagctacctgtactctaactcgctgactacgttcctacgtttcgactaacgtcggtacgggtccctagttccgttacggttacgaggtcggtaccggtaggtacgttgtacggggacgtaggtaacgttcacgttacctaccgtactactacgaacgtccgtacgtccgtcgaccgtacgtccgtagaacgtgttaacgttcgacgttaactttagtacgtacgttaacaaagttctcgtaccttcgaccctagtccgtaccgttccggaacgtacggtacctacgtacgtaggtaactacgtttaaacgcgttacgg

SEQ ID NO: 56733 - DNA, 673 bp, Homo sapiens
  misc_feature: GYAE6OF02F2TAZ.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtggganacagagtcaacgtcacgttcggccgggcgagtcgaggacattaacaattattagcctaggtatcagcagcataccgaagggtaaacgttccgtaacgtcctccgtgtactctatcgctcgctactcctactttgactaacgtcgacgggtaccctagtccgttcggttacgtagggtcgggtcgggtaggtagttaggtagggtacgtaggtacgttacgtaccgttctacctaaccgtactaccgacggtaccacgtccgtcgtaccgtacgtaccgtaggaacgtacgttcggttacgtacttaaactttaacgttaacgttacgttaaacgtaaacgttacttaccgttaccgtttacccgacccctaacgttacccgtaacccggttaccggaacccggtaacgggtacccgtaaccggtaacggttaacgggtaaacgtaaccggttaaaccggtacggttacggg

SEQ ID NO: 56734 - DNA, 717 bp, Homo sapiens
  misc_feature: GYAE6OF02I2IQA.29.87.H10.1.454.CMB.1.raw
  modified_base (208)..(208): a, c, t, g, unknown or other
  misc_feature (208)..(208): n is a, c, g, or t
  modified_base (319)..(319): a, c, t, g, unknown or other
  misc_feature (319)..(319): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggcctcccagataccagatgtgacatccagatcgacccagtcctccattcctccctgtctgacatcgtgtggganacaggactcaacgtcacgttcggccgggcgagtcgaggctaattaacaatttattagcctaggtatcagcagctagtacgaaggtaacttcgtaacgctcctgattactancgctgaccgtatacctcttacgctaacgtcggtacgggtaccctagtcgtcggttacgacggtcggacggttaggtacgttacggtacggggtactaacgggtcgttacctacgttctaccgtaaccacgttacgacggtacctacggtcctacggtaccgtacgtccgtaggtaacgtacgtttacgtacgttaacccgtaaacgtttaccgtttacgtaaacggttaaaccttaaaacggttacctttaaccgttaccccgtttacccgttaacccccgttaacgttaaccccgttaaccccggtttaaccgggaaccccggttaaacggtaccccgtaacggttaaccggtaccggtaaacggttaaacccgttaaaccggtacggttaaccggg

SEQ ID NO: 56735 - DNA, 666 bp, Homo sapiens
  misc_feature: GYAE6OF02FIV07.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccactcctccctgtctgcatctgtggganacagagtcaacgtcacttggccgggcagtcgagggcattaacaattatttagcccgttatcagcagcactccgaagggtaaacgttcctaagcctcctgatctatcgtctcgctacttcctactttcgactaacgtccgaacggggtcccctagttccgttcggttcagggtggtacggggttaggtacgttaaggtcgggaacgtacggtacgttaccgtaccttaccgtaccaacccgttaactaccgacgtccacgtcccgtagaccgtacgacccgtagaaacgtacgttcgttacgaccttaaacgtttactttaacgtacgttaaactaaacgttactaccgttacgtttacccaccccgttatacccgttaaccgttacccggaacccggtaaacgggtaaccctaccggtaacgtacgggtaaagttaaccggttaaacggtaccgttggtaccgg

SEQ ID NO: 56736 - DNA, 763 bp, Homo sapiens
  misc_feature: GYAE6OF02F2K4E.29.87.H10.1.454.CMB.1.raw
  modified_base (206)..(206): a, c, t, g, unknown or other
  misc_feature (206)..(206): n is a, c, g, or t
tcagatagagtactcacgaccggtgctcgatttagcagtactgcgttgggtttgggggcagaagtctctctcagtccagacacagcatggacatggacgggcccccgctcagctccgtggggctcctgctgctctggttcccaggttccagatgcgacatccagatgacccagtctccattcttccgtgtctgtcttctgtcgganacagagtcactatctacttggtcggcgagccgaggtattgttacgtcccttatacgcctggtactcgagacaagaaaccgaggggaaacgccccgaagtccttaccttaattttccgcttcgtccttaccgtagtttcgacgtaggtaggtcggtaccgtccctaacttccgttacgggttaccacggtccgggtactaagggttcggtaacgttccggggttagggggaccctaagggttacggttttacctacgtttcccgtaccgtaaacccgtaacttaacccgtaaacctaccggttccccttacgtaccggtacccgttaggtaaacgtttagtttttaccgaacctttaaaccgttttaacgttacgtttcggtaacgtacggtacggtaacggggttcgtaacccgtttaccgtttccccgttacccgttaccggtttaccgggaccgggttaacgggacccggttaggggtaccggtaccggtaaccgtaaaccggtacgttcggtacggtacctacggaccctaccggattccgttcgtccttaccg

SEQ ID NO: 56737 - DNA, 535 bp, Homo sapiens
  misc_feature: GYAE6OF02HSAKH.29.87.H10.1.454.CMB.1.raw
  modified_base (229)..(229): a, c, t, g, unknown or other
  misc_feature (229)..(229): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (431)..(431): a, c, t, g, unknown or other
  misc_feature (431)..(431): n is a, c, g, or t
tcagatagagtactcacgaccggtgctcgatttagcagtactgcgttgggttttggggcagaagtctctctcagtccagacacagcatggacatgagggcccccgctcagctcctgggactcctgctgctctggctcccagataccagatgtgacatccagatgacccagtctccatccctccctgtctgcatcgtgtgggagacagagtcaacgtcacttggccgggnagtcgaggcattaacaatttattgcctggtatcgagcagcatccgaagggaaacttccgaagcctccgtgtactctatcgctgctactcctatttcgactaagtcgacgggtcccagttctcggttcagtggcggtgagtagtgggacagtacgttcnctcctacacgtancagcgagtcctgccgtagtccctaggaagtntgtacgactacttacgttactagtaacaacgtaatccgtacttcgaccctagtcctaccgtacgaccgaacggaccacggtacgagtacgaacttacgattcgg

SEQ ID NO: 56738 - DNA, 577 bp, Homo sapiens
  misc_feature: GYAE6OF02IGEY7.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttggcccggggagtcgaggcattaacaattatttagcctggtatcagcagcatccgaagggaaacgttcctaagctcctgactctatgctgctatcctactttgacatcgagggtccctatctcggttcagtggcggtggagtagtggacgtagtagttctactctacaccatacagcacgcctgacgacgtccgtagaagtagttgttacgtacctaaactttacttacttagtaacgtaaaagttacttaccttactttaccgtacccctacgtaccctaacccgttaccggaacccgtaacgggaccgtaaccggtaacgtacgggtaacgtaaacgttaacggtaacgttacggg

SEQ ID NO: 56739 - DNA, 613 bp, Homo sapiens
  misc_feature: GYAE6OF02GIJ6H.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcaggcattaacaattattagcctggtatcagcagcactaccgaagggtaaacgttcctaagctcctgactctatgctgcactcctatttgactaatcgacgggtcccagttcgttcgttcaggtggcggtggatagtgggacagtagttcactcgtacaccgactcgacgccacgcctgcacgtaccgtagaacggtattcgttacggacttaactttacgtttaccgttagttaaacctaaaaggttaacttaccttaaccgtttcccgaccccctaacgtttacccgtaacccggtttcccggaaccgtaaaccggggtaacctaaccgggttaacgttaccgggaacgttaaaccgtttaaaccggaaccgtttaacggg

SEQ ID NO: 56740 - DNA, 808 bp, Homo sapiens
  misc_feature: GYAE6OF02I098Q.29.87.H10.1.454.CMB.1.raw
  modified_base (223)..(223): a, c, t, g, unknown or other
  misc_feature (223)..(223): n is a, c, g, or t
  modified_base (333)..(333): a, c, t, g, unknown or other
  misc_feature (333)..(333): n is a, c, g, or t
tcagatagagtactcacgaccggtgctcgatttagcagtactgcgttgggtttgggggcagaagtctctctcagtccagacacagcatggacatggacgggcccccgctcagctccgtgggacctcctgctgctctggcctcccaagataccagatgtgacatccagatcgacccagtcctccactccctccctgtccgtgacacgttcgtagggtcgggaanacgaggtacgttaccgaaacgttccaaccgttcgggacccggggacgtacgtaccggaggggtacctaaagtttaaacctaagtttaactttacggccgttaggttaacncgacgcaagccaacttacggaaggggtaaactttacccaaggtcctaccgtagtacttacctagtcggttcctacggtacctaatacccgttacttggaacctaacggtccggtacgggtacccttaacgttcggttacggtacgtacgggttacggtacgggtacggttaacgtacgggttacgggaactaaggttaaccgttctaccgttaaccgaccaaacccttatacgggtacctaaccgtcgtacccgtttacggaccgttaacggcccgttaaagggtaaccgttaaggttcgttaccggtaacctttaaactttaacggtttaacgttacgtaaaacgtaaactttaccgttaacgtacctttaccccgacctttaaccggttcctaacccgggttccgaaaccgttaaccgggaactacggttaacccggtagttaaaccgtaacgttaaacggtccggttaacgg

SEQ ID NO: 56741 - DNA, 534 bp, Homo sapiens
  misc_feature: GYAE6OF02FQLG5.29.87.H10.1.454.CMB.1.raw
  modified_base (348)..(348): a, c, t, g, unknown or other
  misc_feature (348)..(348): n is a, c, g, or t
tcagatagagtactcacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctggcgagagggccaccatctactgcaagtccagccagagttcttttcacacaaccaatgagaagaactacttaagcttggtaccagcagagaccaggacaacctcctaagttgctcttttactgggctcttcccgggagtcccgggggtccctgaccnttcagtgccagcgggtctgggacagacttcactcctcaccatcagcggcctgcagctagaagatgtggctagtttatactgtcagcagttgttttggccggtttcttcccgacgttttcggcggtagggtaccagggtggtacggtacgaaacgtacgtgtggactgacaccgatcctgtccttac

SEQ ID NO: 56742 - DNA, 921 bp, Homo sapiens
  misc_feature: GYAE6OF02HLB7I.29.87.H10.1.454.CMB.1.raw
  modified_base (207)..(207): a, c, t, g, unknown or other
  misc_feature (207)..(207): n is a, c, g, or t
  modified_base (242)..(242): a, c, t, g, unknown or other
  misc_feature (242)..(242): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctcgtggctcccagataccagatgtgacatccagatgacccagtctccatccctccctgtctgcatcgtggtaggganacgaggagtaccgaacgttcacgttcggccggggntaggtcgaggggctaagtttaggtaagtttaagtttacgtccgttggtttacaggaccgtaaacggaaaaccggaacgggggaaaacccgtacccccttaaaacgttcccgtagtaacgttccctaaccgccgtacggtacctaaccgttaccctaacgttttcggacctaaccggtacgggttccgggggtaccccgtttacgtacggggtttaccgaacgggtcccggtacgaacgggaccgggttacgttaccggtaacgggggtaaccgtaacggtttacttttacccgaaccgtttaccgtccctaaaccgtcgtaacgaccgtaccgtacggtacccttcggaaccgtaccggttaccgtaaggtaacggttacgtttcggttaacgtaacccttttaaaccgtttacgtttaaccgttaaccggttaacctaaaacccgttaaggttaacccgtttttaaacgtaaaccccggtttaaacccccgttttaccggtttaaccgggtttttaacccggtttttacccggggggaaacccggttaacccgggggggtaaacccgttaaacggggggttaacggggtaaaccgttaaaccggttaaaacccggaaaacccggtttaacgggttaccgggttaaccgggttacccgtacggtaacccccgtaaccgg

SEQ ID NO: 56743 - DNA, 565 bp, Homo sapiens
  misc_feature: GYAE6OF02G31EX.29.87.H10.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (374)..(374): a, c, t, g, unknown or other
  misc_feature (374)..(374): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctgtggganacagagtcaacgtcacttggccgggnagtcgaggcattaacaattattagctggtatcagcagtcatccgaagggtaattcctaagcctcctgactctatcgctgctactctactttgactaatcgacgggtcctagtcgtcggttcaggtgggtcggtaggtataggtggganaggtagttcactctactacatcacgcacgcctagcacgtccaagagtagttggtagtaccttaaacgttactttacgtacgttaaacgtaaaagttacttcctaaccgtttccgacccctacgttcctaacccggttacggaacccgtaacgggactaaccggacgtcggtaagtaacttaacgagttcgg

SEQ ID NO: 56744 - DNA, 548 bp, Homo sapiens
  misc_feature: GYAE6OF02G7EF6.29.87.H10.1.454.CMB.1.raw
  modified_base (201)..(201): a, c, t, g, unknown or other
  misc_feature (201)..(201): n is a, c, g, or t
  modified_base (523)..(523): a, c, t, g, unknown or other
  misc_feature (523)..(523): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcaggcattaacaattattagcctaggtatcagcagcatccgaggggtaaagttccgtaaagcctcctgacgtctatgactgcacttcctactttgacaagtcgtacggggtccctagttcgtcggttcagtgggcgggtaggtagtaggtagggacgtaggtacgttcactctacctacctagtcaacgccagccctgaccagcctaggagtacgttgttacgactaaactttcgttactagtactaaagtctacgtacttccgaccctagtcctacctcggaccgacgganacgagtcgaagtaacttacgagtgg

SEQ ID NO: 56745 - DNA, 895 bp, Homo sapiens
  misc_feature: GYAE6OF02IUCUN.29.87.H10.1.454.CMB.1.raw
  modified_base (105)..(105): a, c, t, g, unknown or other
  misc_feature (105)..(105): n is a, c, g, or t
tcagatagagtactcacgaccggtgctcgatttagcagtactgcgttgggtttggggcgagaagtctctctcagtccagacacagcatggacatgagggccccgntcagctcctgggactcctgctgctctggctcccagactaccagatgtgacatccagatcgacccagtcctccattcctcccgtgtcctagcatcgtggtcgggaacacagtaacgtccaaccggttctacgttcgggacccgggagtacgggtacgaacggggtactaaacgttaaacgtaatttacgtttacgtaccgttaggttaactacgaggaccacggacctaacgttacccggaaagggttaacgtttcctaagtccttaccgtaggtaacttacgttaacgtcgtaccgtttacggactaacttccccgttaacgtttacgacgtaaacgtttcccgggaaccggggtttacccctaacgttttcccggtaccgggtttaacgaacggggtttccggggaccgggtttaacgggtaactttaacgggtaccggggaaactacgggttaacgttcccgtaacccgttacgtacccgtaaacgtaacgttccggaaacggtcctacgggtaccttacggtacgaccggtaacccgttaggaaacggttagtttaccggttaccgttaaaccgtttaacgtttaacgttacccggttaaagtaaaccggttaaaacggtttccgttaacccgtttaccccggttacccggttaccccgtaaacggttaccccggttaaacccgttaccgggggaaacccgttaaaccgggtacccgtaacccggttaccgggtaacgggttaaacccgtaaacccggttttaaaccgggcccgttttaacccgggg

SEQ ID NO: 56746 - DNA, 570 bp, Homo sapiens
  misc_feature: GYAE6OF02HAS5Z.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctcatccctccctgtctgcatctggtggganacagagtcaacgtcacttgccgggcgagtcgaggcattaacaattatttagcctggtatcagcagcatccgaagggtaaagttccgtaaggacctcctcggatactatgctgcactcctactttgcaagtcaggggtcccagtcgttcggttcagtgggcggtggtatagtgggtacaggtagttcactctcacactcacgcacgcctcgcacgcctagagtatgttacacgtaacttagttacttagttaactaaaagttataccttaccgtttacgacccctacgttacccgtacccgttaccggaccgtaaacgggtacccgtaacgtacggtaaggaacgttaacgttaacgtaacgttacggg

SEQ ID NO: 56747 - DNA, 740 bp, Homo sapiens
  misc_feature: GYAE6OF02HQQ01.29.87.H10.1.454.CMB.1.raw
  modified_base (203)..(203): a, c, t, g, unknown or other
  misc_feature (203)..(203): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagataccagatgtgacatccagatgacccagtctccatcctccctgtctgcatctggtggganacagtacgtcaacgtcacgttcggccgggacgagtcgagggactaattaactaatttatttacgcctaggtatcagcagcatccgaagggtaacttcctaagtcctccgtagactctagtgactgcctactcctactttcgacctaacgttacggaccggggttaccctagttacccgtttcgggttactaacggggttcggggtacgggttaggtaagtttacgggtacgggggtaaccgtaaaggtaccggttttaccctaaccgtccgtaacccgtaaccgtaacgttaccgacggtaccgaccggttcccgtaggtacccgtaccggtacgtacggaaacgtcgtttaggttaccgtaacgtaaccgttttaagttaccgttacgttaaaacctaaaacgttcttaacccgttacgtttaccccgacccgttaacgtccccgttaacccggttacgggaacccggtaaacgggtccccgttaacggtaacggtacgggtaaacgttaaccggtttaaaccggtattaccgggg

SEQ ID NO: 56748 - DNA, 571 bp, Homo sapiens
  misc_feature: GYAE6OF02G0AN9.29.87.H10.1.454.CMB.1.raw
  modified_base (394)..(394): a, c, t, g, unknown or other
  misc_feature (394)..(394): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggagacagagtcaacgtcacttggccgggcgagtcaggcattaacaattatttagcctggtatcagtcagcatccgaagggtaacgttccgtaagcctcctgtactctatgtctgcactcctactttgctaagtcgacgggtcccatcgtcggttcagtgggcggtggtatagtgggacagtcgttcactctcacctntcacgcgacgccgtgccgacgtccgtagaacgtgtcgttacgacttaacgtttacttacgttagtaaacctaaagttaaccttcgtactttaccccgcccttacgtacccgtacccgttaccggaccgtaacgggacctacggacgtacggaacgtaacgtaacggtacgttacggg

SEQ ID NO: 56749 - DNA, 699 bp, Homo sapiens
  misc_feature: GYAE6OF02IZC14.29.87.H10.1.454.CMB.1.raw
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
tcagatagagtactcacgaccggtgctcgatttagcagtactgcgttgggtttgggggcagaagtctctctcagtccagacacagcatggacatggacgggcccccgctcacgcctcctgggacctcctgctgctcgtggctcccagataccagatgtgacatcagatgacccagtcctcactcctcctgtcngcatctgtaggganacagacgtcaacgtctacgttcggccggganacgtcaggctaattaaactaattacttaacgtaccttggtacgtccaagactacgactaacgtaccgtaaggggtaaacttacctaacggcctaactcggaatccgttaattcgcgttagcctaacttccgtaactttcggactaaacgtcggtaaccgggtacctacgttacctccggtttagtacgggtcgggtacgttacggaattacgtgggaaccgtagggttaacgttactaccgttactccaacacttacgaacgtcaacgtcctcgacgtaccgtacgtaacgtaacgaagtttggtacgtaacgtaaacttaacgttacgttaccggttaaagtaaaacttacgtaaccgttaccctttaccgaaccctaacgttcccgtaaaccgttcggtaacccggaacgttaacccgaacggtcgtagaaacggttaacgtaaaccgtacggttacgg

SEQ ID NO: 56750 - DNA, 560 bp, Homo sapiens
  misc_feature: GYAE6OF02GPKFN.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcgaggcattaacaattattaagcctggtatcagcagcatccgagggaaacgttcctaagcctcctgtatctatgctgctactcctactttgctaagtcgacgggtccctatccgttcggttctaggtggtcgggtggatagtgggacgtagtacgttacactctcactactcagcacgtccgtagcagcctagacgtagtgtcgtactaatttacttacgttgtacaacgtacgtacttaacgttaccgttacccttaccgtaaccttacgtttacggaccgtaacgggtacgtaacggttagacgtaataacgtaacggacttacggg

SEQ ID NO: 56751 - DNA, 627 bp, Homo sapiens
  misc_feature: GYAE6OF02FUOVU.29.87.H10.1.454.CMB.1.raw
  modified_base (202)..(202): a, c, t, g, unknown or other
  misc_feature (202)..(202): n is a, c, g, or t
  modified_base (429)..(429): a, c, t, g, unknown or other
  misc_feature (429)..(429): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtcctccatcctccctgtctgcatctgtggganacagagtcaacgtcacttggccgggcgagcaggcattaacaattattagcctggtatcagcagcataccgaagggtaaacgttcctaagtctcctagatctatgctgctattccgtactttgacaacgtcgacggggtccctatccgtcgttcacggtgggtcggtggtatagtcgggaactaggtagttcacttcgtaccaccatacacgtcaacgtccgtgaccncggaccttagaaacggtattaggttacgtaaccgttaacgtttaacgtttacttaacggtaaactaaaacgttactaaccctttaccgtttcccgaccccttaagttaccgttaaccccgttaccgggaacccggtaaacgggaaccctaaccggacgttaaccgggaacgtaacgtttaaaccggacttaaccgggg

SEQ ID NO: 56752 - DNA, 691 bp, Homo sapiens
  misc_feature: GYAE6OF02FUTHM.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtggganacagagtcaacgtcacttgccgggcgagtcgaggcaattaacaattattagcttggtatcgagcagcatccgaagggtaaacgtttccgtaaagccttccgtaggtacttacgttatcgtcgtcgacctacttccttactttcgactaacgtcggtaacggggtccctagttccgttcggttcgtacgggttcgggtcgggtaggtaagtacggtgggaacgtaggtacgttcaccgttcgtaccctaccacttaccgacgccacgtccgtcgaccacggtccgtaggtaacgtagttcggttacgtaaccttaacgttttaacttacgtttaacgtaaacgttaaaaagttaccgttacttacccgtttacccgtacccccgttacttaacccggttacccgttacccgggtaaccggtaaacgggtaacccgtacggtaaccggttacgggtaaacgtaaaccggttaaaaccgtacggttaacggg

SEQ ID NO: 56753 - DNA, 500 bp, Homo sapiens
  misc_feature: GYAE6OF02GTW0I.29.87.H10.1.454.CMB.1.raw
  modified_base (201)..(201): a, c, t, g, unknown or other
  misc_feature (201)..(201): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattatttagcctggtatcagcagcatccagggaaagttcctaagctcctgatctatgctgcatccacttttgctaatcacggggtcccatctcggttcagtggcggtggatagtgggacaggagttcactctcaccatcagcagcctgcngccngagattgtnctaactttatacttgtacaaagttatactactttcgaccccatcctaccttccggaccaacgggtacacgacgtcggaagaattaacgatacgg

SEQ ID NO: 56754 - DNA, 702 bp, Homo sapiens
  misc_feature: GYAE6OF02H0C16.29.87.H10.1.454.CMB.1.raw
  modified_base (106)..(106): a, c, t, g, unknown or other
  misc_feature (106)..(106): n is a, c, g, or t
  modified_base (206)..(206): a, c, t, g, unknown or other
  misc_feature (206)..(206): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggcctcccagactaccagatgtgacatccagatgacccagtcctccatccctcctgtctgcatcgtggtggganacagagtacaacgtccacgttggccgggtcgagtcgagggctaattaactaattattagtccgtaggtatcgagcagacacgtaccgaagggtaacgttacgtaacgtcctaccgtgacttctatcgctcgactactacctacgtttgacctaagtccgtacgggtccctacgttcgttacggtcgtaggtcgggtacggtaggtagtacggtacgggacgtaggtaccgtttaccaccgtcctaccgtaaccctaggtaccaaccgtacaccgtccgtcgaccgacggtacctaggaacgttagttaccgtactaccgttaaatttaccgttacgtaacgttaaccgaaaagtttaccgtaccctttaaccgtttccccgaaccccgttacgttacccgttaacccggttacccgggaaacccggttaaccgggaccgtaaccggtaccggttaacggtaaccgttaaacggttaacccggtaaggttacccggg

SEQ ID NO: 56755 - DNA, 667 bp, Homo sapiens
  misc_feature: GYAE6OF02IH2PS.29.87.H10.1.454.CMB.1.raw
  modified_base (236)..(236): a, c, t, g, unknown or other
  misc_feature (236)..(236): n is a, c, g, or t
tcagatagagtactcacgaccggtgctcgatttagcagtactgcgttgggtttgggggcagaagtctctctcagtccagacacagcatggacatgagggccccccgctcagctccctgggactcctgctgctctggctcccagataccagatgtgacatccagatgacccagtctccatcctccctgtctgcagtcgtgtgggagacagagtacaacggtccacgttggcccgggngacgtcgagggcaattaactaattacttagcctgtaatcagtcagctatccgaaggtaacgttacctaacgcttccgtagactactactgtctgactaactcctagtttcgactaatacggtaacgggtccctaattccgttacggttcgaaggttcggacggttggtaataggtacggaacgtaaggtacgttacacgttaccactaacctaactcaacgtcgtaaccgtccgtacgacgtacgtaccgtaggaaccgttagtacggttacgaaccgtaaaccgtttattaacgttaccgttaacgaaaattaccttaaccgtaaccgtttcccgacccgttacctacccgttaacccgttccggaacccgtaaacggaacccgtaacggtaccggttaggaacggttaaacttaacccggtattaacgg

SEQ ID NO: 56756 - DNA, 508 bp, Homo sapiens
  misc_feature: GYAE6OF02GACQ9.29.87.H10.1.454.CMB.1.raw
  modified_base (202)..(202): a, c, t, g, unknown or other
  misc_feature (202)..(202): n is a, c, g, or t
  modified_base (318)..(318): a, c, t, g, unknown or other
  misc_feature (318)..(318): n is a, c, g, or t
  modified_base (437)..(437): a, c, t, g, unknown or other
  misc_feature (437)..(437): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtggganacagagtcaacgtcacttggccgggcagtcgagggcattaacaattattagcctggtatcagcagcatccgaagggaaagttcctaagctcctgatctatgctgctatcctatttnacaatcgacgggtccatcgtcggttcaggtggcggtgatagtggacgtagtagttcactctcaccatcagcagcctgcagcctagatgtgtacactaacttatacgtagtactaaagtntctacttcaccctatcctacgttccgaccgtaaggaccacgtacgtaggaactaacgttaacgacgtacgg

SEQ ID NO: 56757 - DNA, 721 bp, Homo sapiens
  misc_feature: GYAE6OF02IDE1V.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtctccactcctccctgtctgcatctggtaggganacagagtcaacgtcacgttggccgggagacgtcgagggtactaagttaaactaatttattacgtcctggtaactcgaggcagctacgtaccgaagggtaaacttccgtaagtcccttaccgtagtacttactagtcgtactcgactacgtaccttacgtttacgacctaacgtccggtaccggggtaccctacgttccgtttacgggttacctaggggttccgggtacgggttacgggttaacgtacggtacggggaactagggtaacgtttcctaaccgttaccgtacaacccgtataccgacgtacgtacgtccgtacgagacccgtcgtaaggaacgttcgttggttacgaaccttaacgtttacttaaccgttagtaaacgtaaaacttctaacttacccgttacccgtaccccgttaccttacccggttaacccgtcccggaaaccggtaaaccggtaccgtacgtaacggttacggtaaaccgtaacggtttaacccggaacgttaccgg

SEQ ID NO: 56758 - DNA, 663 bp, Homo sapiens
  misc_feature: GYAE6OF02F228K.29.87.H10.1.454.CMB.1.raw
  modified_base (104)..(104): a, c, t, g, unknown or other
  misc_feature (104)..(104): n is a, c, g, or t
  modified_base (206)..(206): a, c, t, g, unknown or other
  misc_feature (206)..(206): n is a, c, g, or t
  modified_base (362)..(362): a, c, t, g, unknown or other
  misc_feature (362)..(362): n is a, c, g, or t
tcagatagagtactcacgaccggtgctcgatttagcagtactgcgttgggtttgggggcagaagtctctctcagtccagacacagcatggacatgaggccccgntcagctcctgggactcctgctgctctggctcccagactaccagatgtgacatccagatgacccagtcctccatccctccctagtctgctatcgtgtaggganacagtagtccaacgtcacgttggccgggctagtcgagggactattaaacactttagttacgccgttaggtactcgaggactagactacgtaccggaaacgggttaacgttaccccgtaaagtcccttaccgtagtacttacctagttcggactacncgtaccttacctctttacggaacacgtcgtaccgggttcctacgttccgtacggttcgagggtacggtacggttagaagttcggtagggtacacggttacgtacgacgttcctaccgtacgtacgtaccgcgtactacggtccctaggaccgtaacgtccgtagtaactagttcgtacgtacgtttaacttactacgttataacgtaaagtactaccttcgttcccacccgtattccgtaaccgttccggaacgtacggtaactaccggtactacgggttaacaacgtttaacgattcggg

SEQ ID NO: 56759 - DNA, 819 bp, Homo sapiens
  misc_feature: GYAE6OF02ID39X.29.87.H10.1.454.CMB.1.raw
tcagatagagtactcacgaccggtgctcgatttagcagtactgcgttgggtttgggggcagaagtctctctcagtccagacacagcatggacatggacgggccccccgctcagcctcctgggacctcctgctgctctggcctcccagataccagatgtgacatccagactcgacccagtcctccactccctccctgtctagcctattcgtggtgggaacacgaggtacgtaccaaacgtctacgttcgggacccgggtgtaggtacgaagggtctaagttaaactaatttacgttcggaccgtagtaatcagcagtccacgtaccgaagggtaacttccgtaagcctcctagactcgtatcgctgacctactcctagttacgacgttacgtcggtacggtccctagttccggttcggtagtacggtcgggtacgggtagtaacggtacggtaacggtacgtacggtacgtttacccgtaccgttacccgtaccgtaacctacgtaccctacggcccggtaccgttacccgtaccgtaccggtaaccgtacccgggtaagtaaccgggttaacgttccggttaaccgtaacccgtttaaacggtttttacctaaaccgtttaacgtaaaccgttaaaacggttccctttacccgtttaacccctttccccgtaacccccgtttaaccgttacccccggtttaaaccccggtccggggtaaacccggtaaaccgggtaaccccggtttaaccggtaaccggttaaccggggttaaaccgtttaaaaccccggtttaaccgggttaaccgggttaacccggg

SEQ ID NO: 56760 - DNA, 709 bp, Homo sapiens
  misc_feature: GYAE6OF02F1H0H.29.87.H10.1.454.CMB.1.raw
  modified_base (208)..(208): a, c, t, g, unknown or other
  misc_feature (208)..(208): n is a, c, g, or t
tcagatagagtactcacgaccggtgctcgatttagcagtactgcgttggggtttgggggcagaagtctctctcagtccagacacagcatggacatgagggcccccgctcagctcctgggactcctgctgctctggctcccagataccagatgtgacatccagatcgacccagtcctccactccctccctgtctgcatcgtggtggganacagacgtcaacgtcacgttcggccgggcgacgtcgagggtctaattaaactaatttatttacgccgttaggtactcgagcagcagtaccggaagggtaaacttcctaaggccttaccgtagacttctagtcgtctgcctacttccgtactttacgacctaagtccggacgggtaccctagttcgttacggttcgagggtcgggacggtagtacgtaggtcgggacgtaggtacgttacctacttccgtaccacctacgtaccgtacgaccgtaccggtcctacgaccgtaccgaccgtaaggtaacgttacgttacgtacgtaactttaaacttttacgttaaccgtaacgttaaaccgtaaagttaccttaccgttaccctttcccggaccccttaagtttaccccgtaacccggttacccggaacccggtaaacggtaccccgtacggttaaccgggttacggtaaacgttaaacccgttaaccggtacgttaacggg

SEQ ID NO: 56761 - DNA, 648 bp, Homo sapiens
  misc_feature: GYAE6OF02IW7F3.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctgtggganacagagtccaacgtcacgttggcccgggcgagtcgaggctattaactaattattacgtcctggtatcagtcagctactaccgaaggggtaagttaccgtaacgccttacctagtactcttagtcgtctcgactacttaccctacgtttgactaatccgtacggggtccctagttccgttcggtacgtaggtcgggcggttaggagttaggtacgggactacggtagtcctacttacctacacctatacacgtccgaacgtcctcgtactacgccgtacgtaagtagttacgttacgaccgttaacttaacgttacgttacgttaaactaaacgttactacctttaaccgttccgtacccctacgttcctacccggttccggtaacccgtaacggaaccctacggtaccgttaggaacggtttaacgttaaccggtaagttaccggg

SEQ ID NO: 56762 - DNA, 685 bp, Homo sapiens
  misc_feature: GYAE6OF02HJ6BR.29.87.H10.1.454.CMB.1.raw
  modified_base (106)..(106): a, c, t, g, unknown or other
  misc_feature (106)..(106): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctccctgtctgcatctgtgggagacagagtcaagtcacgttgccgggcagtcaggcatacattattagctggtatcagcagcaatccgaaggtaaacgttccgtaagccttcctagatctagtcgctgacctaatcctaacgtttacgactaacgttcgaacggggttccctagttccgttacggttccgaaggttcgggtacgggtaggtatacggttagggaacgtaacgtacgtttacgaaccttcgtaccgaactacgttacgacggtaccacgttccgtgccgaaccgtcgtaaacggtaaggttaattcgggttaactaccgttaaactttaacgtttaaccgtagttaaacgtaaacgttaaccgttaccttaaccgttttaccccgaaccccttacgtaaccccgttaccccggtttaacggaaccccggttaacgggaacccttacggaaccggttacgggtaaacttaaaacggtttaaccggtaaacgttcccggg

SEQ ID NO: 56763 - DNA, 780 bp, Homo sapiens
  misc_feature: GYAE6OF02IUYPH.29.87.H10.1.454.CMB.1.raw
  modified_base (106)..(106): a, c, t, g, unknown or other
  misc_feature (106)..(106): n is a, c, g, or t
tcagatagagtactcacgaccggtgctcgatttagcagtactgcgttgggtttggggcagaagtctctctcagtccagacacagcatggacatgacgggcccccgntcagctcctgggacctcctgctgctctggcctccagactaccagatgtgacatccagactgacccagtcctaccatccctcctgtctgcctattcgtaggtacgggacaccgaggtacgtaccgaaacggttcaaccggttcggacccggggccgtaaggtccgaaggggacctaaagttaaaccgtaagtttacgtttaacggcccgttaggttaactccagtaccgaaggctaactaccggtaaacgggtaaactttccaaacggtcctacctaggtacttacgttactcgtcccgttaagtcctaacttcccgttaaacgttcgtaaccgtaaacgttccgggtaaaccgggttccccttaacgttccggtttaccgggttacgtaacggttcggggtacgggtaagttacgtaacggttacggggaacccttaaagggttcgtttaccaacgtttacccgaccggtaactaacggttcccggaagtacccacggttacccgtgggaccttaacggaccgttaaggaaggttaccgtgttaaccgtacccttaaatttacgtaacgtaacgtaagtaaaactccttacgtaccttcccgacccgtagttccaaccggttccggaacgaaccggacgactaacgtcgaaacgtttaactaacggtataccgg

SEQ ID NO: 56764 - DNA, 735 bp, Homo sapiens
  misc_feature: GYAE6OF02FOV02.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattattagcctggtatcagcagcatccagggaaagttcctaagcctcctgatctatgctgctatccactttcgactaacgttacgacgggggttcccagttccgttcggttccgtaacggttgggtcgggttagggacgtaagtcggggactaaggaacggtttcctaaccttccgttacaacccgtactacccgaacgcaacggtcccgtcgtaccacggtacccttcggaaacggtacgttacggtttacggaccgttaaacgttttaacgttttaaccgtttacgttaaaccgttaaaaacggttaacttaaccgttaacccgtttttacccgacccccccgttaaccgtttaaccccgtaaccccggttttacccggggtaaacccccggttaaacgggggtaaccccgttaaccccgggtaaccggttaaccggggtaaaccgggtttaaacgtttaaaaacccccgggtaaccgtttaaaccgggg

SEQ ID NO: 56765 - DNA, 736 bp, Homo sapiens
  misc_feature: GYAE6OF02HOKV9.29.87.H10.1.454.CMB.1.raw
  modified_base (108)..(108): a, c, t, g, unknown or other
  misc_feature (108)..(108): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
  modified_base (328)..(328): a, c, t, g, unknown or other
  misc_feature (328)..(328): n is a, c, g, or t
tcagatagagtactcacgaccggtgctcgatttagcagtactgcgttgggtttgggggcagaagtctctctcagtccagacacagcatggacatggacgggcccccgntcagctcctgggacctcctgctgctctggcctcccagataccagatgtgacatccagatcgaccctagtcctccatccctccctgtctgctatcgtggngganacagtcgtacaacgtcacgttggccgganagtcgaggctaattaactaatttattagccttggtactcgagcagcagtaccgaagggtaacgttccgtaagcctccgtagactctancgtctcgactactcctatttcgactaagtacggtacgggtaccacgttcgtcggttcgtacggtcgggtacgggttagtagttacgggtacggaacgtacggtacgtttaccgtaccttaccgtaccgaacctactacgaacgtaccgtacgtccgtacgaccgtaccgtacgtaggtaacgttgttacgttaaccgtactttaaaccgtttagttaaccgttaacgtaaaccgttaaaacgtacctttaacccgttaacccgttacccgtacccccgttaaccgttacccgttaacccccggtttaacccgggtaacccggtaaccgggttaaacccgtaccgttaaacccggggtacgttaaacccggtttaaaacggttaaacccggtaaaccggttaaccgggg

SEQ ID NO: 56766 - DNA, 648 bp, Homo sapiens
  misc_feature: GYAE6OF02IQFI6.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcgaggcattaacaattatttagcctggtatcagcagcactccgaagggaacgttcctaagctcctagactctatgctagcatcctactttgacatcgtacgggtaccctagtccgttcggttacgaggtcggacggtggtataggtcgggacaggtacgttcgtactcctacaccagtaccgagccgtacgccgtacgacgtacgtacgtacggaagtagttcgttacgtaaccgttaacttttaacgtttacgttaagttaaaccgtaaaagttaccgttaccctttaaccgttacccgtacccccgtaacttcccgtaaccccggtttacccgggtaacccggtaaccggtaacccgaacccggttaccggttacgggaaaccggttaaaccgttaaccgggtaacgttaccgggg

SEQ ID NO: 56767 - DNA, 555 bp, Homo sapiens
  misc_feature: GYAE6OF02GKBTY.29.87.H10.1.454.CMB.1.raw
  modified_base (106)..(106): a, c, t, g, unknown or other
  misc_feature (106)..(106): n is a, c, g, or t
  modified_base (202)..(202): a, c, t, g, unknown or other
  misc_feature (202)..(202): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (488)..(488): a, c, t, g, unknown or other
  misc_feature (488)..(488): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctcatccctccctgtctgcatcgtgtgggancagagtcaacgtcacgttgccgggcgagtcgaggctaattaaacattagttagccgtggtatcagcagcacgtccgagggtaaactctaagctctagatctatgaccttgactactcctacttgacaacgttcggacggtccagttcgtacgttcgaggtcggtcggtaggtatagcgganaggtattcncgttctcaccactcagcgtacgcgtcgacgcgcgtagacgagttcgttacgtacttaacgttattacgttagtacgtaaattctacgtacgttccnccctacgtcctaccgtaccggaccgtaacgacgtaacgacgtaggaacgtaacgttaacgcttacgg

SEQ ID NO: 56768 - DNA, 837 bp, Homo sapiens
  misc_feature: GYAE6OF02IEH6R.29.87.H10.1.454.CMB.1.raw
  modified_base (207)..(207): a, c, t, g, unknown or other
  misc_feature (207)..(207): n is a, c, g, or t
tcagatagagtactcacgaccggtgctcgatttagcagtactgcgttgggtttggggcagaagtctctctcagtccagacacagcatggacatgacgggcccccgctcagctcctgggactcctgctgctctggcctcccagataccagatgtgacatccagatcgacccagtctccatccctcctgtctagcattcgtgtaggganacgagtacgtacaacgttcacgttggcccgggagagtccgagggactaaagttaaactaatttacttacgaccgttaggtactcgaagacctagactaagtaccgaaaggggttaaacttccgtaagccttaccgtagacttacgttaacgcgtaccttacgactactaccgtactttacgactaagtccggacggtacctaagttccgttacggttacgagtcgggtagggttacgaatttacggtacggaactacggttacggttaccaccgttaccctacgtaacctagtaccgaacggtacctaacggtccttacgaccgaaccgtacgtaacggaaaacggttcgttaccggtttaacgtacccgtttaaacgttttaaccgtttaaccgtttaaacggttaaacccgttaaaaaacggttacgttttaacccttaaacccggttttaccccgtaacccccccgtttaagttaacccccggttaaccccggttttaaacccgggtaaccccggttaaaaaccgggggttaaccccgtaaacccgggtaaacggggttttaaaacccgggtaaaacccggttttaaaaacccggtttaaaacccgggtcccgtttaaaaccggggg

SEQ ID NO: 56769 - DNA, 744 bp, Homo sapiens
  misc_feature: GYAE6OF02IBZ16.29.87.H10.1.454.CMB.1.raw
  modified_base (398)..(398): a, c, t, g, unknown or other
  misc_feature (398)..(398): n is a, c, g, or t
tcagatagagtactcacgaccggtgctcgatttagcagtactgcgttgggtttgggggcagaagtctctctcagtccagacacagcatggacatggacgggcccccgctcagctcctgggactcctgctgctctggcctcccagactaccagatgtgacatccagatcgacccagtcctccattccctccctgtctcgctattcgtggtgggagacagacgtacaaacggtcacgttcggcccgggagaacgtcgaagggacctaagttaaactaaatttaactttacgtaccgttagggttacttacgaagcgacgctaactacccggaagggtaaactttaccgtaaacggccttaccgttagaacttacgtactgcgtgactactcctaactttnacaaacttcggaacggggttccctacgttccggttcggttaccgtaaggtttcgggcgggttacggtaaggttaacggtccggggtaagtaacgggtacgtttaccgtaccgttcctactaccgtactacgacggtaccacgtccgttcgaccggtacgtccgtaagtaacggtactttaggttacgtaccttaaacgtttacttagttacgttaaactaaaaggtaccttaacgtaccgtttaccgaccccgttaacgtacccttacccgttccggtaaacctaacgggaaccgttacggacggttaacggaaaggtttaaccttaaacgggtaccgtttacggg

SEQ ID NO: 56770 - DNA, 721 bp, Homo sapiens
  misc_feature: GYAE6OF02GHPCE.29.87.H10.1.454.CMB.1.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctggtgganacagatcaacgtcacgttgccggngagtcgaggcattaacattattagctgtatcagcagcacgtaccgaagggtaaacttacctaacgctaccgtgtacttcgtatacgtctagtactactaccgtactttacgactaacgtaccggtaacggggttcccctaacgttccgttccggttacgtaggttcggggtacgggttggacttaggtacggggtaacgtaacggtcggtttaccaccgtttacccgaccgttaacctacgttaccgtacggccgaacggtccgtacgtaccgtacggcccgttaaggaacgttagttacggtttacgtaaccgttaaacgttttaaccgttaacgttaacgtttaaaccgtaaaagttaacttacccgttaaccgtttcccgaacccccgttacgttaccccgttaacccggttacccggtaaaccggtaaccggtaccgtaaacccggtacggtaacggtaaccgtttaaacggttaaaccggtagttaaccggg

SEQ ID NO: 56771 - DNA, 805 bp, Homo sapiens
  misc_feature: GYAE6OF02HVRQY.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagactaccagatgtgacatccagatgacccagtctccatcctccctgtctgcatctggtgggagacagagtcaacgtcacttggccggtagagtcgaggcaattaactaattattagccgtaggtactcgagccagcactaccgaaggtaaacgttcctaagccttaccgtagtactacttagtcggtcctagactacttacctacgttacgacgtaacgtccggaacggggttccccaagtttcccgttacggttaccgacgggtttacggggtccgggttaggtaacggttaacggttaccggggtaacgtaacggttaccgtttaacccgtacgttacccgttaaccgtaacccgttaaacgttaacccggagttacccgaacggttaccccgttagacccgtaaaccggttcccgtaaagggtaaacgttaacggttcggttaaacgtaaccgtttaaacgtttaaccgtttaacggtaaaccgttaaaccgttaaaaacgtaccgtttaacccgttaaccgtttccccggaccccctttaacgtaccccttaaaccggtttaccccgggtaaccggtaaaacccgggtaaccgtaacccgggttaacggttaacccgggtaaacgttaaacgtttaaacccccgggttaattaacccgggg

SEQ ID NO: 56772 - DNA, 556 bp, Homo sapiens
  misc_feature: GYAE6OF02F8J3F.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttggccgggcgagtcgagggcattaacaattatttagcctggtatcagcagcatccgagggaaagttcctaagcctcctgatctatgctgcatccactttgactaatcgacggggtcccaagttcgtcggttcgtaggtgggtcgggtaggtatagtggggacgtaaggtacgttcactctacaccactcagcagtcctgcacgcctaggaatattgttgactaatttacttaacgttagtaactaaaagttctaccgtacctttaccgacccctagtcctaccctttccggaccgtaacgggacaccgacgtacggaacgtaacttaaccgagtacgg

SEQ ID NO: 56773 - DNA, 534 bp, Homo sapiens
  misc_feature: GYAE6OF02G0G43.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttcgccgggcgagtcagggcattaacaattattagcctggtatcagcagcatcgaggaacttcctaagctcctgatctatgctgctactccactttcgctaagtcgacgggtccagtcgtcggttacaggtcggacggtggatagtggacaggtacgttcgactctcactatcacgcagtcctagctacgctagaatgttgtactacgtaacttaacttacgtacgtaactaaagttactcgtaccttccgaccctacgtcctaccgttaccggacgaacggtacacggtacgtaggaacgtaactacgtactacgg

SEQ ID NO: 56774 - DNA, 650 bp, Homo sapiens
  misc_feature: GYAE6OF02IVQRG.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtctccatccctcctgtctgcatctgtggganacagagtcaacgtccacttcggccgggcgagtcgagggctagtttacctaattctttagcctggtatcgagcaagaaaccaggaactaaactcctacactcctgactctatgatcgcgtacctagttagagacgtcggggcccagtcggtaagtttcgacggcggctaggtggactcggagggacagtacgttccacgtctaccactatcgaacgcgacgtccgtacgacgacgtacccgtagtaacgttacttttacgaccgttaaactttaccgtttaacgttcgtaaaccctaaccgttaaaccttttaaaccgtaacttttaaccctacgtaaaccgttaccgtaacccgggtttccggaacccggtaacgggaaccccgtaagggtaccggaaaaccgtaacggtaccggtaaaccgttcgtacggtacccgtacgtaacccg

SEQ ID NO: 56775 - DNA, 649 bp, Homo sapiens
  misc_feature: GYAE6OF02G3XRO.29.87.H10.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (641)..(641): a, c, t, g, unknown or other
  misc_feature (641)..(641): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggcctcccagataccagatgtgacatccagatcgacccagtcctccatccctccctgtctgcatcgtgtggganacgagtagtcaacgtcacgtggccgggngagtcgagggactaattaactaattattagccgtggtactcgagcagcataccgaaggtaacttccaagtcctcctagacttcgtatcgctgactacttcctacttcgactaacgtcgacgggttcctagtccgtcggttacgaggtcggtacggtggtacgtaggtcgggaactacggtacgttaccgtactcgtaccactactcgaacgtccgacgtcctgaccgacgtcctaaggagttacggttcgtaccgtaacttaaccgtttagttaacccgttagttaaaccgtaaattacgttaccttaccgttacccgtacccctacgttaccccggttacccgttaccgggacccgtaaacggccgtaaccggtacgtaaccggtaaacgtaacccgttaacggngttaacgg

SEQ ID NO: 56776 - DNA, 676 bp, Homo sapiens
  misc_feature: GYAE6OF02HC4GM.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctgtggganacagagtcaacgtcacttgccgggagagtcgaggcattaacaatttattagccgtaggtatcgagtcagcacgtaccgaaggggtaaacgttcctaagctcctgtatctatgctgactactcctacgtttcgactaatcgaacgggtccctagttcgtcggttcaggttcggcggtaggtataggtacggggaactaggtacggtttacctacgttcctaccgtaacctacgttaccgagacctaacggtcccttacgacgttaccgacccgtagtaaacggtcgttacgggtttaccgtactaaacgtttttaacgtttacgtaacgtttaaacccgtaaaagttaactttaccgttaaccgtttcccgacccctacgttaaccctaccccgtttaccggggaaccgtaaccgggaccgttaacggaaccggttacgggtaaacgtaacgtttaaaaccggtagttaaccggg

SEQ ID NO: 56777 - DNA, 761 bp, Homo sapiens
  misc_feature: GYAE6OF02GB7JG.29.87.H10.1.454.CMB.1.raw
  modified_base (173)..(173): a, c, t, g, unknown or other
  misc_feature (173)..(173): n is a, c, g, or t
  modified_base (210)..(210): a, c, t, g, unknown or other
  misc_feature (210)..(210): n is a, c, g, or t
tcagatagagtactcacgaccggtgctcgatttagcagtactgcgttgggtttgggggcagaagtctctctcagtccagacacagcatggacatgagggcccccgctcagctcctgggacctcctgctgctctggcctcccagataccagatgtgacatccagactcgacccngtctccattccctccctgtctgacatcgtggtggganacagacgtcaacgtctacgttcggccgggcgagtccgaagggcctaattaaccgtaatttagtttacgcccgttaggtactcgtaagcacgcaacttaccgaaaggggtaaacgttacccgtaaggtcctacctagaacttctacgtcgactgtacctacgttccacttttacgacctaactccggtaaccggggttacccctacgttccgtttccggtttaacgcgggttacgggtccgggttaggtaatttacgggtaggggtaacgtaacggtacgggtttactaccgttaccgtaccgtaacctacgttaccgaacggtccaccggttccgtacgtacgaccgtacccgtaggaacgttagtcggttacgtaaccgttttaaactttcgtttaaaccgtacgttaaacgtaaaaccgtttacttacccgtaccgttttaccccaacccgttaccgttaacccgttacccgttacccgggaaccgtacgggaaccctacccggtaacgttacgggaacgtttaaacgttaaacccggtagttaccggg

SEQ ID NO: 56778 - DNA, 706 bp, Homo sapiens
  misc_feature: GYAE6OF02H0CYI.29.87.H10.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagatagagtactcacgaccggtgctcgatttagcagtactgcgttgggtttgggggcagaagtctctctcagtccagacacagcatggacatgacgggccccccgctcagctcctgggactcctgctgctctggctcccagataccagatgtgacatccagatgacccagtcctccatccctccctgtctgcatcgtggtggganacgagagtcaacgtcacgttggccgggngagtcgagggactaattaactaatttagttacgtccgtaggtatcagcagcacgtaccgaagggtaacgttccgtaagtcctccgtagactcgtatgctcgctactcctacttcgactaacgtcggacggtccctagttccgtacggttcgagggttcgggacgggttaggtagttacggtagggtaacgtacggtacgttaccgtaccgttaccctacgtaaccgtacgtaccgacggtacgtaaccgtccgtacgaccgtaacggtaccgtaaggaaacgttcgttacggtacgtaaccgttaactttaacgttaacgttacgttaaaccggttaaaagttccgttaaccgttacccgttacccgtaccccttacgttaacccgttacccggtaccggtaacccggtaaccggtaccgtaaccggtaacggtaacggtaacggttaaacggttaacccgaggttaccgg

SEQ ID NO: 56779 - DNA, 656 bp, Homo sapiens
  misc_feature: GYAE6OF02GQLA8.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagatgacccagtctccatcctccctgtctgcatctgtggganacagagtcaacgtcacgttggccgggcgagtcgagggctattaacaattattacgcctggtatcgagcagcataccgaagggtaaacgttcctaagctcctagacttctatcgctgcctatcctactttcgactaacgtcgacgggtccctagttccgtcggtacgtacggtcgggtacggtggtacgtacggtacggggactagtacggttcctaaccgttaccgtacctaacctacgtacagtccgacgttccgtagtaccgacgtaccgtagaagtacgttgttaccgacgttaaacgttttaacgttacttaaacggtaacttaaaacgttcgttaccgttaaccgtttccgacccccttacgtacccgttaacccgttccgggaacccgtaacggtaccgtaacggtaccgttaagggtaacctaacggttaaccgtaacgttaccggg

SEQ ID NO: 56780 - DNA, 517 bp, Homo sapiens
  misc_feature: GYAE6OF02GQRXP.29.87.H10.1.454.CMB.1.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (396)..(397): a, c, t, g, unknown or other
  misc_feature (396)..(397): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagataccagatgtgacatccagatgacccagtctccatccctccctgtctgcatctggtggganacagagtcaacgtcacttggccgggnagtcgaggcattaacaattattagcctggtatcagcagcatccagggtaaagttcctaagctcctgatctatgctgcatcctacttgctaatcgacggggtcccagtctcggttcagtggcggtgtatagtgggacaggagttcactctcacatcagcagcctgcnnctagagtatgtnactaacttatactagtaactaaagttntacctactttcgaccctacgtcctaccgttcggaccgtaacggacaacgacgtaggtaagtaacgttaaccgtaactacgg

SEQ ID NO: 56781 - DNA, 890 bp, Homo sapiens
  misc_feature: GYAE6OF02HAEIP.29.87.H10.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
tcagatagagtactcacgaccggtgctcgatttagcagtactgcgttgggtttggggggcagaagttcgtctcgtcacgtccacgacacagtccaagttggtaccattcggaggggcccccctctacgaacgccttccgtaggggaacctccgtaggcctgccttctgggccttcccgagtataaccngtagtttgtagtacacttactaaaggntccgacctagtcctaccatcccttaccgtgttcgtggactagttcgggtgttcgggaatacaggtacggtccgggaaccttcgtaacgttcggtcccgggactaggttccggaacggggtacctaacgtttaaaccgtaagttttaacgttttacggacgtttaggttatttaccgttacgacgtaacgtcgttaccggttacccggtaaaggggtaaacctttccccggtaaacgggtccgtttaccggtaaggttaccgtttacggttagttcgttaaccgtttacgaccgttaacccgtttaccgtaccggttttcaaaccgtaaccgtttccgggtaccgggtttaccctacgtttccggttaccggtttaaccggtaggtttcgggggacgggtttaacggtaacggttacggttaacggggaactaccgggttacttaccgtacctaaccgtacaaaccgtcgtaacgaaaccgtccgtacggtaccgttaccgcgtaacgtaacctcggtaaaggtacttccgggttactaaacgtttaactttaggtacttaaaccgtaagtacttacgtttccttaacgttcccgtacctagttacccaaacggttcggaaacaacgggtcctaacggtacgttaaggaaccggttaacgttaaccgtacggtcgg

SEQ ID NO: 56782 - DNA, 560 bp, Homo sapiens
  misc_feature: GYAE6OF02GC1UR.29.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (373)..(373): a, c, t, g, unknown or other
  misc_feature (373)..(373): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagatcaacgtcacttggccgggnagtcaggcataacattattagctggtatcagcagcatccgaagggaaacttcctaagctacctgatctatgctgctactcctactttcgactaacgtcgaacggggtcccaattcgtcggttacaggtcgggacggtaggtagtagngggacaggtacttcgacttctaccaccataccgagcctacgcctgcacgtacagaacgtagttcgtacgactaacttaagttacttagtaaactaaagttctactacctttaccgacccctactaccgtaccgttaccggaccgtaacggtaccacggtacgtaggaataacgtaaacgtagtacgg

SEQ ID NO: 56783 - DNA, 561 bp, Homo sapiens
  misc_feature: GYAE6OF02FRYPD.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggancagagtcaacgtcacttgccgggcagtcaggcataacaattatttagcctggtatcagcagcatccagggaagttcctaagctcctgactctatgctgcatccactttgacaatcacgggtcccatcgtcggttcagtggcggtgagtagtgggacagagttcacgttctcctaccgatcagcacgtcctgctagcctagaagtattggtgtacgtaaactttattactagttaacgaaaagttactacctacctttcgacccccgtaacttcccgtaacccgtttaccggtacccgtaaacgggacccgtaacggtaccgttacgggtagtaaacggtttaaacccgaacggttacggg

SEQ ID NO: 56784 - DNA, 807 bp, Homo sapiens
  misc_feature: GYAE6OF02HKDJH.29.87.H10.1.454.CMB.1.raw
  modified_base (103)..(103): a, c, t, g, unknown or other
  misc_feature (103)..(103): n is a, c, g, or t
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
tcagatagagtactcacgaccggtgctcgatttagcagtactgcgttgggtttggggcagaagtctctctcagtccagacacagcatggacatgaggccccgntcagctcctgggactctgctgctctggctcccagataccagatgtgacatccagatgacccagtctcatcctcctgtctgcatctgtcggganacagacgtcaacgtcacgttgcccgggngagtccgagggcaattaacaattattagccttggtaatccaagtcaacgcgtaactacccgaaggggtaaacgttttccccgtaaaggtcccttacccgttagtactttccgtaacgttcggccgttcggacctaacttccccgtaacgttttcgaaccgtaaagttccggaccgggggtttaccctaactttccggtttacccggggtttacgtaacgggtttcggggtacccggggtttcggtaaaagttttacgggttacgggggaaacccgttaagggttaacctttaccgttaaaccccgttcgtttaaccccgaaaccctacggttaccgaaacggttccaacggttcccgttaacgcccgttaagacccgttaggaaaccgttagttaccggttagtaaccctttaagtttaacttaaccgtagttaaacgtaaaacgtttcgtaccttaaccctttaccggtaccccctaattacccggtaacccgtttacccgggaaaccggtaaacggggtacccttaaacgggaccgttaacgggaaccgtttaaaaccgtttaaaccggacgtttaccggg

SEQ ID NO: 56785 - DNA, 823 bp, Homo sapiens
  misc_feature: GYAE6OF02HQB3Y.29.87.H10.1.454.CMB.1.raw
  modified_base (172)..(172): a, c, t, g, unknown or other
  misc_feature (172)..(172): n is a, c, g, or t
  modified_base (187)..(187): a, c, t, g, unknown or other
  misc_feature (187)..(187): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
tcagatagagtactcacgaccggtgctcgatttagcagtactgcgttgggtttggggcagaagtctctctcagtccagacacagcatggacatgacgggccccccgctcacgctccgtgggacctcctgctgctcgtggcctacccgagactaccagatgtgacatccaagntacgacccagttccnccacttccctccctgtacngcattcgtggnggacacgagcgtacaacgtcacgttcggccggngtacgtacgaggactaacgttaactaaagtttagttacgtaccgttaggtactacgacgtcgaagtaccgaacgtaccggaaggggttaaaccttaccgtaaacgtcccttaccgtagtactactagtcgtactcgtacctacgttaccgtatttacgactaacgtccggtaacgggtcccttagttccgttacggtcggtaacggttgggtacggtgtaacgtaggtacgggtaacgtaagtacgtaccgtactacctaccgtaaaccgtacttaaccgacgtccgtaaccgtccgtacgaaccgtaccggtaacgttacgaagtttacgtacggtttaacctaacgtttaaaccttttaacgttaacccgtttaagttaaaacccggttaaaacgttaaccgtttaccccgttaaccggtttacccccgaaccccgtttacccggttaacccgttaaccccgggtttaacccggaaacccggggtaaaccggttacccggtaaacggttaccgggtaaacgggttaaaacccgttaaaacggttaaccccgggtaagtttaaccccggggg

SEQ ID NO: 56786 - DNA, 904 bp, Homo sapiens
  misc_feature: GYAE6OF02JPJAR.29.87.H10.1.454.CMB.1.raw
tcagatagagtactcacgaccggtgctcgatttagcagtactgcgttgggtttgggggcagaagtctctctcagtccagacacagcatggacatgagggccccgctcagctcctgggacctcctgctgctctggcctcccagactaccagatgtcgactactccagatcggacccctagtcctaccacttccctcccttgtcctgcctattccgttggaggggaacaccgaaggtacgttaccaaacgttccaacggttgggacccggggtcaaggtccgaaggggtcctaacgtttaaacctaaagtttaacgttttaacgtacccgtttagggttaacttacgaaacgtccgaaaggtacctacgttaacccgtaaacggggaaaacggttttaccccgttaaaaggtacccgtttaacccggtgtaaacggttcccgtttaaattcggttcctacgggtaaccgttaacctacccgtttaacctttacgtaaccgtaaacgttaccggtaccgggggtttaaccctacgttaccgttacgggtttaacccgagggtttacggtccggggttaggtaacgttagtacgggaacgtaacggtacggttacctaaccgtttaccgtccgtaaaccgtacgtaccgtaaaccgtcgttaccggaccctttacgaacccgtaccggtacccgttaaggtaaccgtaacgtttaggttaccgtaaccgttaaacgttttaacgttaaacgttaaccgttaaagtaaaaacgttacggtaaccctttaccgttacccttaacccgtacgtttaccgtaaccgttacccgggtaaacccgtaaccgggtaaccgtaacccggtaacgggtaccgaaacggttaaaccttaaacggtaacgttaaccggg

SEQ ID NO: 56787 - DNA, 606 bp, Homo sapiens
  misc_feature: GYAE6OF02IHVEW.29.87.H10.1.454.CMB.1.raw
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (597)..(597): a, c, t, g, unknown or other
  misc_feature (597)..(597): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtcctccatccctcctgtctgctatctggtggagacagacgtactaaccgtcacgttggccggggacagtcgaggctaattaacaattattagcctaggtactcaggcaagcatcccgaagggaaattcgtaacgcgtcctagacttctatgctgacacgttccctatttcacgtaatccggtacgggaccctagttccgtcgttacggagtcgggacggtggagtagtgggacagtacgttanactcnctacgatcgaacgcaagtcctgaccgtcgacgttacaagtgtacgtacgacttaacgtttattacgtagtaactaaaaggttactacgttaccgttaccgacccttagttacccgtacccgttacggtaacccgaacggtaaccgaacggttactacggtaacgtaacggttaaaccgngtaaccggg

SEQ ID NO: 56788 - DNA, 537 bp, Homo sapiens
  misc_feature: GYAE6OF02GQNUE.29.87.H10.1.454.CMB.1.raw
  modified_base (201)..(201): a, c, t, g, unknown or other
  misc_feature (201)..(201): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcagggcattaacaattattagcctggtatcagcagcatccagggaaacgttcctaagctcctgatcgtatgctgcactccacttgcaagtcacgggtccagtctcggtcagtggcggtgatagtggganagtagtcactctcacntcagcagcctgcacgccgtgaagtnttgttacgacttaattaacttacgtacgttaactaaagttactacgtactttaccgacccctatacccgtacccgttcccggaaccgtaacggtaaccaacgcgttaacggaaccgtaagttaaaccgacgttacgg

SEQ ID NO: 56789 - DNA, 860 bp, Homo sapiens
  misc_feature: GYAE6OF02JP1TK.29.87.H10.1.454.CMB.1.raw
  modified_base (108)..(108): a, c, t, g, unknown or other
  misc_feature (108)..(108): n is a, c, g, or t
tcagatagagtactcacgaccggtgctcgatttagcagtactgcgttgggtttgggggcagaagtctctctcagtccagacacagcatggacatggacgggcccccgntcagcctccgtgggacctcctgctgctcgtggcctcccagactaccagatgtgacatccagactcgaccctagtcctaccacttcccctcccttgtcctcgactacgttcgttgggacgggaacgaccgaggtacgtaccaaacggtcctacggttcgggaccgggacgtacgtacgacgggtacctaagttaaactaagtttagttacgtccgttaggtaactacgagtcgacgtaccgtaacgtaccgggtaaacgggtaaccgttaccgtaacgtccgttaccgttaagtaccgttacgttagtccggtccgtacgtactaacccttccgttaacgtttacgaaccggtaaacgttcccgggaaccgggtccctttaacggttcgttaccggttacggagggttcggggtacgggttagtacgttaacgggtacgggtaacgtacggttaccgttaccgtaccgttaacccgtacccgtaaacgttacggtaaccgtaccgtacccgttacggacccgttacgaccggtaaccggttaccgtaggtaacggttacgttacgttacgtaacctttaacgggtttaccttaacggtaacgttaaaccgtaaatttcccgtacgtttaccctttcccgtaaccccttacggttaaccccgttacccgggttaccggaacccggttaaccggtaacccgtaaccggttaggtaacccggtaaacgttaacccggttaacgtacggttaaccgg

SEQ ID NO: 56790 - DNA, 732 bp, Homo sapiens
  misc_feature: GYAE6OF02JWFCE.29.87.H10.1.454.CMB.1.raw
  modified_base (104)..(104): a, c, t, g, unknown or other
  misc_feature (104)..(104): n is a, c, g, or t
  modified_base (282)..(282): a, c, t, g, unknown or other
  misc_feature (282)..(282): n is a, c, g, or t
tcagatagagtactcacgaccggtgctcgatttagcagtactgcgttgggtttgggggcagaagtctctctcagtccagacacagcatggacatgaggccccgntcagctcctgggactcctgctgctctggctccagataccagatgtgacatccagatcgacccagtctcatcctcccttgtcctagcatcgtgtgggagactagagttaccaacgtcacgttcggccggtacagtacgacgggctaagttaaactaattacgttaagccttggtactanacgtcgaacgtcgtaacgtacccgaagggttaaaccgtttccgttaaacggtacccgttaccgttaaggtaactttccgtttaaagtcgggttaacctcggtacctacgttaccctacgtttacgtacgtaaacgtttccggacggggttaccctagttacccggtcggttacgtggtacggtacggtacggtacttacggtcgggaacgtacgttaacgtttcgaacccgtttcaaacttaccgtacttacggaaacgtcctaggttacccgttgaccgaacggtacctaacgggtaacttagttaccgtccgtaactttaaccgtttacgttaccgttaacgttaaactaaaggttccctacttaaaccgttcccaccgttacttaaccgtacccggttcgaacgtacgtacgtaaccgagtaccgtaagtaacttaacgacgttacg

SEQ ID NO: 56791 - DNA, 524 bp, Homo sapiens
  misc_feature: GYAE6OF02FOUVO.29.87.H10.1.454.CMB.1.raw
  modified_base (106)..(106): a, c, t, g, unknown or other
  misc_feature (106)..(106): n is a, c, g, or t
  modified_base (201)..(201): a, c, t, g, unknown or other
  misc_feature (201)..(201): n is a, c, g, or t
  modified_base (346)..(346): a, c, t, g, unknown or other
  misc_feature (346)..(346): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctccctgtctgcatctgtggganacagagtcaacgtcacgttggccgggcgagtcgagggcattaacaattattagctggtatcagcagcataccgagggtaaacgttcctaagcctcctagatctatgctgcatccactttgacatcgacgggtccagtctcggtanagtggcggtgatagtggacagtgtcactctcaccatcagcacgctgcacgctagagattcgtagtactattatactagtaactaaagtactactaccgttcgaccctactccgaccgttaccggaaccgtaacggtactacggtacgtaggtaacgtaacgttaaccgtacgttacgg

SEQ ID NO: 56792 - DNA, 649 bp, Homo sapiens
  misc_feature: GYAE6OF02I9TTP.29.87.H10.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagatagagtactcacgaccggtgctcgatttagcagtactgcgttgggtttgggggcagaagtctctctcagtccagacacagcatggacatgagggccccgctcagctcctgggactcctgctgctctggctcccagataccagatgtgacatccagatgacccagtctccatcctccctgtctgcatctggtggganacagagtccaacgtcacttggccgggnagtcgagggcattaacaattattagcctggtatcagtcagcatccgagggtaaacgttccgtaagctcctagacttcgtatgactgctactcctactttgactaagttacgggtcctacgttcctcggttacaggttcgggcggtggtataagttgggaactaggtacgttacacgttctacaacctatcgacgcgacgcctagccgagtccctaggaacgtaattcggttcgtaaccttaaacgtttactttaaaccgttcggttaaaccgtaaaacggttacttacctaacccgttttccgaccccccgtagttacccgtaaccctttaacccgggacccgtaaaccggggtacccgtaaaccggtaaccggttacggtaacggtaaactttaaaccggtaaccgttaggttacccggg

SEQ ID NO: 56793 - DNA, 775 bp, Homo sapiens
  misc_feature: GYAE6OF02GZBJZ.29.87.H10.1.454.CMB.1.raw
  modified_base (194)..(194): a, c, t, g, unknown or other
  misc_feature (194)..(194): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctccagataccagatgtgacatccagatgacccagtctcatcctcctgtctgctatctgngggagacagacgtcaacgtcacgttggccgggcagtcgagggcattaacaatttattaacgccttaggtatcgagtctagcactaccgaagggtaaacttccaaagctacctggtaacttctaagtcgcttcgacctacttccgtacgttttacgactaaacgtcgaacggggttaccctagttaccgttcggttactagggtgggccgggtaggtacgtaaggtcggggtaacgtaacggttacggtttaccaccgtttaccgtactaacccgtaactaccgtaaggtacccgaacggttccccgtacgggaccgtaaccggtacccgttaaaggtaacggttacgttacggtttacggaacctttaaccgttttaacgtttaacgttaacgtttaaaaccggttaaaaacgtttaccgttaacccgtttaaccgttttacccgtaacccccgttagttaaccccgtttaacccggtttaccggggaaccccggtaaacggggtaacccgtaacccgggttaacgggttaccgggttaaaccggtaaaaccgttttaacccgggaacgtttaaccggggg

SEQ ID NO: 56794 - DNA, 628 bp, Homo sapiens
  misc_feature: GYAE6OF02G6MKI.29.87.H10.1.454.CMB.1.raw
  modified_base (106)..(106): a, c, t, g, unknown or other
  misc_feature (106)..(106): n is a, c, g, or t
  modified_base (204)..(204): a, c, t, g, unknown or other
  misc_feature (204)..(204): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatccctccctgtctgcatcgtgtcggganacagatccaagtcacgttggccggggcgagtcagggctaagttaacaattattacgccttggtatcagtcagacacgtaccgaagggtaaacgttccgtaagcctcctgtagttcctagtgctgactacttccactttgacctaagtccgacggggtaccctagttcgtcggttcagggtcggtcgggtaggtataggtcgggactaggtacgttcgtacctactaaacctgtacacgacacgcctaggcacgtcctagtagtattcgtacgtaccttaaactttacgttaacgtagttaaacaaaacggttcttacttaccgttaccctacccgtactacccgtaaccggttacccggaccggtaaacggcccgttaacggacgttaggaaaccgtaacggtttaaacgacgtacggtaccgg

SEQ ID NO: 56795 - DNA, 1045 bp, Homo sapiens
  misc_feature: GYAE6OF02FU3IO.29.87.H10.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
tcagatagagtactcacgaccggtgctcgatttagcagtactgcgttgggtttgggggcagaagtctctctcagtccagacacagcatggacatgagggccccgctcagctcctgggactcctgctgctctggctcccagactaccagatgtgacatccagatgacccagtctccatcctccctgtctgcatctggtggganacagacgtcaacgtcattggccggngatcgaggcataacaattattacgctgtatacagacagcacgtacgaagggtaacgttaccgtaacgtacctaccgtagtacttactagtcgtcgtacgtacgtacttaccttacgtttagtaccccccccgtaagttaccggtaaccggggttacccgtacgttaccgtttaccgggtttaccggtacgggttacggggtacgggttacgggtaacgttaacggttacgggggtaacggtaaacggttaacgtttaccgtaacccttacccgttaaccgtaaaccccgtaacgtaccgtaacggtacccgtaacccggttacccgtacggtaacccgtaccggtaaacccggttaacggttaaaacgggttaacgtttaacgggtttaaccggggttaaacccgtttttaaaaacccgggttttttaaacccggttttttaaaccggttttaaaacccggggttttaaaaacccgttttaaaaaaaaaccggggtttttaaaacccgtttttaaaacccccgggttttaaacccccgttttttttaaccccccggggttaaaacccccccccgttttaaaaccccggttttttaaaccccccgggtttaaaaccccccgggttttttaaaccccccggggggttaaaaaccccccgggggtttaaaaacccgggggggttaaaaccccccggtttaaaaaccccggggtttaaaacccccgggggtttaaaacccggggtttaaaaaccggggtttaaaaaccccggggttttaaaaaaacccggggtttaaaccccggttttaaaaccccgggggg

SEQ ID NO: 56796 - DNA, 704 bp, Homo sapiens
  misc_feature: GYAE6OF02I23RC.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatccctccctgtctgcatctgtggganacagagtacaacgtcacttcggccgggacgagtcgagggctaagttaaactaatttatttacgcctaggtactcagcagcacgtaccgaacgggtaactttaccgtaagtcctacgtacgattctatcgtactcgactactaccttactttacgactaacgttccggtaaccggtttccctattccgttacggtttcgtaggttacggtcgggttaggacgtttagtagggtacgtaaggttacgttaccaccgtactacctaacgtactacgacgccacgtcctagacctacgtacccgtaggtaaccggtagttaccgttacgtaaccgtttaactttaacgtttaaccgtaacgttaaaacgtaaaacgttttactacctttaccgtttccccgaccccttaacgttaccccgtaacccggtttacccggaaccggtaaccggtaccgtaacggtaaccggttacggaacggttaaacgttaaacccgtagttaccggg

SEQ ID NO: 56797 - DNA, 810 bp, Homo sapiens
  misc_feature: GYAE6OF02JR4AJ.29.87.H10.1.454.CMB.1.raw
  modified_base (106)..(106): a, c, t, g, unknown or other
  misc_feature (106)..(106): n is a, c, g, or t
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
  modified_base (356)..(356): a, c, t, g, unknown or other
  misc_feature (356)..(356): n is a, c, g, or t
tcagatagagtactcacgaccggtgctcgatttagcagtactgcgttgggtttgggggcgagaagtctctctcagtccagacacagcatggacatgaggcccccgntcagctcctgggactcctgctgctctggctcccagactaccagatgtgacatccagatgacccagtctccatccctccctgtctagcactcgtgtagggntaaccngtacgtcaaacggttccacgttcggcccgggtagacgtccgagggcctaaacgttaacctaatttagtttaccgaccgttggttaanccgaaggtcgtagctaacgtccgaaagggtaacgttacccgaagtccttaccggtanacgttactagttcggcctgtaacctaccttacctacgttttacgactaaccggtttacgacccggggttacccctaatttcccgggttaccgtttacgaggggttaggtcccggggtaagtaaccggttagggtacggtaacgtacggtactttacgaccgttccgttaccaccttaaacgtcgacgtaccgacggttccgacgacccggtagtaccgtaacgggtaacgttccgttacggttaaccggacccgtttttaaacctttaacgtttaacgtaaccgttaaacgggttaaaaacttccgtttaaacccgttacccgtttacccgtacccccggttaaccgttaccccgttaccggtaacccgggtaaccccggtaaagggttaaccccctagttaaccccgggtaaggttaaccggtaaacctttaaaccgggtaccggttaccggg

SEQ ID NO: 56798 - DNA, 685 bp, Homo sapiens
  misc_feature: GYAE6OF02GP2T2.29.87.H10.1.454.CMB.1.raw
  modified_base (108)..(108): a, c, t, g, unknown or other
  misc_feature (108)..(108): n is a, c, g, or t
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
  modified_base (292)..(292): a, c, t, g, unknown or other
  misc_feature (292)..(292): n is a, c, g, or t
tcagatagagtactcacgaccggtgctcgatttagcagtactgcgttgggtttgggggcagaagtctctctcagtccagacacagcatggacatggacgggcccccgntcagctccgtgggacctcctgctgctctggcctcccagataccagatgtgacatccagactcgacccagtcctccacttccctcccttggtctgctattcgtggtggaanacagacgtacaacgtcacgttggccgggngagtcgaggactaataactatttattacgcgttagtatcagacancgtacgtaccggaagggtaaaccgttccgaaagtcctacgtagtatcgtactcgctcgctactacctacttcgaacgtacgtacggtacggtacctagttcgttaccggtagacgggttcggtagggtacggtagttaacgggtacggaacgtacggttacgtacgtaccgttacgtaccaacgtacgtacgaacgtaccgacgtacccggtagaccgtacgtacgtaaggtacgttaacgttaggtaccgttaactttaacgtttaacgttaacgttaacgttaaactaagttacgtacgttaccttacccgtaccctaaccgtaccgtaacccgtaccggaaccgtaacggtacacggtaggtaaccgtaacgtaacgtaacgtcgtacgg

SEQ ID NO: 56799 - DNA, 1200 bp, Homo sapiens
  misc_feature: GYAE6OF02HWX37.29.87.H10.1.454.CMB.1.raw
  modified_base (107)..(107): a, c, t, g, unknown or other
  misc_feature (107)..(107): n is a, c, g, or t
tcagatagagtactcacgaccggtgctcgatttagcagtactgcgttgggtttgggggcagaagtctctctcagtccagacacagcagtggacatgacgggcccccntcagctccgtgggaccttcctgctgctctacgggtcctacccgagtacttacccgagtacttggtacgaacctacgttacccgaaggtacgtacggtaaccccctaggttcccgtaccctaccgttccccttcccccgttcggttccgtacgtacctaaccggttcggttacgggttacggggggaactaaccggtaacgggtaaccggttaacccggtaaaccgtttaccggaaccccggttttcgggggacccccgggggttacgtaaccgggttaacccggaacggggttaaccgtttaaaacggttttaaaaccccgttaaaaggttttttaaacccggtttaaccgggttaccccggtttaacggggtttaaaccgtacccgggttaacgggtaccccgtaccgggttaacccttaacccggggttaaccccgggtaaacgggggttaaaacccggttttaacccgttaacccgggtttacccgttaccccggtttaagttaacccggtttaccgtttaaccgggttaccggtaccggttaccgtaacccgttaaccggtttaaacccccgttaggttttaccccggaaaccgttaacccgggttaccggggttaaccccggggttaccccgttacggttttaccccgggtttaaccggggttacccggttaacggggggtttacggggtaaccccggtttaaaggggttacgtttaacgggggtaacccggggttaacggttaccgggtttaacccggtttaacccgttacccggtttaacccggttacccgtaacccggttaaccgttaccgggtaacccgttaacccggtacggggtttaccccgttaccggttaaccgggtttacccggttaaccggttaaccggggttaaaccggtttacggtttaaccggttaccgggtttaaacccttttaaccggtttaaccggtttaacggtaaacggtttaaaccggtttaaaacggttccctttaaccgggtttaacccgtttacccccgtacccggtttaaccgttaccccggtttacccggttaaccgggtacccggttaaacccggacccggtt

SEQ ID NO: 56800 - DNA, 536 bp, Homo sapiens
  misc_feature: GYAE6OF02GPH78.29.87.H10.1.454.CMB.1.raw
  modified_base (201)..(201): a, c, t, g, unknown or other
  misc_feature (201)..(201): n is a, c, g, or t
  modified_base (454)..(454): a, c, t, g, unknown or other
  misc_feature (454)..(454): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggcgagtcaggcattaacaattattagcctggtatcagcagcatccgagggtaaacgttctaagctcctgatctatcgctgcatcctactttgacaatcgacgggtccactcgtcggttcagttggtcgggtaggagtagtagggactagtagttccactctaccacctatacacgcacgcctgacacgcctagaagagttgtcgactaacttattacgtatactaaagtntacgtacttccgacccctagtcctaccgttaccggaccgtaacggaccacgtaactaggaacgtaacgttaacgagtacggg

SEQ ID NO: 56801 - DNA, 584 bp, Homo sapiens
  misc_feature: GYAE6OF02HJ184.29.87.H10.1.454.CMB.1.raw
  modified_base (106)..(106): a, c, t, g, unknown or other
  misc_feature (106)..(106): n is a, c, g, or t
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
  modified_base (370)..(370): a, c, t, g, unknown or other
  misc_feature (370)..(370): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtcctccatccctccctgtctgcatctggtggganacagatcaacgtccagttgccgggngagtcgaaggctaattaaacaatttacttagccttggtaactcagctaggcaatacccgaaggtaaacttaccaagtcctactagactctatgcttgacactccgtacttgacaagtcgaacggtccaatccgtgttacgngtggcggtagatgaggactagtagtcactctacacatcagcagtcctgacacgaccgtaagatacgttagtacgactaacttacgttactaacgtaactaaaacgttctaccgttaacccttccgacccttacgtacccgtaaccttaccgggaaccgtaaaccgggactacggaaccggttacgaaacggtaaccgttaaacggtacttcggg

SEQ ID NO: 56802 - DNA, 813 bp, Homo sapiens
  misc_feature: GYAE6OF02HZ37R.29.87.H10.1.454.CMB.1.raw
  modified_base (106)..(106): a, c, t, g, unknown or other
  misc_feature (106)..(106): n is a, c, g, or t
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctccctgtctgcatctggtggganacagagtcaacgtcacgttggccgggngtagtcagggacattaacaattattagcctggtatcgagcagacataccgaagggtaaacgttaccgtaacgccttccgtagacgtccttatcgctgactacgtcctacgtttgactaagtaccgtaacgggggttccctaagttccgttaccgggttcgtaacgggttcggggtacgggttagggaaagtttaacgggtaggggtaaccgtaacgggtaacggtttaccgaaccgtttaccctaccgtaaaccctaacgtaccgtaaccggtaccgaaccgtccgtaccggtaccgtacggttacccgtaaggaaacggttacgttacgggtttaccggttaccttaaaaccgtttttaaccgtttaaccgttaacgttaaacgtttaaaaacggttacctttaacccgttaacccttttacccgggtaaccccccttaaccgtttaccccggttaacccccggtttaacccggggtaaaccccggtaaaacccggggttaacccgttaaccggttaaacccggttaaaggggtaaaccggtttaaaacccgggtttaaaaacccggtacggtttaaccgggg

SEQ ID NO: 56803 - DNA, 545 bp, Homo sapiens
  misc_feature: GYAE6OF02FWUEX.29.87.H10.1.454.CMB.1.raw
  modified_base (106)..(106): a, c, t, g, unknown or other
  misc_feature (106)..(106): n is a, c, g, or t
  modified_base (202)..(202): a, c, t, g, unknown or other
  misc_feature (202)..(202): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (471)..(471): a, c, t, g, unknown or other
  misc_feature (471)..(471): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatccctccctgtctgcatctgtggganacatacgtcaacgtcacgttggccgggcgagtcgagggcaattaacaatttattacgccttaggtatcagcagcataccgaagggtaaacttcctaagcctccgtagattctatgctgctatcctactttcgactaatcggacgggtcccagttccgtcggttcnggtcgggcggtaggtataggnggacgtagtacgttcactctacacctatcacgcagtcctgcacgctagagtntgtanactaattntacgtataactaaacgtntctacttccaccctatcctaccgtacggacccgaagggaccacggttacaggtaactacgttaacgagttacgg

SEQ ID NO: 56804 - DNA, 590 bp, Homo sapiens
  misc_feature: GYAE6OF02FVEAQ.29.87.H10.1.454.CMB.1.raw
  modified_base (204)..(204): a, c, t, g, unknown or other
  misc_feature (204)..(204): n is a, c, g, or t
  modified_base (435)..(435): a, c, t, g, unknown or other
  misc_feature (435)..(435): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgctatcgtggtggganacagagtcaacgtcacgttggccgggcgagtcgaggcattaactaattattagctggtatcagcagcatccgaagggtaacgttcctaagtctcctagactctatcgctgctactcctacttgactaagtcgtacgggtcctacttcgtcggttcgtacggtggacgggtaggtagtaggtagggactagtacgttctactctaccacctatacacgactacgcctcgacncgtccgtagaagtattgtacgacttaacttacttacgttagtaacgtaaatcgttacttaccgttacccgaccctactacccgtaccgttaccggaaccgtaaccggtaaccgtaccggtacgttaccggtaagtaacgttaacgacgttaccgg

SEQ ID NO: 56805 - DNA, 726 bp, Homo sapiens
  misc_feature: GYAE6OF02HL9B1.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttggccgggcgacgtcgagggctaagttaacaatttatttagcctggtatcgagcagtcagtaccgagggtaaacgttcctaagcctcctgtactctatgccgtgctacgtacctacgtttcgactaacgtaccgacggggttcccctaacgttccgttccggtttacgtagggttcggggtccgggtagggtaagttagggtacgggtaacgtacggtacgtttaccgtaccttaccgtaccctaaaccgtacgttaccgaacggtacccgacgtacccgtcggtacccgacggtaccccgtaaggtaacgtacggtttacggttacgtaaacccgttaaccgttttaacgttaaccgtttaaccggttaaacgtaaaaacgtttacttaaccctttaaccgtttaccccggacccctttaccgtacccgttaccccgttaccgggaaccgtaaccgggacctaccgggtacgtacggaacgtaacgttaaaccgtacggttacggg

SEQ ID NO: 56806 - DNA, 876 bp, Homo sapiens
  misc_feature: GYAE6OF02F9JCK.29.87.H10.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagataccagatgtgacatccagatgacccagtctccatcctccctgtcngcatctggtggganacagacgtcaacgtcacgttcggccgggcgagcgagggtctaagttaacctaatttacgtttagccgttggttaactcgacgcgaggcctataccgaaggggtaaaacgtttccgtaaacggtccttcccgtagtacttacctagttacggtaccttggtacctaaccgtttacccgttaaccgtttttacggaccttaaaacggttacccgggttaaccggggggttacccctaacgttttcccgggtttacccggtttcgtaaacggggtttcggggtacggggtttacggtaacggttaagggttaccgggggtaaacctaagggtaccgttttaccgtaaccgtttccgttaccccgtaaccgtaccttaacccggtaacgtaccccgtaacgggtcccttaccgggaaccgtaccggtacccggtaaggtaaaccgttacgtttaccggtttaacgtaccgttttaaaacttttacgtttaacgtttaacgggtaaaacctttaaaacggttcctttaacccggtttacctttaccccggtaccccctaacgtttccccgtaacccgggttttacccggaaccgggttaaaacccggtaccgtacccggtaaacggttaccggtaaaacggtttaacccggtttaaaaccggtacgggtttaaccggg

SEQ ID NO: 56807 - DNA, 860 bp, Homo sapiens
  misc_feature: GYAE6OF02IUPPQ.29.87.H10.1.454.CMB.1.raw
  modified_base (216)..(216): a, c, t, g, unknown or other
  misc_feature (216)..(216): n is a, c, g, or t
tcagatagagtactcacgaccggtgctcgatttagcagtactgcgttgggtttgggggcagaagtctctctcagtccagacacagcatggacatggacgggcccccgctcagctccgtgggactcctgctgctctggcctcccagactaccagatgtgacatccagatcgacccagtcctccactccctcccttgtctgcattcgtggtacggganacgaggtacgtacaaccgtccgtacgttcgggcccgggagtacgtcgaaggctaaacgttaaactaagtttacgtttagccgttaggtactacgtacgcgaacgcctaacgtaccggtaaaggggtaaacgttacccgtaacggtccttacccgtaggtaacttacctttaaacgtcggtccgttacggtaacctaccgtttacccgttaacgtttcgaaaccgtaaccggttaccgtaccggggttacccctagttacccggttaccggttacggtaggggttcgggtaccggggttagtaaacgtttacgggtacgggaacggtaaggttaccgttacccgttaccgtacccgtacctaaccgtacgtccgaacggaccgtacggtaccctacgtcgaaccgtacgttaacggaaagttacgtttggtaaaccgttaccttaaacgttttaacgttaccgttaaacggttaaaccgtaaacgtttaaccgttccgttaacccgtttcccgtacccttaacccggtttaaccccggtaacccggttaacccgggtaaacccggtaaaccgggttaaccccgtaacgggttaacgtaacccgggttaaaccggtaaaccttttaaaccggccgtttaaccgggg

SEQ ID NO: 56808 - DNA, 639 bp, Homo sapiens
  misc_feature: GYAE6OF02HYV3D.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctggtggganacagagtcaacgtcacgttcgccgggcgaagtcgagggctaattaacaaatttattacgacctaggtactcagtcagacatcgaggtaaacttccgtaagctacctgatctatgactgacactcctagttacactaacgtcggtacggggtacctacttccgtggttaccgagggttcggacgggttaggtagtaacggtagggaacgtaacggtacgttacgaacttccgtacctaacctacgttaccaacgtaccacgtacccgtgaccgtacggtaaccctaggaatacgttagttacgtacttaacttattaaccgtcgttaaactaaaacgttacgtacgtaccgtttaccgacccctagtaaccttacccggttaccgtaaccggtaacggaccgtacgtaacgtaggtaaccgtaagttaaccgatacggg

SEQ ID NO: 56809 - DNA, 759 bp, Homo sapiens
  misc_feature: GYAE6OF02H06R6.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggcctcccagataccagatgtgacatccagatgacccagtctccatcctccctgtctgcatctgtgganacagagtcaacgtcacgttcggaccgggcgagtcgaaggctaattaacaaatttacttagcctaggtatcagcaagacagtacccgaaggtaaacgtttccgtaaagcctaccgtaggaacttcgttaatcgccgtacgactacgtaccgtacttttagaccgtaactaccgtacggggttaccctaacgttcgttacgggttcgaacggttcgggaccggttaggagttacggtacgggtaacgaacggttacgttacctacgtaccttaccgaacctacgtacgaccgtaccgacgtaccgtgtacccgagttaccgtacggtaaacgtcgttacggttactaaccgttaaaccgtttaacgtttaaccgtaacggttttaaacccaaaacgtttaaacgttaacccgtttaacctttaccccggtaacccccgtaacgttaaccccgtttaacccggtttacgggaaccccggttaaaacggggttaccgaaccccggttaacggtaccgggtaaccgtttaaaaccgtttaacccggtaacggtttaaccggg

SEQ ID NO: 56810 - DNA, 656 bp, Homo sapiens
  misc_feature: GYAE6OF02F03FF.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctggtggganacagacgtcaacgtcacgttcggccgggcgagtcgagggctaagttaactaatttattacgccttaggtatcagccgagcactaccgaagggaacgttccaacgtccttcgtgacttctatgtctcgctactcctacttcgactaagtcgacgggtacctacttcgtacggttctggtcgggtacgggtgtagtaggtcggacgtacggtacgttctacctcgtaccaaccgtataccgacgtccgaacgttccgtacgtaccgacgtccgtagtaacgtgttacgttacgtaactttaaaccgtttagttaccgtaagttaaaccgtaaagtttacgtaccttaccttcccgaacccctactttaaccccggtacccggttaccggaacccgaacgggtaacctaccggtaacgttaaccgggaagtaaacccggtttaaccggagttaccggg

SEQ ID NO: 56811 - DNA, 644 bp, Homo sapiens
  misc_feature: GYAE6OF02IL7LC.29.87.H10.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
tcagatagagtactcacgaccggtgctcgatttagcagtactgcgttggggtttgggggcagaagtctctctcagtccagacacagcatggacatgagggcccccgctcagctcctgggactcctgctgctctggctcccagataccagatgtgacatccagatcgacccagtcctccactcctccctgtctgcatctggtgganacagagtcaacgtcacgttcggccgggngagtcgaggcaattaacaatttagtttacgccttggtatcagcagcatccgaagggtaaacgttccaagtcctcctgtatcttagtcgctgcctatccctagtttcgactaacgtccgaacggggtccctaacgttccgttcgggttacagggttggtcgggtagtaagttaggacgggtaacgaggttacttccgtactcctaccaacctagtacacgaccgtacgtcccgttgaccgtaacgtcctaaggaagtacgttacggttcgaacttaacgtttattacgttaacgtaacgttaaagtcctttacgtaaccgtttcccgacccttacgttcccgtaaccgttaccggaaccgaacggtaacgtaccggacgttacggtaacgtaaacgttaccgtagttacggg

SEQ ID NO: 56812 - DNA, 679 bp, Homo sapiens
  misc_feature: GYAE6OF02GPQPJ.29.87.H10.1.454.CMB.1.raw
  modified_base (209)..(209): a, c, t, g, unknown or other
  misc_feature (209)..(209): n is a, c, g, or t
  modified_base (650)..(650): a, c, t, g, unknown or other
  misc_feature (650)..(650): n is a, c, g, or t
tcagatagagtactcacgaccggtgctcgatttagcagtactgcgttggggtttgggggcagaagtctctctcagtccagacacagcatggacatgacgggcccccgctcagctcctgggactcctgctgctctggctcccagataccagatgtgacatccaagatcgacccagtctccatccctccctgtctgcattcgtggtggganacgagagtaccaacgtctacgttcggccgggacgtagtcgagggactaagttaaactaatttattaacgccttggtactcagcagacagttaccgaaggtaaacgttccgtaagtccgttaccgtagtatcttagtcgtctgtacacttcctacgtttcgactaacgttcgaccgggttacctacgttaccgttcggtacgtacgggtgggtaccggttggtagttacggaggaacgtacggtaacgttacgtacgtctaccgaaccgtatacgaacgtcgacgtcctaacgcgtaccgtcgttaagaacgtcggttacgtacgtaactttaacgttacttacgtaacgtaaactaaacgtcttacctttaccgttcccgtaccctacgttacccgtaaccgttaccggaacgtaaccggtaacctacggaaccgggttanaaacgggtttacctaaaccggtagtacgg

SEQ ID NO: 56813 - DNA, 588 bp, Homo sapiens
  misc_feature: GYAE6OF02FV54K.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctcatcctccctgtctgcatctggtggganacgagagtcaacgtcacttcggccgggcgtagtcgaggggcctaagttaaacaatttatttacgcctaggtatcgagtcagcatacgaagggtaaagttccaaaggtcctaccgtgaactcgtatgactgactacttcctatttacgactaacgtcggacggggttcccagttccgtacgggttacaggttcggacgggttagattaagtcgggactaagtacgtttcactcctacaccgtatacacgccagtccgtgacagtccgtagacgtagtgtcactaagttacttactagaactaaagttctactacttcgaccctagtacctaccgttaccggacgaaccggtagtacccgtagtacgaagttacgtaaacgcggtacgg

SEQ ID NO: 56814 - DNA, 750 bp, Homo sapiens
  misc_feature: GYAE6OF02GAMEW.29.87.H10.1.454.CMB.1.raw
  modified_base (237)..(237): a, c, t, g, unknown or other
  misc_feature (237)..(237): n is a, c, g, or t
tcagatagagtactcacgaccggtgctcgatttagcagtactgcgttgggtttgggggcgagaagtctctctcagtccagacacagcatggacatgagggcccccgctcagctcctgggactcctgctgctctggctcccagataccagatgtgacatccagatcgacccagtcctccactccctcctgtctcgctatcgtgtgggacacagacgtcaacgtcacgttcggccgggngtacggtcgaggactaattaaactaatttattacgtccttaggtactcgagcgagtactacgtaccgaagggtaaacttaccgaacgtccgttaccgagtacttacgtagtacggtcttggtactacgttacctacgtttacgacctaaagttccgggtaccgggtacccttacgttccggttacggttacggtaacgggttcgggtaacggtacggttaagttacggtacgggtacgtaaggtacgtttcccgtaacttcccgtacctaaccgtacgtaccgtaacggacccgttacggtacccgtacggtacccgtaacggttaacccgagggttaaacgttacgtttacggtacttaccgtttaaaccttttacgttaactttaggtaaactaaacgttcgttaaccttacccgtttacccacccttacgtttacccggaccgtttaccgggaaccgtaaccggtaaccgacgtacgggttacgtaacggtaacgttaacggagttacgg

SEQ ID NO: 56815 - DNA, 850 bp, Homo sapiens
  misc_feature: GYAE6OF02G8Q25.29.87.H10.1.454.CMB.1.raw
  modified_base (106)..(106): a, c, t, g, unknown or other
  misc_feature (106)..(106): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctccagataccagatgtgacatccagatcgacccagtctccatcctccctgtctgcatcgtggtagggagacagagttaccgaacgtctacgttcggccgggacgagtcgagggctaattaacgtaattttattacgccgttggtactcagcagcaatacccggaagggtaaacgttaccgtaagccttaccgtagtacttctatcgacctgcctacttcctacgtttacgactaacgtccggaaccggggtccctaacgttccgttcgggttccgtaagggtcgggtaccggggtagggtaagttacggtacgggggtaacctacgggtaacgtttttacccaaccggttttaccccttaacccgtacccgtaacggttacgtaaccggtacccggtaacgtaccccggttacggtacccggtaacggtaccccggtaagggtaaaccgtaacgggtttacttttaaccgggttaaccctttaaaccggttttaacgtttaacccgggttttaaacgttaaaccgtttaaaaaaccgtttaactttaccccgttaacccggtttttacccggtaaccccccttaccggttacccccggtttaaacccgtttacccgggtaaaccggtaaacccggggttaacccgtaacccggtaaccgggtttaaaccgggaacggtttaaaacgtttaaaacccgggtaacgtttaaccgggg

SEQ ID NO: 56816 - DNA, 778 bp, Homo sapiens
  misc_feature: GYAE6OF02H7ZP3.29.87.H10.1.454.CMB.1.raw
  modified_base (173)..(173): a, c, t, g, unknown or other
  misc_feature (173)..(173): n is a, c, g, or t
tcagatagagtactcacgaccggtgctcgatttagcagtactgcgttgggtttgggggcagaagtctctctcagtccagacacagcatggacatggacgggccccccgctcagcctccgtgggacctcctgctgctcgtcggcctcccagactaccagatgtgacatccaganccgacccagtcctccacgtccttccctgttctgccatcgtggtaggagacgaggtactaccgaacgtaccaccggttggcccgggagaacgtcgaaggtctaaacgtttaaatagttttaacttacggtacccgttggtaacttaccgagtaccgacgtaccctaacgtacccggaaagggttaaacgtttacccgtagtaccgttaccgtagtactacgtagtcgcttagacctacttaccgttattacgacgtacgtccgggaacggttccctacgtttcggttaccggttcgtaaggggtcggtacgggtagtacgtttagggacggtacgtacgtaccgtttaccgtaccgtaccgtaccgactacgaccgaggtaccgtccgtaccggtacgacgtaccgtacgtacggtaatcgggttctaacgttacttaacgtttaacgttaaccgtaacgttaaacgtaaacgttcctttaacccgttaccggtaccccttaaccccgtaagttcccggtaaccccggttcggaaaacccggttacgggacccttacgggtaacgtacggtaaaaccgtttaaccggtaaccggttagtacccggg

SEQ ID NO: 56817 - DNA, 684 bp, Homo sapiens
  misc_feature: GYAE6OF02FLMA6.29.87.H10.1.454.CMB.1.raw
  modified_base (203)..(203): a, c, t, g, unknown or other
  misc_feature (203)..(203): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatcgtggtggganacagacgttacaacgtcacgttcggccgggcgagtccagggacagttaaacaattactttagccttaggtactacagcagcataccgaggtaaacgttaccgtaagtcctacgtagtactactagtcgacgtacgctacgtccttacttcgactaacgtacgtaccggggttacctacgttccgtttacggttacgtaacgggttgggtacgggttaggtaagttacggtaggggtactaaggtcgttacctaccgttacctacccgtaaccaacttaccgacgacgtaccgtccgtacgaccgtacgtcgtaaggaagtcgttaggttacgtaccgtaattttactaacgttagttaaactaaagttccgttacctacgttacccgacccgttacgttcccgtaaccgttcccggaaccgtaacggacccgtaacgtaccgggtaacggttaacgttaaaccgttaaggaccgttaacgg

SEQ ID NO: 56818 - DNA, 791 bp, Homo sapiens
  misc_feature: GYAE6OF02JZK3K.29.87.H10.1.454.CMB.1.raw
  modified_base (185)..(185): a, c, t, g, unknown or other
  misc_feature (185)..(185): n is a, c, g, or t
  modified_base (208)..(208): a, c, t, g, unknown or other
  misc_feature (208)..(208): n is a, c, g, or t
  modified_base (232)..(232): a, c, t, g, unknown or other
  misc_feature (232)..(232): n is a, c, g, or t
tcagatagagtactcacgaccggtgctcgatttagcagtactgcgttgggtttgggggcgagaagtctctctcagtccagacacagcatggacatgaggccccgctcagctcctggactcctgctgctctggctcccagataccagactgtgacatccagatgacccagtctccactcctccctntacctgcatcgtgtggacgaccngacgtcaacgtcacgttgccgggnagtcgaggcattaacaattattagcctagtatcagcagcactccgaaggtaacgttaccgtaagtcgtacctagacttctagtcgacgttgacctacttaccgtaactttcgaccgtaagtaccggttacgggtaccctagttccggtttacggttccgtaaggttcgggccgggttaggtactaaggttacgggtaagtaacggtaacggtttactaacgttccgtacctaacctagttaccggagtacccgtaagtccccgttaacgccgtaaaccgttccgtaaggtaacggtaacgttttaccggttaacgttaacccgtttaaaccttttaagggtttaacccttaaaggttaaacccgttaaaaacgttaccgtttaacccgtttaccctttaacccgaacccccccggttttacgtaaccccctttaaccccgggttttaccgggtaaacccccgggtaaaccgggtttaccccgtaaacccgggttaaccgggttaaccggtttaaaccggggtaaaaccttttaaaccccgggtaacgtttaacccgggg

SEQ ID NO: 56819 - DNA, 775 bp, Homo sapiens
  misc_feature: GYAE6OF02JCYP1.29.87.H10.1.454.CMB.1.raw
  modified_base (106)..(106): a, c, t, g, unknown or other
  misc_feature (106)..(106): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
tcagatagagtactcacgaccggtgctcgatttagcagtactgcgttgggtttggggcagaagtctctctcagtccagacacagcatggacatgacgggcccccgntcagctccgtgggactcctgctgctctggcctcccgagactaccgagatgtgacatccagatcgacccagtctccatccctcctgtctgacagtcgtgngganacgagacgtacaacggtcacgttcggccgggagacggtcgagggtctaacgtttaaccgtaatttacgttacggtcccgttagggttaactacgtacggacctaggtaccgtacgtaccggaaagggtaacgtttaccgtaaaccgtccgtccgtagtacgttacgttaacgtcgtaccgtacgtaccgtaccttaccgttaacgtttacgaaccctaacgttccggtaacggggttaccctaacgttccggttacggttaccgtaaggggttcggtcgggtacggtaacgtacgggttacgggacgttaacggtacgttaccgtaccgttcctacgtaaccgacgtaaccgacgtaccgacgttaccgtaccgtacgtaccggttacctaacggtaacggttacttcgggttaacctaaccgttaagtttaacgttaacgtaacggttaacctaaacggttacgttaccgttaccgttcccgacccttacgtacccgttaaccgtaccggtaccgtaacggacctaacgtaccggtagtaaccggtaaagtacccgttagtacgg

SEQ ID NO: 56820 - DNA, 691 bp, Homo sapiens
  misc_feature: GYAE6OF02IY60Q.29.87.H10.1.454.CMB.1.raw
  modified_base (200)..(200): a, c, t, g, unknown or other
  misc_feature (200)..(200): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgganacagagtcaacgtcacgttcggccgggcgagtcgagggcagttaactaattatttagctaggtatcagcagcatccgagggtaacgttccaagctcctagtactctatgtactcgacactctactttcgactaactccggaacggggtccctagttccgttcgggttactacgggttcgggccgggttaggtacgttaaggtcggggaacgtaggtacgttcgtaaccttcgtacctaactacgtacaacggctaccgtccgtacgtacccgagtaccgtaggtaaacgtcgttcggttacggaaccttaaacgtttagtttaaccgttacgtttaaacttaaaacggttaccttaactttaccccgtttcccgtaccccgtaacgtttccccgaaacccggtttacccggggtaacggtaaacccgggtaccgaacccggtacggttacggttaaaccggtaaaccgtttaaaaccgggtcgttaacggg

SEQ ID NO: 56821 - DNA, 532 bp, Homo sapiens
  misc_feature: GYAE6OF02FKMWZ.29.87.H10.1.454.CMB.1.raw
  modified_base (356)..(356): a, c, t, g, unknown or other
  misc_feature (356)..(356): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtgggaacagagtcaacgtcacttgccgggcgagtcaggcattaacaattattagcctgtatcagcagcatcccaagggaaagttcctaagctcctgatctatgctgctactccacttttgctaatcacggggtcccatcgtcgttcagtgcggtgtatagngggacagagttcactcgtcaccatcagtcaagcctgctagtctagaagttattttactaatttttacttaacttgtacagtactagttaactcgtaagtcggacttaccggtaacgtttcggaccgtaagggaccgaaggttaggaacgttaccgaaacgtacgtagtaggtaccg

SEQ ID NO: 56822 - DNA, 710 bp, Homo sapiens
  misc_feature: GYAE6OF02GE70M.29.87.H10.1.454.CMB.1.raw
  modified_base (106)..(106): a, c, t, g, unknown or other
  misc_feature (106)..(106): n is a, c, g, or t
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctcctgtctgcatctggtggganacgagagtacaacgtcacttcggccgggcgagtcgagggactaattaacctaatttattacgccttaggtactcgacgtccgagtcctacgtaccggaaggggtaaacgtttaccgtaacggaccttccgtagtacttacgtagttcgctacggtacctactacctacgtttacgactaacgtcggtaccggggtaccctacgttcgttaccggttcgacgggttcgggtcgggtaggtacgtagtacggggtataacggtgttacctacttacctaccacgtaacttccgaacggcctacggtccgacgaccgttagtaccgaaggtaagtagttcgtacgtaacttaactttaacgttccgtaagttaaacctaaaagttccttaaccgttacccgtttacccgaccccgttaaccttcccgttaacccggttacccggaaccggtaaccgggacctaaccgtacgggttaacggtaaaccgtaaaggtttaacccgtagttacggg

SEQ ID NO: 56823 - DNA, 725 bp, Homo sapiens
  misc_feature: GYAE6OF02HR3DA.29.87.H10.1.454.CMB.1.raw
  modified_base (206)..(206): a, c, t, g, unknown or other
  misc_feature (206)..(206): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagactaccagatgtgacatccagatcgacccagtcctccatcctccctgtctgcatctggtggganacagagtacaacgtcacttggccgggtcgagtcgaggctaattaacgtaattattagtcctggtatcagcagcatccgaagggtaaacgttcctaaggcctccgtagatctatcgctagctattcctacttttcgactaagtcgtaccggggttaccctaacgttcgtcggttccgtaaggtcgggtacgggtggtaagtttacggtacggggtaacgtaaggttacgtttaccgtaccgttaccgtacctaacccgtaactaccgtaacgaccgaaccggttacccgtcgaaccgtacggtaccgtacggaaacggtacgtttacggttaaccgtaaccgttaaaccttttacgtttaaccgttaggtttaaaacctaaaacggttaacctttaccgttaacccttttaccccggacccccttacgttaccccgtaacccggtttccggaaacccggtaacggtaacccgtaccggtaacgtacggtaaacggtaaccttaaacggtaccgttacggg

SEQ ID NO: 56824 - DNA, 776 bp, Homo sapiens
  misc_feature: GYAE6OF02FPXU4.29.87.H10.1.454.CMB.1.raw
  modified_base (230)..(230): a, c, t, g, unknown or other
  misc_feature (230)..(230): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatcgtgtgggagacagagtccaacgtcacgttggccgggngagtcgagggcataacaattatttagccttaggtactcagctagacataccgaagggtaaacgttcctaagcctaccgtagattcttatagctcgtctactacctacgtttacgactaacgttcggtaacggggttacccctagttaccgttcggggtttaccgaacgggtttcggggtaccgggttacggggtaaacgtttacgggtcggggtaaccgtaacgggttaacggtttcctaacccgtttaccgttacccgtaacctacgttaccaacggtaccgaaccgggtaccccttacggaccgtaaccggtaccgtacggtaaacgttaggtttacggttaccggtaacctttaaaccgttttaaacgttaacgtttacggttaaaaaccgtaaaaggtttaccttaaccccgtttaacccgttttaccccgacccccctaacgttcccgtaaccccggtttaccccggaacccgggtaaaccgggtaacctaccgggtacggttaacgggtaacgtaaacggttaaaccggtacggttacgg

SEQ ID NO: 56825 - DNA, 757 bp, Homo sapiens
  misc_feature: GYAE6OF02H5K90.29.87.H10.1.454.CMB.1.raw
  modified_base (221)..(221): a, c, t, g, unknown or other
  misc_feature (221)..(221): n is a, c, g, or t
tcagatagagtactcacgaccggtgctcgatttagcagtactgcgttgggtttgggggcagaagtctctctcagtccagacacagcatggacatggacgggccccccgctcagctccgtgggacctcctgctgctctggcctcccagactaccagtatgtacgacatccagagtcgacccagtcctaccactcctccctgtctgactatcgtaggtggganacgagacgtaccaacgtcctacgtgggcccgggagacgtacgacggactaaacgttaactaatttagtttacgccgttcggtaatcgaacgtcacgcctacgtacccggtaaggggttaaaccttaccgtaacgtcccgttccgtagtaactacttacgtcgtcgtaactcctactacgtacgttacgactaacgtccggttaccggtcctacgttcgttacgggtcgtaggtcggtgggactaaggtggtacgggaactacgttcggttaccgtcctactcccgtaactctaacgcaccgtacgtccgtacggcctacggtactaacggtaacgtcggttacgttacaaccgttttaacgtttaacttaacccgtttagttaaaaacccgtaaatttaccgttaaccttaccccgtttacccgaaccccgttattacccccggtttacccggtaacgggtaaaccccgtaacgggtaacctacccgggaacggttacggtaaacggttaaacccgtttaaaccggcggtttacgg

SEQ ID NO: 56826 - DNA, 1117 bp, Homo sapiens
  misc_feature: GYAE6OF02JFLC1.29.87.H10.1.454.CMB.1.raw
tcagatagagtactcacgaccggtgctcgatttagcagtactgcgttgggtttgggggcagaagtctctctcagtccagacacagcatggacatggacgggcccccgctcagcctccgtgggacctccgtgctgctcgtcggcctcccagactaccgagtatcgtagactatccgaaggtaacttccggaacccctaggttaccctacccctaacgttcccccttaccccgttggttacccgttacggtaccttaacgtttccgggttacggggtacggggtaaaaccggccggttaacggaaaccggttaccgtaaaacccggttaccgtaaccggtttaccgggaccccgggggtaacgtaaacgggttaccggaaacggggtaaccgttaaacgtttaaaaccgttaaagttttaaccgtttaacggtacccggtttatagggggttaaacttccgaaagggtacccttaaacggttaccccggaaaaggggttttaacccccgttaacggggtaaaaaaccggttttcccccgttaaaaagggtaccgtttaaaccccgttaaggtaaaccttccggttaaacgttaccggaaccgtttaccggaaccccttaaggttttaccccgaaaaccgttttttagggaacccggtttaaaaccgggtttccccgtaaacggggggttttcccccttaaaacggggtttacccggttaaccgggggtttaccggtaaacgggggtttaccgggtaacccggggtttaaggggaaccggtttaaacggttaacgggggtaaacctaacgggtaaaccttttaccccgaaaccgtttaccgtaaccgtaaaccggtaaactacccggtaaacgtacccgtaacgggtacccttaaacggaccgttaaacggaccggttaagtaacggtaacgttaaccggttaactaaccgtttaaacgttaacgttaaaccgttaaccgttaaactaaaccggttaccgtaacccttaaccgttaccggtaaccccgttaaggttacccgaaaccgttacccgggaaccttaacccgggtaactaaccggtaaaccgttaaccggtaaacttacggtaaccggtaaccg

SEQ ID NO: 56827 - DNA, 659 bp, Homo sapiens
  misc_feature: GYAE6OF02JTY2N.29.87.H10.1.454.CMB.1.raw
  modified_base (169)..(169): a, c, t, g, unknown or other
  misc_feature (169)..(169): n is a, c, g, or t
  modified_base (238)..(238): a, c, t, g, unknown or other
  misc_feature (238)..(238): n is a, c, g, or t
  modified_base (353)..(353): a, c, t, g, unknown or other
  misc_feature (353)..(353): n is a, c, g, or t
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
tcagatagagtactcacgaccggtgctcgatttagcagtactgcgttgggtttgggggcagaagtctctctcagtccagacacagcatggacatgacgggccccccgctcagctccgtgggcctcctgctgctcgtggcctcccagactaccagatgtgacagccagancgaccctagtcctccacttcccgtccctgtctgactctcgtggagggaatacgagagtacaaccgttcncgttcggccgggtcgaagtccgaggctaattaacaatttacgttagccgttgtaactcaggcagactcgtaccgaagggtaacttcgtaacgcctcgtactatcgtatcgctacnctaacttcctatttcgaatacgtaccgacggtcctcgtacgttccgttacgaggggtttccgggagttaccggaagttcgtaacggggtataacggtacgttaccacccgttataaccccngtaaccgtctaccgactacgccgttanccgtagctagaagttcgttactcgtaaacctatttaacgttactacttaaacgtaacaccttttaccgtaccttcccgtacctaccgtacccttaacggtacccgaacggttaaccgacgtacgtaagttaccgtaagtaaacgttaccgtaaggtcg

SEQ ID NO: 56828 - DNA, 817 bp, Homo sapiens
  misc_feature: GYAE6OF02HT7NV.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggcctcccagataccagatgtgacatccagatcgacccagtcctccatccctccctgtctgcatcgtggtgggagacagagtccaacgtcacgttggccgggcgagtcgaggactaattaactaatttattacgtcctaggtatcagcagacaactacccggaagggtaacgtttaccgtaacgtccttccgtagtacgttacttacgtgtccttacgtacctacttacccgttaacgttttacggacctaaacggtttccggaaccggggttacccctaggtttacccgttccggggtttacgaacggggttcggggtaacggggttacgggtaatttacgggtacgggggtaacgtacggtaaccggtttacctaacccgtaccgttacccaaccgttaacgtcccgaacgggtacctacggttacccgtacggaccgtaccgggtaccgtaaggtaaaggttacgtttacggttaccggttaaccgttttaaactttaaaccgttttacgttaaacgtttaaaccgtaaaacggtttaccttacccgttacgtttaccccaccccttaaccggttaccccttaaccccggtttacccggggaaaccggtaacccggggtaaccgttaccgggtacgttaaacggtaaaccggttaaaccgttaaaccggtaccgttacgggg

SEQ ID NO: 56829 - DNA, 591 bp, Homo sapiens
  misc_feature: GYAE6OF02IBJR6.29.87.H10.1.454.CMB.1.raw
  modified_base (107)..(107): a, c, t, g, unknown or other
  misc_feature (107)..(107): n is a, c, g, or t
  modified_base (201)..(201): a, c, t, g, unknown or other
  misc_feature (201)..(201): n is a, c, g, or t
  modified_base (285)..(285): a, c, t, g, unknown or other
  misc_feature (285)..(285): n is a, c, g, or t
  modified_base (334)..(334): a, c, t, g, unknown or other
  misc_feature (334)..(334): n is a, c, g, or t
tcagatagagtactcacgaccggtgctcgatttagcagtactgcgttggggtttgggggcagaagtctctctcagtccagacacagcatggacatgagggcccccgntcagctcctgggactcctgctgctctggctcccagataccagatgtgacatccagatgacccagtctccatcctcctgtctgcatctgtggganacagacgtacaacgtactacgtcggccgggacgagtcgacgggctaattaacctaagttaatttagaccgtggtagtcaagcanctaatccgaagggtaaacgttacctaacgtctcctacgattctaagtcnctagcatcactttgactaatcgtacgggtccatcgtcgttgagtcggtcgtcgagtgtacggacgacgtagtacgtactactactaccagtacacgactacgctcgacgaccgctacgaagtacgtgttacgtacttaacttaacgtttaacgtacgtaaactaaacgttaactaccgttacttccaccctacgtaactaccgttaccggaaccgtaacgaacgacgtacgtaggaacgtaagttaaccgagtacgg

SEQ ID NO: 56830 - DNA, 707 bp, Homo sapiens
  misc_feature: GYAE6OF02G7DVS.29.87.H10.1.454.CMB.1.raw
  modified_base (204)..(204): a, c, t, g, unknown or other
  misc_feature (204)..(204): n is a, c, g, or t
  modified_base (536)..(536): a, c, t, g, unknown or other
  misc_feature (536)..(536): n is a, c, g, or t
tcagatagagtactcacgaccggtgctcgatttagcagtactgcgttgggtttgggggcagaagtctctctcagtccagacacagcatggacatgaggcccccgtcgagctcctgggactcctgctgctctggctcccagataccagatgtgacatccagatgacccagtctaccatccctccgtgtctgcatcgtggtagganacagacgtcaaacgtcacttcggccgggacgtagtcgagggactaagttaacaattagttaacgccgttaggtaactcgaagaccgagtacgtactacggaaacgggtaaagttacctaagtactacctagacgttaccttatacgtcgtacgtactaacgtcctaacgtttcgaactaacgtcgtaaccggggtaccctacgtaccgttcggtacgtaggtacgggtacggtaacggtagtaacgttacgggagtaacggttacgttacccgtaataccgtactaaccgttaacgcgtaacgacacgttaccgtcgaccgtacgccgtaanaacgttagtggtactacgtaattaccgttaccttagtaaacgtaaacgttcaaccttacctttaccggaccccttaacttcggtaaccccgttacgaaacccggtaacggttacccgaaacgtttacccgggaaaggtaactttaaaaccggtacggtaaacccgttaggg

SEQ ID NO: 56831 - DNA, 712 bp, Homo sapiens
  misc_feature: GYAE6OF02FWR97.29.87.H10.1.454.CMB.1.raw
  modified_base (106)..(106): a, c, t, g, unknown or other
  misc_feature (106)..(106): n is a, c, g, or t
  modified_base (162)..(162): a, c, t, g, unknown or other
  misc_feature (162)..(162): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctcgctctggctacccgagtactaaccagactggtanacatccaggatcgaccctagtctccatccctccgtgtctgctatcgtgtcgganacngatcaacgtctacgtcggcccgggagtagtcgacgggctacttaaactaacgtttaatttacgtccgttagtacgtcgtaagacgtacgcgtactaccggaacggttaaacggttaccttaacgccttaccgtcgtactctagtcgtcctaggcctacttaccgttacttacgactaactaccggtaccgggtaccttacgtccgttcgttaccggtagggtcggacgggtaggtacgtggtacgacgtaacggtcttactactacctacgacctacgaacgcgacacgtaccgtcgtacacgtaccgtagtaaccgggttattcgttactaaccgtttaacgttactttaaccgtagtaaaccgtaaacttagttacccgttacctttacccgacccgtaaccgttcccgttaccggtacgtaaccccggtaacgacccgttacggtaccttaaagggtaaccttaaccggtaaaccggttacgttaccggg

SEQ ID NO: 56832 - DNA, 665 bp, Homo sapiens
  misc_feature: GYAE6OF02JZQ7O.29.87.H10.1.454.CMB.1.raw
  modified_base (107)..(107): a, c, t, g, unknown or other
  misc_feature (107)..(107): n is a, c, g, or t
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (479)..(479): a, c, t, g, unknown or other
  misc_feature (479)..(479): n is a, c, g, or t
tcagatagagtactcacgaccggtgctcgatttagcagtactgcgttgggtttgggggcagaagtctctctcagtccagacacagcatggacatgacgggcccccgntcagctcctgggactcctgctgctctggcctcccagataccagatgtgacatccagatcgaccctgtcctccactccctccctgtctcgctactccgtggtaggganaccagacgtacaacgtcacgttcggaccgggngtagtcgaggctaataactaatttgttacncgtgtacnctacgacagtacactacggaaggtaacttctaagcctctagatcctagtcgactcgacctactaccttacgtcacgtaactccgggtacggtacctacggttcgttacggtcgagttcggggcgttagcgtagtacggtatacgtctcgtacctccgaacgacctgtaccgacgtacgaccgttaccgtgaaccnccggtaacgtacggtactacggttacgttaccgtaaacgtttaacttaccgggtttaataaccgtaaactaaacgtttactaccgttacccgtcccggtaacctcccgtaccggttaaccccgtcgggtaaaccgtaccggaccgtacggaacgtaacgttaacgtaacggtaccgtaaggttccg

SEQ ID NO: 56833 - DNA, 867 bp, Homo sapiens
  misc_feature: GYAE6OF02HJUTU.29.87.H10.1.454.CMB.1.raw
  modified_base (218)..(218): a, c, t, g, unknown or other
  misc_feature (218)..(218): n is a, c, g, or t
tcagatagagtactcacgaccggtgctcgatttagcagtactgcgttgggtttgggggcagaagtctctctcagtccagacacagcatggacatgacgggcccccgctcagcctcctgggacctcctgctgctctggcctacccagactaccagatgtgacatccagatcgacccagtcctccatccctccctggtctgctacgttcgtggtaggganacaggtacgtacaaccgttcacggttcggcccggggtagtacgtacggaggggtactaattaaactagtttaactttacggacccgttaggttaactaccgaacggtaccgagtaccgtaacggttacccggggaaagggttaaaaccgtttccccgtaaaggtccccttcgttaaggtactttaccgtaaggttccgtcgtacggtaacctaccgttttacccgttaacgtttcgaaccgttacgtacccgggtaaccggggttaccctacggttccgtttacgggtcggtaacgggtcggggtacggttaggtacgtacgggtacgggtaacgtacggttacgtttacccaccgttacccgtaactaccgtactaaccgacgtacccgtaacggtccgtacgaccgtacgtacggtacgtaaaggtctttaaccggtacgttaacccttaacgttttacgtaaccgttaaccgttaaacgttaaaacctttccgttaaccgtaacccggtttacccccgacccgttacgtttacccccggtacccgttaaccggggaaaccccggtaaccgggtaaccgttaacccgggtttaaggtaaccggttaaaaccggtttaaaccggtttaaccgggtacgttaaccgggg

SEQ ID NO: 56834 - DNA, 787 bp, Homo sapiens
  misc_feature: GYAE6OF02G4K9H.29.87.H10.1.454.CMB.1.raw
  modified_base (107)..(107): a, c, t, g, unknown or other
  misc_feature (107)..(107): n is a, c, g, or t
tcagatagagtactcacgaccggtgctcgatttagcagtactgcgttgggtttgggggcagaagtctctctcagtccagacacagcatggacatgacgggcccccgntcagcctcctgggactcctgctgctctggctcccagataccagatgtgacatccagatcgacccagtctccactccctccctgtcctgcatcgtggtgggaacgactagacgttaccaacggtcaacgttggccgggcgagtcgagggctaattaaactaattatttacgccttagggtaactcgtagacgagtaccagtacccggtaaaggggtaaacgttacccttaaaggccttaccgtagttactactacgttcggacttacgacgttaacttccgtaaccgttttacgactaaacgtccggtaaccggggttaccctacgttccggttacggtttacggagggttcggggtacgggttaaggttacggtaacggtacggggtaaacgtacggttaacgttaccgtaccgttaccgttaccaacctacgtaccgacggtaacccgacgccgttacggacccgtacgacggtaaagtagtaacgttcgggttaacctacgttaaattttaacgtaacttaaacgttaaacttaaaacgttaccttacgttaacccgtttcccgaaccccttcgtttaaccccgacccggttttaaccgggaaacccgtaagggaaacccgttacggtaaaccggttacgggtaaaacgttaaccggttaaaccggtaccgttacggg

SEQ ID NO: 56835 - DNA, 830 bp, Homo sapiens
  misc_feature: GYAE6OF02FQKJY.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagactaccagatgtgacatccagatcgacccagtctccatcctccctgtctgcatcgtggtggganacagacgtacaacgtcacgttcggcccgggtacgagtccgaggggtacctaagttaaacctaagtttaacgttttaagcccgttagggttaacttaccgaggtaccaggtacctaactacccggaaagggtaaaacgtttacccgtaaacggtacccttaccgtaggtaacttcgttaacgttcgtaccttactacgttccctaacttttaggactaaacgtccggtaacggggttaccctacgtttacccgttacgggtttacgtaagggttccgggtacgggttagggtaaattacggtacggggaacgtacggttaacgggtttacccaccgttccgttaccaaacctacttaccgacgtaccacggtacccttacggccgttaacgaccgtaacgggagtacggttaggttaccgtaaaccttaaccgtttaagttaccctagtttaaaccgtaaaacggttaccttaacgttaacccgtttacccgtacccccttacgttaaccccgtccgttaaccccgggtaaccgggaaaccggtttaaccccgaaccggtaccggttaacggttaaacccgggttaaacgtttaaaccccggttaacggttaccggttaacccggg

SEQ ID NO: 56836 - DNA, 592 bp, Homo sapiens
  misc_feature: GYAE6OF02FTWCD.29.87.H10.1.454.CMB.1.raw
  modified_base (107)..(107): a, c, t, g, unknown or other
  misc_feature (107)..(107): n is a, c, g, or t
  modified_base (202)..(202): a, c, t, g, unknown or other
  misc_feature (202)..(202): n is a, c, g, or t
  modified_base (405)..(405): a, c, t, g, unknown or other
  misc_feature (405)..(405): n is a, c, g, or t
tcagatagagtactcacgaccggtgctcgatttagcagtactgcgttgggtttgggggcagaagtctctctcagtccagacacagcatggacatgagggccccccgntcagctcctgggactcctgctgctctggctcccagataccagatgtgacatccagatgacccagtctccatcctccctgtctgcatctgtggganacagagtcaacgtcacttgccgggcgagtcaggcattaacaattatttagcctggtatcagcagcatccagggaaacgttcctaaagctacctgatctatgctgcatcctactttcgcaatcaggggtcccatcgtcggttcagtgggcggtggagtagtagggactagtagttcactacctcaaccatacacgacagtcccngcacgccgtacgaaggtattggttagactaaacctttaacgttacttacggttaactaaaacgttattacccttaacgtttacccgacccctaacgttccctaaccgtttacccgggaacccgaaaccgggaccgtaacccgaacgttacgggtaacgtaacggtttaaaccgtaacgttaaccggg

SEQ ID NO: 56837 - DNA, 766 bp, Homo sapiens
  misc_feature: GYAE6OF02FZIQ0.29.87.H10.1.454.CMB.1.raw
  modified_base (219)..(219): a, c, t, g, unknown or other
  misc_feature (219)..(219): n is a, c, g, or t
tcagatagagtactcacgaccggtgctcgatttagcagtactgcgttggggtttgggggcagaagtctctctcagtccagacacagcatggacatggacgggcccccgctcagctcctgggacctcctgctgctcgtggcctcccagactaccagatggtgacatccagatcgaccccagtcctccactccctccctgtctgctacttcgtggtggganacaggtacgtaccaaccgtctacgttcgggccgggcgagtcggacggactaattaaacctaatttaattacgccttaggtactcgagcacgcctacgtaccggtaagggtaaaccgttccgtaacgcccttacgtagtacttcgtaagttcgcgtacgactccgttacctacgtttacgacctaacgtccgggtaccgggtcctagttcccggttacggttacgaggggttaccggggtcgggttaacggtaggtacggtacggggtaacgttagtaccggtttacctacgttaccttacccgacctagttcccggacgaacccggtcgttaccccggtcggtaccgaaccggttaccggtaagtaaccgggttagtttccgggttaacctaacgttttaacctttaagttaccgttaacgttaaactaaaccgtttactacccgttaacccttccccgaacccttcggtaaccccgttaacccgtcggaacccggttaagacccgtacggtacgtacgggtaaataaaccggttaacgcgtacggg

SEQ ID NO: 56838 - DNA, 751 bp, Homo sapiens
  misc_feature: GYAE6OF02JI2C4.29.87.H10.1.454.CMB.1.raw
  modified_base (106)..(106): a, c, t, g, unknown or other
  misc_feature (106)..(106): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggcctcccagataccagatgtgacatccagatcgacccagtctccatcctcctgtctgcatctggnggganacagactcaacgtcacgttcggccgggcgaagtcgaggctaattaactaatttagttagccgttaggtactacagtacagacgtatacccggaaagggtaaacgtttaccgtaacgtcccttacgtacggtaacttacgttaacgttacgctacggaccgttaacttacccgttacgtttacgaaccgtacgttaccggtaccggggttaccctaagtttcccgttaacgggttacggtaacgggttcggggtacgggttagttaacggtacggtacgggtaacgttacggtaccgtttaaccgacccgttacgtaccgtaaaccgtagtaacgaccgtaccgtaaccggtccgttacggaacctacggttacccgtaaggtaacgttacgttaggtaaccttaccttaaacgtttacgtaaccgttacgttaaacggaaattaccgtaccttaccgttccgtaccccgtattccccggtaaccgttacggaaccgtaacggaaccgtacgtaccggtaagttaacgtaacggttaccgtaagtccgg

SEQ ID NO: 56839 - DNA, 665 bp, Homo sapiens
  misc_feature: GYAE6OF02I69W2.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctcctgtctgcatctggtggganacagagtcaacgtcacttcggccgggcagtcgagggcattaacaattattagcctggtatcgagcagctactccgaagggtaaacgtttccgtaacgtccttacctagtacttctattcgcttcgactactccttacttagactaacgtacgtacggggtccctattcggttacgttcgtagggtcggtcgggtaggtacgtacgtacgggactacggtagttaccacttcgacctaaccgtacgtacgtaaccgccgtaacgtcccgtagaccgtacgacccgtagtaaacgtcgttacggttacgacttaactttaacgttacgttaacgttaaacgtaaacgttaccttaccgttacctttacccgtacccctacgttaaccccggttaccgttaccgggaacccgtaacggacccgtaacgtacggtaacgtaacgtaaccgtttaacggaccttacggg

SEQ ID NO: 56840 - DNA, 676 bp, Homo sapiens
  misc_feature: GYAE6OF02ISSQ7.29.87.H10.1.454.CMB.1.raw
  modified_base (107)..(107): a, c, t, g, unknown or other
  misc_feature (107)..(107): n is a, c, g, or t
  modified_base (157)..(157): a, c, t, g, unknown or other
  misc_feature (157)..(157): n is a, c, g, or t
  modified_base (208)..(208): a, c, t, g, unknown or other
  misc_feature (208)..(208): n is a, c, g, or t
  modified_base (473)..(473): a, c, t, g, unknown or other
  misc_feature (473)..(473): n is a, c, g, or t
  modified_base (520)..(520): a, c, t, g, unknown or other
  misc_feature (520)..(520): n is a, c, g, or t
tcagatagagtactcacgaccggtgctcgatttagcagtactgcgttgggtttggggacagaagtctctctcagtccagacacagcatggacatgacgggcccccgntcagctcctgggacctcctgctgctctggcctcccagataccagatgtanacactccagactcgacccgagtcctccatcctccctgtctgcactcgtggngggacaacgtagacgtacaacgtcctacgttacgggcccgggagtacgtacgaggtacctaattaaactaactttagttacgcctagggtactacgacggactaaggcctaagtacccggaaagggtaactttacccgaagtcccttccgtaagtacttaccgtttagacgtcttccggacctaagttaccccttagttacaccgtaacgccggtaccgggtacccttagtcggtcgtacgaggtcggtcggtagtactacgggngacgtatccgtagacctcgtacacgtatcgaactcaaccgttcacgnaccgtagtagagttgacgttacgtaactaacgtttataacgttaacgtaaactaacgttactcccgtaacttacccgtaccttaacctcccggtaaccttcgggaaccgtaacgaacgtcgtaacggtacgtaaacgtaacgtacgaagttcccgg

SEQ ID NO: 56841 - DNA, 822 bp, Homo sapiens
  misc_feature: GYAE6OF02GNZ3U.29.87.H10.1.454.CMB.1.raw
tcagatagagtactcacgaccggtgctcgatttagcagtactgcgttgggtttgggggcagaagtctctctcagtccagacacagcatggacatgaggcccccgctcagctcctgggactcctgctgctctggctcccagataccagatgtgacatccagatgacccagtctccatccctccctgtctgcatctggtgggagacagagtacaacgtcacgttcggcccgggtacgaacggtccgaggggtactaactttaaaccgtaaattttaagtttacgaccccgttagggttaacttccgaacggtaccgaaggtccgtaagttacccgggaaagggggtaaaaccggttttaaccccgtaaacggttcccgttacccgtaaggtaacctttaccgttaacttacggtccttacggaccgtactttccccgttaacgttttcgaccttaaacgttccggtaccgggggttaccctagttccggtttaccgggtttacgtaaggggttcgggtacgggttaggtacgtttaggtacggggactagggtacgtttaccaccgttcccgtaccaccttacgtcgacgaccgacgtccgtcgaccgtacgtaccgtaaggtaaacgttgttacgttacgtaacctttaacgtttacgtttaacgttagttaaaccttaaaagtttccttaaccgtttaaccctttcccgtaacccccgttagttaaccccgttaacccggttacccggaaacccggtaacggaacccgttaaccgaacggttacgggtaaaccggttaacgtttaaaccggaccttacgggg

SEQ ID NO: 56842 - DNA, 821 bp, Homo sapiens
  misc_feature: GYAE6OF02F8YVD.29.87.H10.1.454.CMB.1.raw
  modified_base (105)..(105): a, c, t, g, unknown or other
  misc_feature (105)..(105): n is a, c, g, or t
tcagatagagtactcacgaccggtgctcgatttagcagtactgcgttgggtttgggggcagaagtctctctcagtccagacacagcatggacatgaggcccccgntcagcctcctgggactcctgctgctctggctcccagataccagatgtgaccatccagatcgacccagtcctccatccctccctgtctgcatcgtgtagggacacaggtacgttcaaaccgtctacgttcggcccggggtcgacgtccgaaggggactaagtttaaaaccaaagttttactttaacggtaccccgtttagggttaactttaccgaggttaccgaacgaccgtaacgttacccggtaaacgggggtaaacgtttacccgttaaacggtaccgttacccgtaagtaacttcgttaacttcgccgttacggtacctacgttacctaccgttttacgaccgtaaacgtccggtaccgggggttaccctaacgttccgtttacgggttaccgtacggggttcgggtacgggttacggtaacgttaacgggtacggggtaacgtaaggtaccgtttacgtaccccgttacctaccgtaaccgtaccttacggacgtaccgtaaccgtaccgtcgtaaccggtaccgtctaaggtaacgtacgttacgttcggtaaactacttttaaccgtacgttactaaacgttaaagttaccttacgttaccttaccccgaccctaccgttaaccgttacccggtttaaccggaccgtaacgggtaacctaccgggtaaccgttaccggaacggttaaacgttaaaccgtacgttaacggg

SEQ ID NO: 56843 - DNA, 727 bp, Homo sapiens
  misc_feature: GYAE6OF02JH8OD.29.87.H10.1.454.CMB.1.raw
  modified_base (156)..(156): a, c, t, g, unknown or other
  misc_feature (156)..(156): n is a, c, g, or t
  modified_base (548)..(548): a, c, t, g, unknown or other
  misc_feature (548)..(548): n is a, c, g, or t
tcagatagagtactcacgaccggtgctcgatttagcagtactgcgttggggtttgggggcagaagtctctctcagtccagacacagcatggacatgacgggccccccgctcagcctccgtgggacctcctgctgctctggctcccagactaccagntgtgacactccagactacgaccccagtcctcctactccctcccttgtcgtcgactacttcggtggtggggaatacgaacggtagtacccgaacgtcctacggttccgggccggggtacgtaacggtcggaacgggtacttaaacgtttaaaacctaagttttacttaacggtccgttaggtaactcgtaacgcacggtaccctagtaacccggaagggtaaacttcccgtaacgtcctccgtagacttcgtacgttgccgtacgtacctacgttcctacgtttccgaacgtaacggttcggtaaccggtcccttagttccggttcggtagacggttcggtcgggtaagtatgggtacggacgtagtacgtactacggtctaccgatcgtacncgactacgctacgaccgtgaccgttaggacgttgttaccgtacgtaacgttaacttcgtaccgtaacttaaaccgtaaacttaccgttactaccgttaccctcctaacgtaccccgtaggttaccgaaccgtacgaaccgtacgtaacgaacggtacgtaaaccgttacggtacgtcgg

SEQ ID NO: 56844 - DNA, 844 bp, Homo sapiens
  misc_feature: GYAE6OF02JX8XB.29.87.H10.1.454.CMB.1.raw
  modified_base (188)..(188): a, c, t, g, unknown or other
  misc_feature (188)..(188): n is a, c, g, or t
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
tcagatagagtactcacgaccggtgctcgatttagcagtactgcgttgggtttgggggcagaagtctctctcagtccagacacagcatggacatgacgggcccccgctcagctccctgggactcctgcctgctctggctcccagataccagatgtgacatccagtatgacccagtctccatcctcctntacngccagtctgtggganacagacgtacaacgtcctacgttcggacccggggtcaggttaccgaacggggtctaaactttaacctaaattttaacgtttaacggacccgtttacgggttacgtaccgtaacgtaccgaacggtacctaaccggttacccggtaaacggggtaaaaaccgttttaccccggaaaccggttaacccgtttcccgttacgggtaaccttttaccgtaaacgttcgttaaccggtaccggtaaccctaccgttaaccccttaaccggtttcggtaaccctaacggtaccgttaaccggggttaccccgttaaaccgtttccggttacggtttacgggtaccggttttacggggacgggttacggtaacggttcggttaacggggacttaacgggtaactccggttacctaccgtaacctaccgtaatccgtacgaccgtacgccgttaccgacgttcgaaaccgttgaacgtggttacgtactacgttaaacttcgtttaaccgtaagttaaaccgttaaagtactttaaccgttacccttaccgccctttaacggtacccttacccgtaccggtacccggtaaaccgtccgtaaccgttacggaaccgtaacgtttaaccgtaacgtacttaacgggg

SEQ ID NO: 56845 - DNA, 679 bp, Homo sapiens
  misc_feature: GYAE6OF02HBCS4.29.87.H10.1.454.CMB.1.raw
  modified_base (202)..(202): a, c, t, g, unknown or other
  misc_feature (202)..(202): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctggtggganacagactcaacgtcacgttcggccgggcgagtcgagggctaattaaactaattactttagcctggtactcagcagcactacgaaggtaaacgttcctaacgtctcctagtactactatgctgtaccacttcctactttcactaactccggtaacgggtaccctagttcgttaccggtttacagggttccgggtacgggttaggtaacgtttagggtacggggtaacgtaggtacggttacctaccgttccgttacccaaccgttactaccgacgaccgaccgtccgtcgacgacgtaccgtagaagttgttcggttactacttaactttaacttaccgttaacgttaactaaacgttactaccgttacctttcccgacccctaacgttacccgtacccgttaacccggtaaccggtaacggacccttaacgggtaccgtaagggtaacctaaacggtttaaaccgtaggttaaccgg

SEQ ID NO: 56846 - DNA, 899 bp, Homo sapiens
  misc_feature: GYAE6OF02FWEEO.29.87.H10.1.454.CMB.1.raw
  modified_base (158)..(158): a, c, t, g, unknown or other
  misc_feature (158)..(158): n is a, c, g, or t
tcagatagagtactcacgaccggtgctcgatttagcagtactgcgttggggtttggggggcagaagtctctctcagtccagacacagcatggacatggacgggcccccgctcagctcctgggactcctgctgctcgtggcctccagataccagatgtnacatccagatcgacccagtctccactccctcctgtcgtgactactcgttggtgggaactaacgaggtacgttaccgaacgtccgtacgttcgggacccggggcggtacgtacggacgggaacttaacgtttaaacctaaagttttaacgttttacggacccgttttagggttactaccgtacggacctaacggtacccgtaaaccgttaaccgggtaaaacgggggttaaccgtttaccccggtaaacggtccccgtttacccggtaggttaaccgttacccgtttaacgtttcgggtacccttacggtaaccctttaacccgtttcccgttaccgtttttaacggacccgttaaccggttaccgggttacccgggggtttaccctacggtttccggtttacggttacggttacggggttacggggttagggttacgggtaacgttacgggtacgggggtaaccttacgttaccggttaccgtacccttaacgtacctaacgtaccggtaccacggtacccgtacgttaccgcgtaccaccgggttactagggtaacgttcgtacggtttacctaactttaaccgttttacgttaacggttaacctaaaggtttaaccttaccttacgttacccttccccgggtaaccccttacgttaaccccgtaccggtttaccgggaaaccgtacggttaaccccgagggttacgtacggaacgttaacgtaaccggtcgttaaccgg

SEQ ID NO: 56847 - DNA, 734 bp, Homo sapiens
  misc_feature: GYAE6OF02GTYR3.29.87.H10.1.454.CMB.1.raw
  modified_base (207)..(207): a, c, t, g, unknown or other
  misc_feature (207)..(207): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgacatccagactgacccagtctccactccctccctgtctgctatcgtggtgganacaggatacaaccgttctacgttcggccgggacgagtacgaggggactaattaaacctaagtttaactttacggcccgttggtaactcagccaaggcctagtaccgaaggggtaaacgttcccgtaaacgtcccgttactacgtacttacgtagtcgactcgactacctacctacttacgacaacgtaccgaccgggtcctagtcccggtttcggtaccggtaaggtccgggtaggttacgggatttacggtacggacgtaggtccgttactaccgtccttaccgacacgttaccgaactccgtacgtccgacgtaccacggtaccgtaaggttaaccggtaattcgggtaccttaacgtttaacgttaacttaacgtcgtttaaaacgtaaacgttatacccgtttaacttacccgtacccccgttacgtaacccgtttacccggtacgggtaaccccggtaaccgggtaaccgaacccgtacgggttaaggaaacccgtttaacggtaaacgtaccgggtaccgg

SEQ ID NO: 56848 - DNA, 777 bp, Homo sapiens
  misc_feature: GYAE6OF02FT650.29.87.H10.1.454.CMB.1.raw
  modified_base (108)..(108): a, c, t, g, unknown or other
  misc_feature (108)..(108): n is a, c, g, or t
  modified_base (764)..(764): a, c, t, g, unknown or other
  misc_feature (764)..(764): n is a, c, g, or t
tcagatagagtactcacgaccggtgctcgatttagcagtactgcgttgggtttgggggcagaagtctctctcagtccagacacagcatggacatggacgggcccccgntcagctccgtgggactcctgctgctcgtggcctcccagataccagactgtgacactccagatcgacccagtcctaccactccgtaccctgtactacatcgtggtacggacacagtacgtaccgaacgtcctacgttcggccgggacgtacggtcgacgggtctaaacttaacgtaatttacgttacgccgttaggtactacgagcgagtacctacgtaccggaaagggtaaccttaccgaacgtccgttaccgtagtaactaccgttagtcgtcgttacgaccttacgttacccttaagtttccggaactaaggttcccggtacgggtaccctaggtttccggttacggttacgtaggggttaccggggtacggttacgggtagttacgggtaccgggtaataaccggttacgttcccgtacgtaccgtaaccaccgtactcggaactccgacgtaccggttacgaccgtagtccggttaaacgtagttacgttacgtacgtaaaccgtttaccgtttaagttaacgttaaccgtaacgttaaacgttcgttaccgttaaccttccccgtacctacgttacccggttacccggtaccgtaacggtaccgtaacccgaggtttaacggaacggttaaccgtaaacggtttaacccgnggtacgtaaccgg

SEQ ID NO: 56849 - DNA, 774 bp, Homo sapiens
  misc_feature: GYAE6OF02I1G82.29.87.H10.1.454.CMB.1.raw
tcagatagagtactcacgaccggtgctcgatttagcagtactgcgttggggtttgggggcagaagtctctctcagtccagacacagcatggacatgacgggcccccgctcagctccgtgggactcctgctgctctggcctcccagactaccagtatgtgacatccagatcacccagtcctccacttcccctccttgtacctgacctatcgttggtagggacgacaaggacgtacctaaccggtctaaccgtttcgggacccggggtacaaggttaccggagggtacctaaacgttttaaacaaagttttactttacgggacccgttagggttaactacgtaacggaccgtaacgaccgttaacgaaccggtaacggggtaaacgtttacgtaacggtccttacgtagtacgtcgtaatcggctcgataccgtactacgttacgactacgtccgggtacggttcccgtaattccggtacggtcgagggttccggtaggtacggtcgtagggacggtacgtacgtacttaccgactcctaacgccgtaactcgacgtaccacgttccgtggtaaccgcgttaaccggtaagtacggttaacgtccggtttaaacgaccctttaaacgtttacttaggtaaccgttaaaagtacgtttaatttcccgtaccgtttaccccgaccttacgtaacccggttacccgtaaccgggaacgtaaccccgtagaacccggttaaggtaaccggttaacggtaaaccgttacgacggttacggg

SEQ ID NO: 56850 - DNA, 722 bp, Homo sapiens
  misc_feature: GYAE6OF02HOEZP.29.87.H10.1.454.CMB.1.raw
  modified_base (161)..(161): a, c, t, g, unknown or other
  misc_feature (161)..(161): n is a, c, g, or t
  modified_base (171)..(171): a, c, t, g, unknown or other
  misc_feature (171)..(171): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
  modified_base (522)..(522): a, c, t, g, unknown or other
  misc_feature (522)..(522): n is a, c, g, or t
tcagatagagtactcacgaccggtgctcgatttagcagtactgcgttggggtttgggggcagaagtctctctcagtccagacacagcatggacatggacgggcccccgctcagtcctccgtgggactcctggctgctctggctacccagactacagatgtnacatcagtancgacccagtcctaccacttcctcctgtctcgctatcgtggtaggacgacgtagacgtacaacgtacgacgttcggaccgggactacggtacgaggacttaacttaaacgtaattagtttacggccttaggtacncgaggtcncgtactacgtaccgggtaagggtaaccttacgtacgccgttacncggtaactntaacggtctacgtcgcctacttaccgtnttacgacgtaacgtacgggtacggtccttagtccgttacggttacgaggggtacggtacggttaggtacgtagggtaccggtactacggtacgttctaccgtacctaaccgaacgtatccggtaaacncgttacggaccttacgaccgttcctaacgtagaacggttatagtttacctaaacgttacttaacgtttacgtaacttaaagttaaccgtttctaaacccgtttcctaccctaacccctaagttcccgtacccgggacggtaaccggaaacgttccgtaacgttaacggtacggtaacgtttaaagtacccgtggttaccg

SEQ ID NO: 56851 - DNA, 665 bp, Homo sapiens
  misc_feature: GYAE6OF02H9R8Y.29.87.H10.1.454.CMB.1.raw
  modified_base (187)..(187): a, c, t, g, unknown or other
  misc_feature (187)..(187): n is a, c, g, or t
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggccccgctcagctcctgggactcctgctgctctggctcccagataccagatgtgacatccagatgacccagtctccatcctccctgtcngcatctggtggganacagagtcaacgtcacttggccgggagagtcgacgggcaagttaactaatttattacgccgtgtactcagcacgcactccgaaggtaacgttcctaagctctgatctatgctgactactcctatttgactagtcgacgggtcctacgttcttcggttcgaggtcgggtcgggtaggtagtacggtacgggacgtaggttacgtaccgtactccgtaccaacctataccgacgcctacgtacctcgacgtacgaccgtaggtaacgtcgttagttacgtaacttaaccttttaacttaccggttaacgttaaacgttaaaacgttacttaccgttaccgtttacccgaccccttaaccgtaccccgttaaccggttacccgggaaaccggtaaccgggtaacccgtacggtaaccggttaacggtaaaccggttaaacgtttaaacccgggacgtttaaccgggg

SEQ ID NO: 56852 - DNA, 775 bp, Homo sapiens
  misc_feature: GYAE6OF02I1UBR.29.87.H10.1.454.CMB.1.raw
  modified_base (119)..(119): a, c, t, g, unknown or other
  misc_feature (119)..(119): n is a, c, g, or t
tcagatagagtactcacgaccggtgctcgatttagcagtactgcgttggggtttgggggcagaagtctctctcagtccagacacagcatggacatggacgggcccccgctcagctccgngggactcctgctgctctggcctcccagactaaccagtatgtagacagtccagactacgaccctagtcctaccacttccctcccgtgtactcgctactcgtgggtagggacgaacgaggaacgtaccgaaccgtacgtacgttccgggccggggacgtaacggtaccggaggtaaccttaaaacttaaacgtaattttaacgtttacggccgttaagggtaactacgacgctaacgactaccggtaaccggtaaagggttaaacctttaccaaacggtcccttacgtacggtaacttaccgtatcggactactaccgtacttacccttagttagactaaccgtacgggtacccggtacctagttcggttaccggttgtacggtacgggacggttaggtagtcggaggaaccttaggtaccgttacctaaccgtcctaccgtaactacgtccgtaacgactacgtacgtacgacggaaccgtacgtaaggtaattaccgttagtaaccgttaactttaaacgttataaccggttaaactaaataaacggttacttaccctacgttaccccacgttaacctacgtacccggttaagaacccgtaaagggtaccctaagggtaacgtaacgggttaaactaacggtacggtaccggtacg

SEQ ID NO: 56853 - DNA, 543 bp, Homo sapiens
  misc_feature: GYAE6OF02FKGTY.29.87.H10.1.454.CMB.1.raw
  modified_base (213)..(213): a, c, t, g, unknown or other
  misc_feature (213)..(213): n is a, c, g, or t
  modified_base (286)..(286): a, c, t, g, unknown or other
  misc_feature (286)..(286): n is a, c, g, or t
  modified_base (384)..(384): a, c, t, g, unknown or other
  misc_feature (384)..(384): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggagcagagtcaacgtnacttgccggcgagtcaggcattaacaattattagcctggtatcagctagcatcgaggtaactctaagcctacngatctatgctgcatcatttgacactcgacgggtccactcgtcggttacacgtcgggcgtgtaactggtacggacgtagagttcaactctccaaccgtnttaccagctacgcctagcacgctagacgtattggtctacgtaatttactacgttcgtaaactaaagttactaccttacgttaccgtacccagttaacccgtaccgtttacccgacgttaacgggacacgtacgtaggtaagtaactaacgtactacggg

SEQ ID NO: 56854 - DNA, 741 bp, Homo sapiens
  misc_feature: GYAE6OF02I8BJP.29.87.H10.1.454.CMB.1.raw
  modified_base (108)..(108): a, c, t, g, unknown or other
  misc_feature (108)..(108): n is a, c, g, or t
  modified_base (156)..(156): a, c, t, g, unknown or other
  misc_feature (156)..(156): n is a, c, g, or t
  modified_base (227)..(227): a, c, t, g, unknown or other
  misc_feature (227)..(227): n is a, c, g, or t
  modified_base (534)..(534): a, c, t, g, unknown or other
  misc_feature (534)..(534): n is a, c, g, or t
  modified_base (554)..(554): a, c, t, g, unknown or other
  misc_feature (554)..(554): n is a, c, g, or t
tcagatagagtactcacgaccggtgctcgatttagcagtactgcgttgggtttgggggcagaagtctctctcagtccagacacagcatggacatggacgggcccccgntcagcctccgtgggacctcctgctgctctggcctccagactaccagtntgtgaccatccgagatcgaccctagtcctccacttccctcccgtagtcctgctattccgtggtaggggaancgaggtagtccaaaccgtctacgttacggccggggacgaggtacgaggggtactaacgttaaacgaattttaacgttacgaccgttaggtactccgaagtccacgtacgtaactaccgggtaaacggggttaaacgttccccggtaaagtcccgttaccgtaggttaactacgttacgtcgtagtcgactacgtacctatttgacctaacgttccgacgggtccagttccgttacgtcgaggttcgggtacggtaggtacgtacggacgggtacgtgggtaaccttcgacctttaccgccgtaaccntaccgtcgacctacggtccncgtacctacggtcgtagaacgtgttaccggttaataccctaaagtttacctacgagttaaaccaaaggtttcttaccgtaccctttaccgacccttacgtccgtttaccccggtaaggaacccggtaaccgccttaaacggcccggttaaacggtaacgtaaaccgttaaccggttacgtaccgggg

SEQ ID NO: 56855 - DNA, 671 bp, Homo sapiens
  misc_feature: GYAE6OF02F380U.29.87.H10.1.454.CMB.1.raw
  modified_base (131)..(131): a, c, t, g, unknown or other
  misc_feature (131)..(131): n is a, c, g, or t
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (427)..(427): a, c, t, g, unknown or other
  misc_feature (427)..(427): n is a, c, g, or t
  modified_base (481)..(481): a, c, t, g, unknown or other
  misc_feature (481)..(481): n is a, c, g, or t
tcagatagagtactcacgaccggtgctcgatttagcagtactgcgttgggtttgggggcagaagtctctctcagtccagacacagcatggacatgagagccccgctcagctcctgggactcctgctgctcnggcctcccagataccagatgtagacatccagatcgacccagtcctacctatccctcctgtctgcatctgggtggganacgagtacgtaccaacgtctacgttaggcccgggganacggttcgacgggctaaattaactaagtttacttaacggcccttaggtaatacgacggtacaggtacctacgtacccggaagggttaaacgttcctaaggccttaccgtagacttacctaagtcgctacgctacttacccttagttcacgtactcggtaccgggtaccacgttcgtcggtanacgggtcgggtacggttagagtggtacggagtagtcgtctactctccgactacncgacacgctactacgacgtacgtaccgtagacgtacttacgtctaaccgtactttaaccgttactaacggttaaactaaacgttacttacccgttacttacccgtacccgttaactacccggttaccggttaaccgaccggtaaggtaaccggaccgtaggtaacggtaacgtaacgttaacggtaacgg

SEQ ID NO: 56856 - DNA, 775 bp, Homo sapiens
  misc_feature: GYAE6OF02JP170.29.87.H10.1.454.CMB.1.raw
  modified_base (205)..(205): a, c, t, g, unknown or other
  misc_feature (205)..(205): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagactaccagatgtgacatccagatcgacccagtctccatccctccctgtctgcatcgtgtggancagacgtcacgtcacttggccggcgagtcgaggctaagttaacaatttatttagccttaggttatccgaagtcagccagtacccgaaggggtaacttacctaacggccttaccgtagaacttctaagtcgtacttgacctactccttaagttcgacaacgttcggaccgggttaccctagttccgtacgggtttctaacggggtcgggtaccgggttacggaagtttaggtacggggtaacgtcggttaacggtttacccgtaacgttaccgttacccgtaaacctaacgttaccgaacggttcccggaacgtccctttaccgggaacctaccggtacccggttaagggtaaacgtacgtttaccggtacgttaaaccttaacgggttttaaccttaacggttaacgttaaacgttaaaaccgttaagttcccctttaaccggtttacccctcccccggttaaccttcccgttaaccccggttacgggtaacccgtaaccgggtaaccgtaacccggtaccggttaaggaaaccggtttaaaccgtttaaaccggacggtttaacccggg

SEQ ID NO: 56857 - DNA, 813 bp, Homo sapiens
  misc_feature: GYAE6OF02GDTOH.29.87.H10.1.454.CMB.1.raw
  modified_base (204)..(204): a, c, t, g, unknown or other
  misc_feature (204)..(204): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatcgacccagtctccatccctccctgtctgcatctggtggganacaggacgtcgtaaccgtcgtacttcggcccggggacgtaacggttcgaaggggtcctaaattaaaccgtaaattttaacgtttacgccgttaggtactacgagctacgactaacgtaccggtaaaggggtaaaccgtttaccgtaaacggtccttaccgtaggtaactttaccgttacgtcgtaccgttacgacctaacctttaccctacgtttacggaccttaaacgtaccgggtaaccgggttcccttaacgttccgtttacggttacgtacggggtttacggggaccgggttaggtacgtttacgggtaacgggtaccgtaacgggttaacgttccgtaaccgtttccgaaccttacgtacgttaccgacggtaccgtacgtccgtacggaccgtaccgacgttaacgtaacggtacgttacgttaccgtaaccgtttaacttttaacgttaccgtaacttaaacgtaaaccgttacgttaccttaacccgttcccgtacccctaaccgttcccgtaacccggttacccggtaaaccggtaacccggtaccgttaaccggtacgttaaccggtaacggttaaaccgttaaccggacgtttacggg

SEQ ID NO: 56858 - DNA, 797 bp, Homo sapiens
  misc_feature: GYAE6OF02JAMVD.29.87.H10.1.454.CMB.1.raw
  modified_base (106)..(106): a, c, t, g, unknown or other
  misc_feature (106)..(106): n is a, c, g, or t
tcagatagagtactcacgaccggtgctcgatttagcagtactgcgttgggtttgggggcagaagtctctctcagtccagacacagcatggacatgagggcccccgntcagctccgtgggactcctgctgctctggctcccagataccagatgtagacatccagatcgacccagtctccatcctccctgtctgctagtctggtagggacgacgtagacgtaccaaacggtctaacgttcggaccgggtacgagtaccgagggacctaattaaacgtaattacgttacggtaccttaggtatacgtaggacgtagacctaacgtaccggaaagggttaaccgttacccgtaaacgtccttaccgtaagtacttaccgtagtacggtcctaggtacctaaccgtaccgtaacgtttacgacgtaaacggtaccggtaccggggtacccttaacggttcccggttaccgggtttacgtaagggttacccggggttagggttaacggtaacgtttacgggtacggggtaaacgtaaaccgggttacgtttaacccggtaaccttaccgtaacccgtaaccgttacgtaacccgaacggtacctaaccggttccctagaccgtaacggtaccgtaggtaaacggttgttaacgtacgtaaccttaacgttaacgttacgtaacgttaaactaaacgttacctacgttaaccgttaccgacccttacgtcccttaaccggtaccggtaaccgtaacggtacctaacgggtactaagggtaacctaacgtaacggtaccgtacgg

SEQ ID NO: 56859 - DNA, 769 bp, Homo sapiens
  misc_feature: GYAE6OF02FHRAC.29.87.H10.1.454.CMB.1.raw
tcagatagagtactcacgaccggtgctcgatttagcagtactgcgttgggtttgggggcagaagtctctctcagtccagacacagcatggacatgacgggcccccgctcagctcctgggactcctgctgctctggctccagataccagatgtgacatccagatcgaccagtcctccatccctccctgtctgctatcgtggtcgggatacaggtactccgaacgtctacttcggccgggcgtaggtcgagggactaacttaacgtaactttatttacgccgttacggtattaccgacgtacgacgtccacgttaccggaacgggtaaacgttacctaaacggtccttaccgtagttacgtacttacgtcgtacgtcgacctacttaccttacgttcaacgttactacggtaccgggttaccctagttccgttcggttacgtacgggtcgggtacggtacggttagtaacggtacgggtaacgtaaggttaccgttcgtaaccctttaccgtaccgtaacccgtaactacgtaacgtaccgacggttacccgttacgaccggtaccgtacgttaacggtaaggtacgtttcggttacgtaacctttaaaccgttttacgttacgtttaacgtaaacgttaaacgttccgttaaccgttacccgttacctaccccgtacgttaaccccgttccggttaacccggtaaccggaacggtacccgtacggtaacggttacgtaaacggttaacgttaaaccggttaggttaccgg

SEQ ID NO: 56860 - DNA, 595 bp, Homo sapiens
  misc_feature: GYAE6OF02F20N3.29.87.H10.1.454.CMB.1.raw
  modified_base (201)..(201): a, c, t, g, unknown or other
  misc_feature (201)..(201): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttggccgggcgaagtcgaggggcaattaacaatttatttagccttaggtatcagcagcatccgaggggtaaacgttcctaagcctccgtgactctatgctgctactcctactttgactaacgtcgaacggggttccctagttccgttcggttacgagggttgggcgggttaggataggtcggggacaggtacgttcactctacaccatcgagcacgcctgacacgccgtagaacgtagttcgtacgacttaactttattacgttagtaactaaaagttctacttaccgttaccgacccctagtcctaacccgttacgggaacccgacggtaaccgacggtacggtacggaacgtaacgttaaaccggtagttacggg

SEQ ID NO: 56861 - DNA, 799 bp, Homo sapiens
  misc_feature: GYAE6OF02IYK68.29.87.H10.1.454.CMB.1.raw
  modified_base (105)..(105): a, c, t, g, unknown or other
  misc_feature (105)..(105): n is a, c, g, or t
tcagatagagtactcacgaccggtgctcgatttagcagtactgcgttgggttggggcagaagtctctctcagtccagacacagcatggacatggacggcccccgntcagcctccgtggactcctgctgctcgtggcctccgagtactaccgagactggtcgactactccagtactaccgacctagtcctaccgacttccctccgtgtacgtcgctacgtcggtggtacggagacgagtaccgtacacggtctacgtcggcgagacgtcgagtactaacgttaaacgtatttaagttccgaccggttagtactacggtacgtaccggaacgtaccgtacgttaaacccggaaaggggttaaacccgttaccgtacgtaccctcggttaacgtacgttacgtacgtcgaccgtacgaccttaaccgttcgttaacgtacttaccgacgtttaacccggtccggttaccttcggttaccgtcggttacggcggtcggggttaggttacgacggtttacggaccggtaacgtacgttaccgttaacttacccgtaccgtacctaaacggtacctaaacgtcgaccttaacgtcgtaacgaccgtaggtaacgtacgtaaggttagttaccgtaacgttaacgttaacgttcgtaacgttaaacgtaacgtaacggttacttacccgttacccttaccgtacccgtacgttaaccgacccgggttaaaccgacccgggttaaacgaccgttaaccggtacgttaaccgggaaacctttaacccgggttactcggggttaacccg

SEQ ID NO: 56862 - DNA, 767 bp, Homo sapiens
  misc_feature: GYAE6OF02HC1AN.29.87.H10.1.454.CMB.1.raw
  modified_base (105)..(105): a, c, t, g, unknown or other
  misc_feature (105)..(105): n is a, c, g, or t
  modified_base (192)..(192): a, c, t, g, unknown or other
  misc_feature (192)..(192): n is a, c, g, or t
tcagatagagtactcacgaccggtgctcgatttagcagtactgcgttggggtttggggcagaagtctctctcagtccagacacagcatggacatgaggcccccgntcagctcctgggacctcctgctgctctcggctacccgagactaccagatgtcgacacgtccaagatcgacccagtctccattccccncctgtactcactacgttcgtggtacgggatacagtaccgtacgacgtctacgttggaccgggactacgtacacggtactaaattaacgtaatttacgttaacgccgttaggtcgtaaccgagtacgacgaaccgtacgtaacccggtaaaggggttaccttaccgtaacgtccgttaccgtagttacttacctagtcgttacgtaacgtcctaacgttccctaagtttacgtaacgtaccgttaccgggacggtttcccaacgtttcccggttacgtacgggttacgtccggggttaacgtcggtaacgtaacgggtacgggaacgtacgtaacgtactcccgtacaacccgtactaacgttccgaagccctaggccagacgacgtacgagtaacgtcgttataccgtacttaaacttccgtaacgttaacgttaaaccgaattaacccgtttccctaaccgttaccctccctaacgttccccggttaacccgtacgggtaacccggtaaccgtaaccgtaccgggttaacgtaacccggttaaaggtaaacccggttaagtaccgtaaccgggg

SEQ ID NO: 56863 - DNA, 838 bp, Homo sapiens
  misc_feature: GYAE6OF02I1FIA.29.87.H10.1.454.CMB.1.raw
  modified_base (106)..(106): a, c, t, g, unknown or other
  misc_feature (106)..(106): n is a, c, g, or t
  modified_base (244)..(244): a, c, t, g, unknown or other
  misc_feature (244)..(244): n is a, c, g, or t
tcagatagagtactcacgaccggtgctcgatttagcagtactgcgttgggtttgggggcagaagtctctctcagtccagacacagcatggacatgagggcccccgntcagctcctgggactcctgctgctctggctcccagataccagatgtgacatccagatcgacccagtctccatccctcctgtctgcatctggtggagacagactccaacgtcctacgttcggccgggcgagtcgacggntaacgttaaactaattatttacgtaccgttaggtactcgacgacacggctaacgtacccggtaacggggtaaacgtttacccgtaaacgtcccgttaccgtacgtacgttacctaagttcggtaccttacggaccttacgttaacccctacgttttacgaaccgtaacgttacccggtaacccggggttacccttacgttacccggttcggttaaccgtcgggttaccggggtacgggtaacgggtagtttaacgggttacggggtaaccgttaacggggttacgtttaccccggtaaccgttacccgttaacccgaaccgtttaacgaacccgaccggtaccgtaccggtacccgttacgacccgaccgcccgttaaaggtaacgttaacggtgtttaaccgtaactttaaacgtttacgtttacgtaaccgttaaagtaaaccggtttaactacccgtttacccgtttacccgtaacccccgttacttaacccgggttaaccccgttaccgggtaacccgtaaccgggtaacctacccgggtaacgttaaccggtaaaccggttaaacggtttaaacccggtagttaccggg

SEQ ID NO: 56864 - DNA, 742 bp, Homo sapiens
  misc_feature: GYAE6OF02F7W9R.29.87.H10.1.454.CMB.1.raw
tcagatagagtactcacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatcgtgtgggagacagtagtacaacgtcctacgttcggccgggacgagtcgaggggactaattaacgtaatttaatttagtccttaggttactactaaggcaacggcactaccggaacggggtaaacgttacctaaaccgtcctaccttagaacttacgtagtgtctacgtccacgttccctacgttttacgacgtaaattacccgggtaacggggtaccctaacgttccggttacggtttaccgaacggtttgggacgggttacggtaagtacgttacgggaacaggttacgttctctccgtacgtaaccctagtaccgtaacgaccgacggtaccctcggacctacggacccgtagtaacggtacgttacggtacgtacttaaaccttttagtaaccgtttaacgtaaaccttaaaacggttaccttaaccgttacccgtttacacccccggttactaaccccgttacccggttaaccgggtaacccggtaaaccggtaacgtaacccggtaccggttaaggaaactaaacggttaacggtaactacggg

SEQ ID NO: 56865 - DNA, 773 bp, Homo sapiens
  misc_feature: GYAE6OF02HBLYM.29.87.H10.1.454.CMB.1.raw
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (295)..(295): a, c, t, g, unknown or other
  misc_feature (295)..(295): n is a, c, g, or t
  modified_base (553)..(553): a, c, t, g, unknown or other
  misc_feature (553)..(553): n is a, c, g, or t
tcagatagagtactcacgaccggtgctcgatttagcagtactgcgttgggtttggggcagaagtctctctcagtccagacacagcatggacatgacgggcccccgctcagctcctgggactcctgctgctctggcctcccagataccagatgtgacntccagatgaccagtcnccatccctcctgtctgcatcgtggtggacgacagtagtactaacgtctacgttcggaccgggtacgacgtcgacgggtactaagttaaactaatttaagttcgaccgtaggtatacgaacgngaacgctaacgtaccggtaaacgggtaacttaccgtaaagtccctccgtaggtactagttactacggttctcacgtaacttcctaacgtttcgaaccttaagtccgggtaacggttccctaaggtcccttacgggttacgtacggggtacggtcgggtaggtaaacgttacgggttacgggaacgtagggtacgtttaaccgaccttacgtaacccgtaacttacgaaccgttacgaccgtacgttcccgagttaacncggtaccaggtaaacggtttaccggtataccgttaactttaacgttaacggttacgttaaaaggttaaaccttaacttacccgtttaacccgttaccgtacccccttaacggttaccccgttacccggtaaaccgggttaaccgaaacccgggtacgttaacccggtacggtaaaccgggtaaacctttaaacccggttaaacggttacggttaaaccgg

SEQ ID NO: 56866 - DNA, 681 bp, Homo sapiens
  misc_feature: GYAE6OF02IZ0G1.29.87.H10.1.454.CMB.1.raw
  modified_base (431)..(431): a, c, t, g, unknown or other
  misc_feature (431)..(431): n is a, c, g, or t
  modified_base (573)..(573): a, c, t, g, unknown or other
  misc_feature (573)..(573): n is a, c, g, or t
tcagatagagtactcacgaccggtgctcgatttagcagtactgcgttgggtttgggggcagaagtctctctcagtccagacacagcatggacatgagggcccccgctcagcctcctgggactcctgctgctctggcctcccagactaccagactgtgacatccagatcgacccagtcctccactcctccctgtctgcacttctggtgggagacgtagacgtaccgtaacgtctacgttcgggccgggtcgtacggtacgaggggacctaagttaaacgtaatttacgtttacgtccgttaggtacttcgagccagctacgtaccgaagggtaacttccgtaagtcctaccgtgacttcttaagtcgtctcacctacgttccctagttcgactacgtcgtaccggtcctagttcgttacggtcgtggtcggnggtagagtaggcggtacgtagtactacctactacgtacctaaccgtactcaaccgccgtagccgttcgacgtaccgtccgtaagtaacgtgttcgtacgttaacgttaactttaacgttcgttaacgttaaactaaacgttntaccgtttaccttacccgtaccctacgttacccggtaacccgttacggaaccgtaccggtaaccgtacgtaacggttaccgaagtaaaccgttaccggcgttaacggg

SEQ ID NO: 56867 - DNA, 643 bp, Homo sapiens
  misc_feature: GYAE6OF02JTG45.29.87.H10.1.454.CMB.1.raw
  modified_base (106)..(106): a, c, t, g, unknown or other
  misc_feature (106)..(106): n is a, c, g, or t
  modified_base (181)..(181): a, c, t, g, unknown or other
  misc_feature (181)..(181): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (361)..(361): a, c, t, g, unknown or other
  misc_feature (361)..(361): n is a, c, g, or t
  modified_base (397)..(397): a, c, t, g, unknown or other
  misc_feature (397)..(397): n is a, c, g, or t
tcagatagagtactcacgaccggtgctcgatttagcagtactgcgttgggtttgggggcagaagtctctctcagtccagacacagcatggacatgacggcccccgntcagctcctgggactcctgctgctctggcctcccagataccagatgtgacatccagatcgaccctagtcctaccnttccctcccttgtctgactgtcgtggngganacagtagtcaaacgtcagttcggccgggngagtcgaggctaagttacaatttagttacgccgttagtactcgacgtnagcctacgtaccgaagggttacttacccgtaagcttaccnggtaacttntataggctcgactacttaccgtnttcgactaacgtcggacggtccacgttcgtacgttnacgtggtacgtagtagtcgtaggactagtagttccactacgtccaaagtcacgacgtacacgtcgacgtcgaacttactaggaagttcttagggtacctaccgtttaaattacgttaaccgttaagttaaacccaaaggtttaccctcgttaaccgtttacccgacctttacgtaacccgttaccgtaggaaaccggtacgtaaccacgggttataaccgtaaggttaaccttagggtacctaggg

SEQ ID NO: 56868 - DNA, 679 bp, Homo sapiens
  misc_feature: GYAE6OF02GRV4S.29.87.H10.1.454.CMB.1.raw
  modified_base (107)..(107): a, c, t, g, unknown or other
  misc_feature (107)..(107): n is a, c, g, or t
  modified_base (152)..(152): a, c, t, g, unknown or other
  misc_feature (152)..(152): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
  modified_base (287)..(287): a, c, t, g, unknown or other
  misc_feature (287)..(287): n is a, c, g, or t
  modified_base (352)..(352): a, c, t, g, unknown or other
  misc_feature (352)..(352): n is a, c, g, or t
  modified_base (499)..(499): a, c, t, g, unknown or other
  misc_feature (499)..(499): n is a, c, g, or t
tcagatagagtactcacgaccggtgctcgatttagcagtactgcgttgggtttgggggcagaagtctctctcagtccagacacagcatggacatgacgggcccccgntcagctcctgggacctcctgctgctcgtggcctccagataccagntgtgactatcccgagatcgaccctagtctccattccctcctgtctgctatcgtggtaggganacgngaacgtccgtaacgtcctaggttcggccgggnagcgaggctaattaaactatttattacgccgttgtancgagcagtacacgacgtaacgggtaacgttccgtaacgtcctccgtagtactcttagcgtacgtntacctacttccgttacgttgaccgtaacgtccggtacgggtacctacggttccgttacggttcgtgggtacgggtacggttaggtagtacgggtacgaaggtacgttaacgtccgttacgtacctaccgacctactaccgcgtaacncggtcctacgtcgtaccgaccgttagtacgtcggtttacgtacgttaacttaacgttacgttaaccgtagtaaaccgtaaattcccttaacgtttccgttacccaaccttccgtaccctaccggtaccgaaccggtaacgacgacgttagtaaccggaagtttacctacggtagttccgg

SEQ ID NO: 56869 - DNA, 678 bp, Homo sapiens
  misc_feature: GYAE6OF02H4N7V.29.87.H10.1.454.CMB.1.raw
  modified_base (105)..(105): a, c, t, g, unknown or other
  misc_feature (105)..(105): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (611)..(611): a, c, t, g, unknown or other
  misc_feature (611)..(611): n is a, c, g, or t
tcagatagagtactcacgaccggtgctcgatttagcagtactgcgttgggttgggggcagaagtctctctcagtccagacacagcatggacatgacgggccccgntcagctctggcctctgctgctctgcctccagataccagatgtagaccatccaagtactcgacccagtcctacctactcctcctgtctgcattcgtaggtgggaanacgtagnttaccaacgtctacgttcggccgggntacgtcggaggtactaatttaaactaagttttaacgttacggtccttaaggtacgtacacggtcagtaccctaatacccgggtaaacggttaaacggttttccgtaaagtcccttccgtagtacctcgtttaacgcggtactcggtctacctttacctacggtttcaactacggtacgtaccggtctcgttcgtacgttaccgtgggtcggtcgggtaggttaagtcggtacgggtaacgtacggtagttaccgactcctaacccactacgaccacgtcaccgttccgcgaacgtacgaccttagaacgttacgttgtaactacgttaattacgtacgttacaacgtaacttactacgttaccttacnccctagtacccgttcgtaccggtagtaccgtaccgtagtacggacgtacggtaactacggtactcgg

SEQ ID NO: 56870 - DNA, 885 bp, Homo sapiens
  misc_feature: GYAE6OF02GMAS5.29.87.H10.1.454.CMB.1.raw
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
tcagatagagtactcacgaccggtgctcgatttagcagtactgcgttgggtttgggggcagaagtctctctcagtccagacacagcatggacatgagggcccccgctcagctcctgggactcctgctgctctggcctcccagactaccagatgtgacatccagatcgacccagtcctccatccctcctgtcngccatcgtgngganacagacgtacaacgtctacgtcggccggacgagtcgaggactaagtaaactaagtttattacgtaccgttaggtactacgagtacacgtcaacgtacgaacgggtaaacgtttaccgaagtcctccgtagtacttcgtatcggctagcctactacctacgtttacacctaacgtcggaccggtacctacgttccggttacgttacgtagggtcgggcgggttaagtagtacggtacgggtaacgtacggttacgttaccgttaacgttaccgtaccgtaaaccctaccgtaaccggtaccgacccggtacccggttacccgtcggtaaccggtacctaccccgggtaagttaaaccggtacggttttacgggttaacccggttaacccttttaaaaccgttttttaacggttaaacccggtttaaacggttaaaacccgtttaaaacggttaaccccgttttaaccgtttacccccgttttaccccggggtaaacccccctttaacgggttaacccccgtttaaacccccgggtttaaccccggggaaacccgggtttaaaaaccccggggtaaccccggtttaaaacccgggtttaaacccgggggttaacgggtttaaaaacccggtttaaaacccgggtttaaaaacccgggttacccgggtttaaaccccggggg

SEQ ID NO: 56871 - DNA, 793 bp, Homo sapiens
  misc_feature: GYAE6OF02FQX21.29.87.H10.1.454.CMB.1.raw
  modified_base (230)..(230): a, c, t, g, unknown or other
  misc_feature (230)..(230): n is a, c, g, or t
  modified_base (327)..(327): a, c, t, g, unknown or other
  misc_feature (327)..(327): n is a, c, g, or t
tcagatagagtactcacgaccggtgctcgatttagcagtactgcgtttggggtttgggggcagaagtctctctcagtccagacacagcatggacatggacgggccccccgctcacgcctccgtgggaccttcctgctgctcgtggcctacccagatacccagtatgtgacatccaggatacggaccctagtcctccacttccctcctgtctgactctcgtggtcgggaanacgagtactaccgaacgtccgtacgttcgggccgggacgtaagtcgagggtactaattaaaacgttaacttttacttaacggcgtttacggttaacncgaacgtcaacgtcacggtacggaaggggttaaaccttccgttaacgtcctacggtagtacttacgtacgcgttctacgtcctacgttaccgttacgttaccacgttacgtaccgggtacccggttccctaggttcccgttaccggtggtacgggtaccgggtagggttaaggtacttaagggtccgggtaacgttaacgggtttaccgttaccgtacccgtttactaaccccgtaactttacgaccggtaaccgcgtaccgtaccgttcgacccagggtaacctacgggtaatccgttgtaacgttactttacgttaacgttactaactttaaacggaactttcgtaccctttaacccggtcctaccccctaacggttaccgttaacccgtccggtaaacccggtaagggacccttaacggccggttaaggtaaaccggttaacgtttaaccggaagttcccggg

SEQ ID NO: 56872 - DNA, 617 bp, Homo sapiens
  misc_feature: GYAE6OF02GS400.29.87.H10.1.454.CMB.1.raw
  modified_base (316)..(316): a, c, t, g, unknown or other
  misc_feature (316)..(316): n is a, c, g, or t
  modified_base (352)..(352): a, c, t, g, unknown or other
  misc_feature (352)..(352): n is a, c, g, or t
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
tcagatagagtactcacgaccggtgctcgatttagcagtactgcgttgggtttgggggcagaagtctctctcagtccagacacagcatggacatgacgggcccccgctcagctccgtgggactcctgctggctcgtggcctcccagactaccagtatgtagactactccgagatcgaaccctagtcctccactccctcccgtgtcgtcgctactcgtggtgggaagacgagtacgtacgaacgtcgtacgttcggaccggacgtaacgtcggaggtactaattaaactaattattacgtacgtgtatcagcagcanaccgtaggtaacgtctagtcctcgatactctagtcnctcgctatccgtattgactacgtcgtccggtactgtcgtcgtacgtacggtgacgggtntacgtaggacggatagtgtacgctctaccagacagcnctacgcacgtacncgtagtacggagtagttacgtacgtacttaacgttactaacgtagtaactaagttacctaccgttccgttaccctccgtaccgttaccgttacccgtaccggaaccgtaacggccgtacgtaacggtaggtaactaacggttaaccgcgttaacgg

SEQ ID NO: 56873 - DNA, 788 bp, Homo sapiens
  misc_feature: GYAE6OF02IP8HW.29.87.H10.1.454.CMB.1.raw
tcagatagagtactcacgaccggtgctcgatttagcagtactgcgttgggtttgggggcagaagtctctctcagtccagacacagcatggacatgagggccccccgctcagctcctgggactcctgctgctctggcctcccagactaccagatgtgacataccagatcgacccagtcctccatccctccctgtctgcatcgtgtgggagacagagtacaacgtcacgttcggccggggacaggtcgaggggactaacttaaactaagtttaatttaccgaccgttaggtactacgagacaaggtcctaacgtcccggtaagggttaaaccgttaccgtaacgcccgttaccttacggacttactagtcgccgttacgcctacgttaccttacgtttagactaacgtaccggtaccggggttaccctagtttaccggttacggtttacgacgggttccggggacgggttacggttaagttcgggtacgggtaacgtacggttacggtttacctaccgtcgtaccctaccgtataccgacgtaccgtacgttccgctaaccggcgtaacgtaggaaattcgttaggttaaccgtaccgtttaaatttaaccggtttacgttaacttaaaccgttaaacggtacctttaacccgtttaccggttcccctaaccccggtttaactaccccggtttaaccgggtaccgaacccgggtaacccgaacggttaacccggacgggtttaacggtaacccggtttaaaaccggttaaaccggtacggtttaaccggg

SEQ ID NO: 56874 - DNA, 841 bp, Homo sapiens
  misc_feature: GYAE6OF02IUC29.29.87.H10.1.454.CMB.1.raw
  modified_base (110)..(110): a, c, t, g, unknown or other
  misc_feature (110)..(110): n is a, c, g, or t
  modified_base (158)..(158): a, c, t, g, unknown or other
  misc_feature (158)..(158): n is a, c, g, or t
tcagatagagtactcacgaccggtgctcgatttagcagtactgcgttgggtttgggggcagaagtctctctcagtccagacacagcagtggacatggacgggccccccgntcagcctccgtcgggactcctgctgctctggcctcccagactaccagntggtacgacattccgagtacgtccgacccctagtcctccctacttccctcccgttgtcctcgacctacgtcggttggtaggggacacgaggtacctacgaacgttcacgtccggccggcgagtacgcggacttaagttaaacttaacgtttattaccgtaccgttacgtacgtacgacgactaacggcctaacggttaccggtaaaccgggtaacgtttaaccggtacccgtacggtaccctcggtaacttccggtagttcgggtactccgtacttaccgttcccttaagttaccgagtaacgtccgggtaacccggttacgtaccctttaccgggttcgtaacgggttcgggtaccgggcggggtttaacgtaaggttccgggtaacgggtacggtaacgtccgttaacgtaccgttaccgtccctaacgttacgaccgtaccggtacacggtcccgtacggactacccgggtacctacggtaaaggttccgttacggtttactttacccgtttaaagttaacggtttacccggtaagttaaaccgtaaaccttcttacccggttaccctacccggttacctttaccggtacccgttaccgggttaacccgtaccggtaaccggaccttaaacggggtcgaaaggttaaacccggtttaacgtaccggtttaaccggtccgg

SEQ ID NO: 56875 - DNA, 757 bp, Homo sapiens
  misc_feature: GYAE6OF02JFANW.29.87.H10.1.454.CMB.1.raw
  modified_base (105)..(105): a, c, t, g, unknown or other
  misc_feature (105)..(105): n is a, c, g, or t
  modified_base (206)..(206): a, c, t, g, unknown or other
  misc_feature (206)..(206): n is a, c, g, or t
tcagatagagtactcacgaccggtgctcgatttagcagtactgcgttgggtttgggggcagaagtctctctcagtccagacacagcatggacatgaggcccccgntcagctcctgggactcctgctgctctggctcccagataccagatgtgacatccagatgacccagtcctccatcctccctgtctgcctatcgtgtacggganacagacgtcaactcgaacttggccgggcaggtcgagggactaacgttaaactaagtttatttaacggccgtttaggtactcagactagactacgttacccggaagggtaaacgttcctaagtccctacctgtacttaccgtataggcctagacctactaccgtatttacgacctaagtcccgaagggttccctaagttccgttcggttacgaggttcggggtacgtacggtaagttaccggtacgggtactaaggtaacggttccaacccggttctaaccctaacgtaacgttccgaaccgtaccgtacgacccgttagcccaacggttcccgtaaagaccggttacggttacgttaccggtaccgtttaaactttagtttaaccgttagttaaaaccttaaaggttaccttaaccgttaccgttttaccccgaccccttaaccgttcccggttaacccgtaccggggtaacccgtaacgggttaaccccgtaacgggttaaccgttacgggaaacctttaacgggttaaaacccggtagttaacccgggg

SEQ ID NO: 56876 - DNA, 663 bp, Homo sapiens
  misc_feature: GYAE6OF02JHNBC.29.87.H10.1.454.CMB.1.raw
  modified_base (333)..(333): a, c, t, g, unknown or other
  misc_feature (333)..(333): n is a, c, g, or t
tcagatagagtactcacgaccggtgctcgatttagcagtactgcgttgggtttgggggcagaagtctctctcagtccagacacagcatggacatgacgggcccccgctcagctcctgggactcctgctgctctggctcccagataccagatgtgccatccagttgacccagtctccattcttcctgtctgcatcgtgtaggagaccagagttcctccatccgacttcggcccgggtaccagtcgagggtccatttaggaacgtttatttagccttggtttcagcaagaaacctagggaaacctccctaaactcctagaactcgtacctcgtcncaacttcccgtaattcgacacgtaaggttccggggtcccttacgtacgggttcaggccggtacgtaagggccggtaacttccgtaaggggacctaaggtacttttcgaaccttcgtaaccacctacgttccgaacggtcaaccgggtccctggacccacgtccgtaagtaagtcgttagtacccgtaactaacgttttaactcgtacgtacctaaacctaggttacctttaagaaccgtacccttaccgtacttacgtttccggacgaacgggtaaccgaggttacgactaaccgtacgtaaaccggattccggtaggacctgaccgtac

SEQ ID NO: 56877 - DNA, 822 bp, Homo sapiens
  misc_feature: GYAE6OF02FJSMM.29.87.H10.1.454.CMB.1.raw
  modified_base (109)..(109): a, c, t, g, unknown or other
  misc_feature (109)..(109): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (401)..(401): a, c, t, g, unknown or other
  misc_feature (401)..(401): n is a, c, g, or t
  modified_base (456)..(456): a, c, t, g, unknown or other
  misc_feature (456)..(456): n is a, c, g, or t
  modified_base (502)..(502): a, c, t, g, unknown or other
  misc_feature (502)..(502): n is a, c, g, or t
tcagatagagtactcacgaccggtgctcgatttagcagtactgcgttggggtttgggggcgagaagtctctctcagtccagacacagccatggacatgacgggcccccntcagctcccgtgggacctcctgactcgctcgtggcctcccaggactaaccaggatcgtcggactctaccgagatcgaacccgagtcctaccgactccctcccgtgctcgccactcgtggcggtanctgactccaacgtcacgttcggccggacgngtcgaggtaccaaattaacgtattttaacttgcccgttttaggaaccctacgtacggacctaacggtaacccgtaccctaacggggtaaaaccggttaaaccttaccggtaacgtccccgtagttaccgtagttacncgttacgcttccgaacttcggtcttaggttacctacgacgtccgggtacgttacncgttccgtccttaaacggcgggttaccggtaccgggagttaaacgngggtaccggacgttacggtactttccggaccttccgtaaccctaacgtaccgtacggacctaaccgtccgttacggtacccgtacgccggtaacacggtaacgttcgttaacggtacctaacgtttaaccgttttaacggtaaactttcgtaaaaccggtaaacgttaacccggttttacccgtaacgttacccccgaacttaccccggttaaaccctttcccgggtaaaaccgtacccgggttaaaccgtaccggttaacccgaacgggttaaaccgttaaccggttaaaccgttaaaaccgttcccgggttaaaccgg

SEQ ID NO: 56878 - DNA, 666 bp, Homo sapiens
  misc_feature: GYAE6OF01CCK2I.35.79.H02.1.454.CMB.1.raw
  modified_base (613)..(613): a, c, t, g, unknown or other
  misc_feature (613)..(613): n is a, c, g, or t
  modified_base (615)..(618): a, c, t, g, unknown or other
  misc_feature (615)..(618): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (650)..(653): a, c, t, g, unknown or other
  misc_feature (650)..(653): n is a, c, g, or t
  modified_base (655)..(656): a, c, t, g, unknown or other
  misc_feature (655)..(656): n is a, c, g, or t
  modified_base (659)..(659): a, c, t, g, unknown or other
  misc_feature (659)..(659): n is a, c, g, or t
  modified_base (661)..(665): a, c, t, g, unknown or other
  misc_feature (661)..(665): n is a, c, g, or t
tcagtacagatcgtcacgaccggtgctcgatttagtgtcacacgaagggtaaagggggtcggtggaatgggtcctcacttaagttagtggtagccgccgacttcacacgacgtaccgcagactccgtgagtcggccgttctccatctccgagacgaccaattccaaacaaacacggtgtaatctgacaaatcgaaccagtccctgacgacgccgacgagtacggccgtaatacgtactgtgactaaacttcgaccactacgtattacgttttgagttggtacttagaacttacgtggggcctaggggacgcccgttggtacacgttccgtacctaccgtacgaccggtccccttaccccgaaccggtaacgggcccctaagttcccgggttccccttaccccccggtgggccccgttacccgttaggtacccgtaccggtaacggggtacctacccgtaacccgtaccggaggaccgtcaacggtacgcccgggtcccgttggggccttacggtcccgtttaggaccaaacggtacctaaccgttccgacgtactccgtgtaacgtcgacggtccggtatacgggacgtaaacggtcgactaagttacgacanannnncgtgtcgcgtgcgcgagnganananananagnnnncnnctntnnnnnc

SEQ ID NO: 56879 - DNA, 234 bp, Homo sapiens
  misc_feature: GYAE6OF01EB7K2.35.79.H02.1.454.CMB.1.raw
  modified_base (222)..(234): a, c, t, g, unknown or other
  misc_feature (222)..(234): n is a, c, g, or t
tcagtacagatcgtcacgaccggtgctcgatttagtgtcacacgaaggagggtgccgagggagccctggtcatcgtctccctcagcctccaccgaacgggcccatcggtcttccccctggcaccctcctccaagagcacctcgtgggggcacagccggccctgggctgcctggtcaaggctacttccacgatctgtactgagcggctggcaaggcgcatagnnnnnnnnnnnnn

SEQ ID NO: 56880 - DNA, 426 bp, Homo sapiens
  misc_feature: GYAE6OF01CLXY9.35.79.H02.1.454.CMB.1.raw
  modified_base (422)..(426): a, c, t, g, unknown or other
  misc_feature (422)..(426): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactggggccagggagccctggtcatcgtctcctcagcctccaccaagggcccatcggtcttccccctggcaccctcctccaagagcacctctgggggcacagcggccctgggctgcctggtcaaggctacttccacgatctgtactgagcgggctggcaaggcgcatagnnnnn

SEQ ID NO: 56881 - DNA, 219 bp, Homo sapiens
  misc_feature: GYAE6OF01E3F1V.35.79.H02.1.454.CMB.1.raw
  modified_base (218)..(219): a, c, t, g, unknown or other
  misc_feature (218)..(219): n is a, c, g, or t
tcagtacagatcgtcacgaccggtgctcgatttagtgtcacacgaaggagggtgccagggagccctggtcatcgtctcctcagcctccaccaagggcccatcggtcttccccctggcaccctcctccaagagcacctctgggggcacagcggccctgggctgcctggtcaaggactacttccacgatctgtactgagcgggctggcaaggcgcatagnn

SEQ ID NO: 56882 - DNA, 438 bp, Homo sapiens
  misc_feature: GYAE6OF01DGSEH.35.79.H02.1.454.CMB.1.raw
  modified_base (423)..(423): a, c, t, g, unknown or other
  misc_feature (423)..(423): n is a, c, g, or t
  modified_base (428)..(438): a, c, t, g, unknown or other
  misc_feature (428)..(438): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgattattttgagtggtcttgactacgtggggccagggagccctggtcatcgtctcctcagcctccaccaaggcccatcggtcttccccctggccaccctcctccaagagcacctctcgggggcacgacgcggccctgggctgcctggtcaaggctacttccacgatctgtactgagcgggctggacaaggcgnatagnnnnnnnnnnn

SEQ ID NO: 56883 - DNA, 221 bp, Homo sapiens
  misc_feature: GYAE6OF01CGEMB.35.79.H02.1.454.CMB.1.raw
  modified_base (217)..(221): a, c, t, g, unknown or other
  misc_feature (217)..(221): n is a, c, g, or t
tcagtacagatcgtcacgaccggtgctcgatttagtgtcacacgaaggagggtgccagggagccctggtcatcgtctcctcagcctccaccaagggcccatcggtcttcccctggcaccctcctccaagagcacctctgggggcacagcggccctgggctgcctggtcaaggactacttccacgatctgtactgagcgggctggcaaggcgcatagnnnnn

SEQ ID NO: 56884 - DNA, 221 bp, Homo sapiens
  misc_feature: GYAE6OF01BQTAR.35.79.H02.1.454.CMB.1.raw
  modified_base (218)..(221): a, c, t, g, unknown or other
  misc_feature (218)..(221): n is a, c, g, or t
tcagtacagatcgtcacgaccggtgctcgatttagtgtcacacgaaggagggtgccagggagccctggtcatcgtctcctcagcctccaccaagggcccatcggtcttccccctggcaccctcctccaagagcacctctgggggcacagcggccctgggctgcctggtcaaggactacttccacgatctgtactgagcgggctggcaaggcgcatagnnnn

SEQ ID NO: 56885 - DNA, 436 bp, Homo sapiens
  misc_feature: GYAE6OF01DKIH4.35.79.H02.1.454.CMB.1.raw
  modified_base (423)..(436): a, c, t, g, unknown or other
  misc_feature (423)..(436): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgatacgatattttgagtggtcttgactactggggccagggagccctggtcatcgtctcctcagcctcacccaagggccccatcggtcttccccctggcaccctctccaagagcacctctggggcacagcggccctgggctgcctggtcaaggctacttccacgatctgtactgagcgggctggctaagggcgcataggnnnnnnnnnnnnnn

SEQ ID NO: 56886 - DNA, 597 bp, Homo sapiens
  misc_feature: GYAE6OF01EGKOS.35.79.H02.1.454.CMB.1.raw
  modified_base (137)..(137): a, c, t, g, unknown or other
  misc_feature (137)..(137): n is a, c, g, or t
  modified_base (214)..(219): a, c, t, g, unknown or other
  misc_feature (214)..(219): n is a, c, g, or t
  modified_base (225)..(225): a, c, t, g, unknown or other
  misc_feature (225)..(225): n is a, c, g, or t
  modified_base (233)..(234): a, c, t, g, unknown or other
  misc_feature (233)..(234): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (245)..(246): a, c, t, g, unknown or other
  misc_feature (245)..(246): n is a, c, g, or t
  modified_base (249)..(250): a, c, t, g, unknown or other
  misc_feature (249)..(250): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (260)..(261): a, c, t, g, unknown or other
  misc_feature (260)..(261): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
  modified_base (490)..(490): a, c, t, g, unknown or other
  misc_feature (490)..(490): n is a, c, g, or t
tcagtacagatcgtcacgaccggtgctcgatttagtgtcacacgaaggagggtgccagggagccctggtcatcgtctcctcagcctccaccaagggcccatcggtcttcccctggcaccctcctccaagagcacctntgggggcacagcggccctgggctgcctggtcaaggctacttccagatctgtactgagcgggctggcaaggcgcatgnnnnnncgtgcnctgcagcnngtnanctgncnnctnnctgcnacngnntcgctnagtcngntagctcagtctacgacttcggtcgactcgtcgtntacgtacgtcgcgtaacgtagtctcgtcgtaacgtcgttacgcgtaccgttaagtccgtcggtaaccctgtaaccggttcgtacccgtaagtccgggtacttaacgtaccggtttcgacgttaccgtttaggacgggttaacttccgtaacgttccgtacgttacgtacgttaacgggttcnccgttttaaacgcggttcgtaaaccgtaggtcccgtagtaacccgggtcttaccggtacgttaccgtacgtaacgggttacaccgttaacggtcgtaacggtaccgg

SEQ ID NO: 56887 - DNA, 427 bp, Homo sapiens
  misc_feature: GYAE6OF01D26E3.35.79.H02.1.454.CMB.1.raw
  modified_base (423)..(427): a, c, t, g, unknown or other
  misc_feature (423)..(427): n is a, c, g, or t
tcagtacagatcgtcacgaccggtgctcgatttagtgtcacacgaagggaaaggggctggaatgggtctcacttattagtggtagcaccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactggggccagggagccctggtcatcgtctcctcagcctccaccaagggcccatcggtcttccccctggcaccctcctccaagagcacctctggggcacagcggccctgggctgcctggtcaaggactacttccacgatctgtactgagcgggctgggcaaggcgcatagnnnnn

SEQ ID NO: 56888 - DNA, 426 bp, Homo sapiens
  misc_feature: GYAE6OF01ER8IJ.35.79.H02.1.454.CMB.1.raw
  modified_base (419)..(426): a, c, t, g, unknown or other
  misc_feature (419)..(426): n is a, c, g, or t
tcagtacagatcgtcacgaccggtgctcgatttagtgtcacacgaagggaaaggggctggaatgggtctcacttattagtggtagcaccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactggggccagggagccctggtcatcgtctcctcagcctccaccaagggcccatcggtcttccccctggccaccctcctccaagagcactctggggcacagcggcctgggctgcctggtcaggactacttcacgatctgtactgtagcgggctggcaaggcgcatgnnnnnnnn

SEQ ID NO: 56889 - DNA, 223 bp, Homo sapiens
  misc_feature: GYAE6OF01B0AWI.35.79.H02.1.454.CMB.1.raw
  modified_base (217)..(223): a, c, t, g, unknown or other
  misc_feature (217)..(223): n is a, c, g, or t
tcagtacagatcgtcacgaccggtgctcgatttagtgtcacacgaaggagggtgccagggagccctggtcatcgtctcctcagcctccaccaagggcccatcggtcttcccctggcaccctcctccaagagcacctctgggggcacagcggccctgggctgcctggtcaaggactacttccacgatctgtactgagcgggctggcaaggcgcatagnnnnnnn

SEQ ID NO: 56890 - DNA, 226 bp, Homo sapiens
  misc_feature: GYAE6OF01DTTL4.35.79.H02.1.454.CMB.1.raw
  modified_base (217)..(226): a, c, t, g, unknown or other
  misc_feature (217)..(226): n is a, c, g, or t
tcagtacagatcgtcacgaccggtgctcgatttagtgtcacacgaaggagggtgccagggagccctggtcatcgtctcctcagcctccaccaagggcccatcggtcttcccctggcaccctcctccaagagcacctctgggggcacagcggccctgggctgcctggtcaaggactacttccacgatctgtactgagcgggctggcaaggcgcatagnnnnnnnnnn

SEQ ID NO: 56891 - DNA, 583 bp, Homo sapiens
  misc_feature: GYAE6OF01DL8ZI.35.79.H02.1.454.CMB.1.raw
  modified_base (271)..(271): a, c, t, g, unknown or other
  misc_feature (271)..(271): n is a, c, g, or t
  modified_base (544)..(544): a, c, t, g, unknown or other
  misc_feature (544)..(544): n is a, c, g, or t
  modified_base (550)..(552): a, c, t, g, unknown or other
  misc_feature (550)..(552): n is a, c, g, or t
  modified_base (554)..(583): a, c, t, g, unknown or other
  misc_feature (554)..(583): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgataccggccgtatacctactgtgacgaaacttgaccgactacgatattttgagtggtcttgactacgtggggccagggngcctggtcatcgtctcctcacgcctccaccaacgggccccagtccggttcccttccccccgtcggtcccaaccccgttccctacccgtaacgacgccgacccgtcgtcggggggaccaccggacggcccgggtcccgtcgggccgttcggccgttcgggtaccgaaacgggtacccttaaccttccgaaccggtacgttccttacggttaccgtagggacgggtccggggccgttggggaacccgggaaacgggaccgtacctaaggttaggnagtgcnnngnnnnnnnnnnnnnnnnnnnnnnnnnnnnnn

SEQ ID NO: 56892 - DNA, 223 bp, Homo sapiens
  misc_feature: GYAE6OF01BG31L.35.79.H02.1.454.CMB.1.raw
  modified_base (217)..(223): a, c, t, g, unknown or other
  misc_feature (217)..(223): n is a, c, g, or t
tcagtacagatcgtcacgaccggtgctcgatttagtgtcacacgaaggagggtgccagggagccctggtcatcgtctcctcagcctccaccaagggcccatcggtcttccccctggcaccctcctccaagagcacctctgggggcacagcggccctgggctgcctggtcaaggactacttccacgatctgtactgagcggctggcaaggcgcatagnnnnnnn

SEQ ID NO: 56893 - DNA, 220 bp, Homo sapiens
  misc_feature: GYAE6OF01DPE1X.35.79.H02.1.454.CMB.1.raw
  modified_base (217)..(220): a, c, t, g, unknown or other
  misc_feature (217)..(220): n is a, c, g, or t
tcagtacagatcgtcacgaccggtgctcgatttagtgtcacacgaaggaggtgccagggagccctggtcatcgtctcctcagcctccaccaagggcccatcggtcttccccctggcaccctcctccaagagcacctcgtgggggcacagcggccctgggctgcctggtcaaggactactccacgatctgtactgagcgggctggcaaggcgcatagnnnn

SEQ ID NO: 56894 - DNA, 241 bp, Homo sapiens
  misc_feature: GYAE6OF01BSTXS.35.79.H02.1.454.CMB.1.raw
  modified_base (227)..(241): a, c, t, g, unknown or other
  misc_feature (227)..(241): n is a, c, g, or t
tcagtacagatcgtcacgaccggtgctcgatttagtgtcacacgaaggagggtgccagggagccctggtcatcgtctcctcagcctccaccaagggcccatcggtccttcccctggcaccctcctccaagagcacctcgtgggggcacaggccggccctgggctgcctggtcaaggactacttccacgatctgtactggacggcgggctggcaagggcgcgagtagnnnnnnnnnnnnnnn

SEQ ID NO: 56895 - DNA, 679 bp, Homo sapiens
  misc_feature: GYAE6OF01BRR83.35.79.H02.1.454.CMB.1.raw
  modified_base (592)..(592): a, c, t, g, unknown or other
  misc_feature (592)..(592): n is a, c, g, or t
  modified_base (597)..(598): a, c, t, g, unknown or other
  misc_feature (597)..(598): n is a, c, g, or t
  modified_base (605)..(605): a, c, t, g, unknown or other
  misc_feature (605)..(605): n is a, c, g, or t
tcagtacagatcgtcacgaccggtgctcgattttagtgtcacacgaagggaaagggggacgtacggaaatgggtcctcctacgttaattaagtcggtagcgccgacttcacacactacgcagactccgtgagtgggccggttctccatctcagagacaatccaacaacacggtagtactctgcaaatgaacagcctgagacgcgaacgatacggccgtatacgtactgtgacgtaaacgttgaccgtactaacgatttacttttggaaggtgttctttagaccgtaacgtgggaccagggtacgccgtggtaccagtccggtcctcctacgtacgcccttaccgaaccggaacgggtaccccagttaccgggttccctttaccccccgtggaccctaacccctccttaaccgaagtacgacctaaccgttcggcggggaccaccgacggtaccggacccgtcgggtaccgtcgtaccggttacggtaccgaaacggtaccttaacccgtaccgaacgtaacgttacttacgtacgtacggaacggaccggggtctacgggaacaacggacgtaacgtagtacggagcgactngacannaaccggngacgagagtagactacgatgagacgacgagagacgtacgagacgcgagacgacgtacgacgactacgcgcgacg

SEQ ID NO: 56896 - DNA, 563 bp, Homo sapiens
  misc_feature: GYAE6OF01BUGPS.35.79.H02.1.454.CMB.1.raw
  modified_base (514)..(516): a, c, t, g, unknown or other
  misc_feature (514)..(516): n is a, c, g, or t
  modified_base (518)..(519): a, c, t, g, unknown or other
  misc_feature (518)..(519): n is a, c, g, or t
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
  modified_base (532)..(534): a, c, t, g, unknown or other
  misc_feature (532)..(534): n is a, c, g, or t
  modified_base (537)..(537): a, c, t, g, unknown or other
  misc_feature (537)..(537): n is a, c, g, or t
  modified_base (540)..(542): a, c, t, g, unknown or other
  misc_feature (540)..(542): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
  modified_base (556)..(558): a, c, t, g, unknown or other
  misc_feature (556)..(558): n is a, c, g, or t
  modified_base (560)..(561): a, c, t, g, unknown or other
  misc_feature (560)..(561): n is a, c, g, or t
  modified_base (563)..(563): a, c, t, g, unknown or other
  misc_feature (563)..(563): n is a, c, g, or t
tcagtacagatcgtcacgaccggtgctcgatttagtgtcacacgaagggaaaggggctggaatgggtctcacttattagtggtagcaccgacttcacacactacgcagactccgtgatggccggttctccatctccagagacaattccaacaacacggtgtatctgcaaatgaacagcctgagacgccgacgatacggccgtatacctactgtcgcgaaactttgccgactacgattattttgagtggtcttgacttactggggccagggagcccgtggtcagtcgtcctctcacgcctccgaccgacggcccattcggtccgttccccgtcggccaccctcctccaacgacgcgtacctcgcggggacacgacggccggcccgtcgggcgtacggccgtggttaccgaaacgggtaccctacctttccgaaccgtacgttccttacggttacgtcggacgggtccgggacggttcgggacgaaacgggccggacctaaggttagactgcgagnnngnngngnngagcgcgnnncgngcnnngngncgcngangcnnncnngn

SEQ ID NO: 56897 - DNA, 223 bp, Homo sapiens
  misc_feature: GYAE6OF01APFQ5.35.79.H02.1.454.CMB.1.raw
  modified_base (218)..(223): a, c, t, g, unknown or other
  misc_feature (218)..(223): n is a, c, g, or t
tcagtacagatcgtcacgaccggtgctcgatttagtgtcacacgaaggagggtgccagggagccctggtcatcgtctcctcagcctccaccaagggcccatcggtccttccccctggcaccctcctccaagagcacctctgggggcacagcggccctgggctgcctggtcaaggactacttccacgatctgtactgagcggctggcaaggcgcatagnnnnnn

SEQ ID NO: 56898 - DNA, 676 bp, Homo sapiens
  misc_feature: GYAE6OF01BFAFH.35.79.H02.1.454.CMB.1.raw
  modified_base (509)..(509): a, c, t, g, unknown or other
  misc_feature (509)..(509): n is a, c, g, or t
  modified_base (625)..(625): a, c, t, g, unknown or other
  misc_feature (625)..(625): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (638)..(639): a, c, t, g, unknown or other
  misc_feature (638)..(639): n is a, c, g, or t
  modified_base (641)..(641): a, c, t, g, unknown or other
  misc_feature (641)..(641): n is a, c, g, or t
  modified_base (643)..(644): a, c, t, g, unknown or other
  misc_feature (643)..(644): n is a, c, g, or t
  modified_base (647)..(676): a, c, t, g, unknown or other
  misc_feature (647)..(676): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctcagagacaattccaacaacacggtgtatctgacaaatgaacagcctagagagccgacgagtaccggcgtatactactgtagacgaaacttcgacgacttacgtatttagttttcgaggttcggttcttacggtaccgttacggtcgggggacccgaagggggtaccgtccccgtgggtaccaacgttcccggttcccttccctccggaacgtcccccgttaccccgaaaccggtaaaccgggggtcccctacggttccccgggttacccctttccccccgtacggacccctaccccccgttaccaacccggaaaggcccgacctacccggtacgggtcgggggaaccctaaccgacgggccccggggttcccgnggggacccttcgggccggtcggtaaccgtaaacggtaccttaccgttacccggagtacctttccggtacgtacggtggacggggccggtcgtggggtaacggaacgggcccggtanaaaggtcgngngnngngnncgnnnnnnnnnnnnnnnnnnnnnnnnnnnnnn

SEQ ID NO: 56899 - DNA, 603 bp, Homo sapiens
  misc_feature: GYAE6OF01DWL8L.35.79.H02.1.454.CMB.1.raw
  modified_base (127)..(127): a, c, t, g, unknown or other
  misc_feature (127)..(127): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (512)..(512): a, c, t, g, unknown or other
  misc_feature (512)..(512): n is a, c, g, or t
  modified_base (571)..(571): a, c, t, g, unknown or other
  misc_feature (571)..(571): n is a, c, g, or t
  modified_base (573)..(592): a, c, t, g, unknown or other
  misc_feature (573)..(592): n is a, c, g, or t
  modified_base (594)..(603): a, c, t, g, unknown or other
  misc_feature (594)..(603): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccgttntccatctcagagacaattccaacaacacggtgtatctgacaaatgaacagcctgagagccgacgagtaccggccgttataaccgtactggtgaccgtaaaacttgacccgaactacgatttagtttttgaggttggtccttgacctacggtgggggaccgaaggggacgtccctcgggtacagttccgtctcctcacgcctacccaccgaacggccctacgttccggttcccttcccccgngggtacccncccccgttaccttaccaaacgtccgacctacccggtccgggtgggggcccaaaccgtcgggccccgggacccggttcgggcgttccgtcccgttacgggacgtaaaccggtacccgttaccgttaccaaaccgtnttaccggtgttaaccgtggacgggcggccgtagggacccgagggcaccgtaggactgcngnnnnnnnnnnnnnnnnnnnncnnnnnnnnnn

SEQ ID NO: 56900 - DNA, 254 bp, Homo sapiens
  misc_feature: GYAE6OF01EVKAO.35.79.H02.1.454.CMB.1.raw
  modified_base (220)..(220): a, c, t, g, unknown or other
  misc_feature (220)..(220): n is a, c, g, or t
  modified_base (226)..(227): a, c, t, g, unknown or other
  misc_feature (226)..(227): n is a, c, g, or t
  modified_base (229)..(232): a, c, t, g, unknown or other
  misc_feature (229)..(232): n is a, c, g, or t
  modified_base (235)..(254): a, c, t, g, unknown or other
  misc_feature (235)..(254): n is a, c, g, or t
tcagtacagatcgtcacgaccggtgctcgattttagtgtcacacgaaggagggtgccagggagccctggtcatcgtctcctcacgcctccaccaagggcccatcggtcttcccctggcaccctcctccaagagcacctctgggggctacgagccggcccttgggcctgccctgggtcaaggactacttccacgatctgtactgatcgggctggcaacggncatagnntnnnnctnnnnnnnnnnnnnnnnnnnn

SEQ ID NO: 56901 - DNA, 615 bp, Homo sapiens
  misc_feature: GYAE6OF01AH2OR.35.79.H02.1.454.CMB.1.raw
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (559)..(560): a, c, t, g, unknown or other
  misc_feature (559)..(560): n is a, c, g, or t
  modified_base (563)..(563): a, c, t, g, unknown or other
  misc_feature (563)..(563): n is a, c, g, or t
  modified_base (574)..(575): a, c, t, g, unknown or other
  misc_feature (574)..(575): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (589)..(590): a, c, t, g, unknown or other
  misc_feature (589)..(590): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (598)..(598): a, c, t, g, unknown or other
  misc_feature (598)..(598): n is a, c, g, or t
  modified_base (607)..(607): a, c, t, g, unknown or other
  misc_feature (607)..(607): n is a, c, g, or t
  modified_base (609)..(611): a, c, t, g, unknown or other
  misc_feature (609)..(611): n is a, c, g, or t
  modified_base (613)..(614): a, c, t, g, unknown or other
  misc_feature (613)..(614): n is a, c, g, or t
tcagtacagatcgtcacgaccggtgctcgatttagtgtcacacgaaggggaaaggggctggaatgggtcgtcacttattagtggtagcgccgacttcacacactacgcagactccgtgatgggccggttctccatctccagagacaattccaacaacgacggtggtatctgacaaatgaacgagcctgagacgccgacgatcggcctatactatcgtgacgtaaacttgccgactacgattatttgagttggtcttacgtacgtacgtgggggccagggacgccgtgtacacgtccgtcctcctacgaccgtccctccgaaccgacgggtaccctacgtcccgttcccttccccgtcggaccctaccccgtccctaccgacgacgccgtacccgtccggtcgggaccgaccggaccggcccggtcccggtcggccgtccgtccggtacggtaaccgaacggtacccttaccgtaccgtacgtacgtcgttacgtacggacggtacgggtccgggccgtacggaccggaacggaccgacgtaggtacgcgancgcngcgnngcncgacgtgagtnngtcncnnctcgcgnncgngngcnctgacgtcncnnngnng

SEQ ID NO: 56902 - DNA, 477 bp, Homo sapiens
  misc_feature: GYAE6OF01CZL9E.35.79.H02.1.454.CMB.1.raw
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (446)..(449): a, c, t, g, unknown or other
  misc_feature (446)..(449): n is a, c, g, or t
  modified_base (451)..(477): a, c, t, g, unknown or other
  misc_feature (451)..(477): n is a, c, g, or t
tcagtacagatcgtcacgaccggtgctcgatttagtgtcacacgaagggaaaggggctggaatgggtctcacttattagtggtagcgcccgacttcacacactacgcagactccgtgatgggcccggttctccatctccagagacaattccaacaacacggtgtatctgcaaatgaacagcctgagagccgacgatacggccgtatactactgtgcgaaacttgccgactacgatattttgagtggtcttgacgtactgggggccagggagccctggtcatcgtctctcagcctccaccaagggccccatcggtccttcccccgtggcccaccctcctccaagacgcaccgtctcgggggcaccgagcggccctgggctgacctgggtcaaggctactccacgactctgtactgaggcgggctgggcaacgggcgtnagtgncngnnnngnnnnnnnnnnnnnnnnnnnnnnnnnnn

SEQ ID NO: 56903 - DNA, 647 bp, Homo sapiens
  misc_feature: GYAE6OF01A79W2.35.79.H02.1.454.CMB.1.raw
  modified_base (500)..(500): a, c, t, g, unknown or other
  misc_feature (500)..(500): n is a, c, g, or t
  modified_base (613)..(613): a, c, t, g, unknown or other
  misc_feature (613)..(613): n is a, c, g, or t
  modified_base (615)..(647): a, c, t, g, unknown or other
  misc_feature (615)..(647): n is a, c, g, or t
tcagtacagatcgtcacgaccggtgctcgatttagtgtcacacgaagggaaaggggctggaatggggtctcacttattagtggtagcgccgacttcacacactacgcagactccgtgatgggccgttctccatctccagacgacaattccaaacaacacggtgtatctgacaaatgaacacggtcctgaacgcgccggaacgagtaaccggccgtaatactacgtggtgaactaaattcgaccgtactacggtatttagttttaggagttcggttctttagaacgttcggtcgggggaccgaacggggccgtcccggttaggtaccacgttccgttcccgtccgtccgaaccggtcccctaccccgaaccggtaaaccggggcccctaacggtttccccgttccccgttaccccccgtggtaaccctccccgttaccctaacgaaacgaccgtcccacccgttcggggacgggaccaacgggtccggaccggtcccgggnggtccctcgggtccgtttaacggtaccgaacgttaccttacccggtaccaagtccttgtacgtacggtacggacgggcgggtccgtcgggaaccgagggatcgaagtcgtagngnnnnnnnnnnnnnnnnnnnnnnnnnnnnnnnnn

SEQ ID NO: 56904 - DNA, 220 bp, Homo sapiens
  misc_feature: GYAE6OF02GUZPR.35.79.H02.1.454.CMB.1.raw
  modified_base (216)..(220): a, c, t, g, unknown or other
  misc_feature (216)..(220): n is a, c, g, or t
tcagtacagatcgtcacgaccggtgctcgatttagtgtcacacgaaggagggtgccagggagccctggtcatcgtctcctcagcctccaccaagggcccatcggtcttcccctggcaccctcctccaagagcacctctggggcacagcggccctgggctgcctggtcaaggactacttccacgatctgtactgagcgggctggcaaggcgcatagnnnnn

SEQ ID NO: 56905 - DNA, 220 bp, Homo sapiens; identical to SEQ ID NO: 56904
  misc_feature: GYAE6OF02GT7WN.35.79.H02.1.454.CMB.1.raw
  modified_base (216)..(220): a, c, t, g, unknown or other
  misc_feature (216)..(220): n is a, c, g, or t

SEQ ID NO: 56906 - DNA, 221 bp, Homo sapiens
  misc_feature: GYAE6OF02GWKGQ.35.79.H02.1.454.CMB.1.raw
  modified_base (216)..(221): a, c, t, g, unknown or other
  misc_feature (216)..(221): n is a, c, g, or t
tcagtacagatcgtcacgaccggtgctcgatttagtgtcacacgaaggagggtgccagggagccctggtcatcgtctcctcagcctccaccaagggcccatcggtcttcccctggcaccctcctccaagagcacctctggggcacagcggccctgggctgcctggtcaaggactacttccacgatctgtactgagcgggctggcaaggcgcatagnnnnnn

SEQ ID NO: 56907 - DNA, 215 bp, Homo sapiens
  misc_feature: GYAE6OF02FEAWH.35.79.H02.1.454.CMB.1.raw
  modified_base (215)..(215): a, c, t, g, unknown or other
  misc_feature (215)..(215): n is a, c, g, or t
tcagtacagatcgtcacgaccggtgctcgatttagtgtcacacgaaggagggtgccagggagccctggtcatcgtctcctcagcctccaccaaggcccatcggtcttcccctggcaccctcctccaagagcacctctggggcacagcggccctgggctgcctggtcaaggactacttccacgatctgtactgagcgggctggcaaggcgcatagn

SEQ ID NO: 56908 - DNA, 429 bp, Homo sapiens
  misc_feature: GYAE6OF02JFPN8.35.79.H02.1.454.CMB.1.raw
  modified_base (422)..(429): a, c, t, g, unknown or other
  misc_feature (422)..(429): n is a, c, g, or t
tcagtacagatcgtcacgaccggtgctcgatttagtgtcacacgaagggaaagggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactggggccagggagccctggtcatcgtctcctcagcctccaccaagggcccatcggtcttccccctggcaccctcctccaagagcacctctgggggcacagcggccctgggctgcctggtcaaggactacttccacgatctgtactgagcgggctggcaaggcgcatagnnnnnnnn

SEQ ID NO: 56909 - DNA, 426 bp, Homo sapiens
  misc_feature: GYAE6OF02HRA69.35.79.H02.1.454.CMB.1.raw
  modified_base (421)..(426): a, c, t, g, unknown or other
  misc_feature (421)..(426): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgatatttgagtggtcttgactactggggccagggagccctggtcatcgtctcctcagcctccaccaagggcccatcggtcttccccctggcaccctcctccaacgagcacctctgggggcacagcggcctgggctgcctggtcaaggactacttccacgatctgtactgagcgggctggcaggcgcatagnnnnnn

SEQ ID NO: 56910 - DNA, 267 bp, Homo sapiens
  misc_feature: GYAE6OF02JK8WM.35.79.H02.1.454.CMB.1.raw
  modified_base (216)..(267): a, c, t, g, unknown or other
  misc_feature (216)..(267): n is a, c, g, or t
tcagtacagatcgtcacgaccggtgctcgatttagtgtcacacgaaggagggtgccagggagccctggtcatcgtctcctcagcctccaccaagggcccatcggtcttccccctggcaccctcctccaagagcacctctggggcacagcggccctgggctgcctggtcaaggactacttccacgatctgtactgagcggctggcaaggcgcatagnnnnnnnnnnnnnnnnnnnnnnnnnnnnnnnnnnnnnnnnnnnnnnnnnnnn

SEQ ID NO: 56911 - DNA, 438 bp, Homo sapiens
  misc_feature: GYAE6OF02JD8XI.35.79.H02.1.454.CMB.1.raw
  modified_base (425)..(438): a, c, t, g, unknown or other
  misc_feature (425)..(438): n is a, c, g, or t
tcagtacagatcgtcacgaccggtgctcgatttagtgtcacacgaagggaaaggggctcggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactggggccagggagccctggtcatcgtctcctcagcctccaccaagggcccatcggtcttccccctggccaccctcctccaagagcacctctgggggcacagcggccctgggctgcctggtcaaggctacttccaccgatctgtactgagcgggctggcaaggcgcatagnnnnnnnnnnnnnn

SEQ ID NO: 56912 - DNA, 484 bp, Homo sapiens
  misc_feature: GYAE6OF02IYB55.35.79.H02.1.454.CMB.1.raw
  modified_base (442)..(444): a, c, t, g, unknown or other
  misc_feature (442)..(444): n is a, c, g, or t
  modified_base (446)..(448): a, c, t, g, unknown or other
  misc_feature (446)..(448): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (456)..(458): a, c, t, g, unknown or other
  misc_feature (456)..(458): n is a, c, g, or t
  modified_base (460)..(461): a, c, t, g, unknown or other
  misc_feature (460)..(461): n is a, c, g, or t
  modified_base (463)..(484): a, c, t, g, unknown or other
  misc_feature (463)..(484): n is a, c, g, or t
tcagtacagatcgtcacgaccggtgctcgatttagtgtcacacgaagggaaagggggctggaatgggtctcactttattagtggtagcgccgacttcacacactacgcagactccgtgatgggccggttctccgatctccagagacaattccaacaacacggtgtatctgcaaatgaacagcctgagagccgacgatacggccgtatacctactgtgcgaaactttgccgactacgataattttgagtggtcttgactactggggccagggagccctggtcatcgtctcctcagcctccaccaagggcccatcggtcttcccccgtgggccacccctcctcccaagacgcaccctctggggggccacgagcggccctgggctgcctggtcaaggactacttccacgatctgtacctgagcgggctgggcaaggtcgcatagnnngnnntnctancnnngnngnnnnnnnnnnnnnnnnnnnnnn

SEQ ID NO: 56913 - DNA, 425 bp, Homo sapiens
  misc_feature: GYAE6OF02HQ6QV.35.79.H02.1.454.CMB.1.raw
  modified_base (400)..(400): a, c, t, g, unknown or other
  misc_feature (400)..(400): n is a, c, g, or t
  modified_base (421)..(425): a, c, t, g, unknown or other
  misc_feature (421)..(425): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactggggccagggagccctggtcatcgtctcctcagcctccaccaagggcccatcggtctccccctggcaccctcctccaagagcacctctgggggcacagcggcctgggctgcctggtcaaggactacttccacgatctgtactgancgggctggcaaggcgcatagnnnnn

SEQ ID NO: 56914 - DNA, 220 bp, Homo sapiens
  misc_feature: GYAE6OF02I884N.35.79.H02.1.454.CMB.1.raw
  modified_base (217)..(220): a, c, t, g, unknown or other
  misc_feature (217)..(220): n is a, c, g, or t
tcagtacagatcgtcacgaccggtgctcgatttagtgtcacacgaaggagggtgccagggagccctggtcatcgtctcctcagcctccaccaagggcccatcggtcttccccctggcaccctcctccaagagcacctctggggcacagcggccctgggctgcctggtcaaggactacttccacgatctgtactgagcgggctggcaaggcgcatagnnnn

SEQ ID NO: 56915 - DNA, 226 bp, Homo sapiens
  misc_feature: GYAE6OF02F66P5.35.79.H02.1.454.CMB.1.raw
  modified_base (217)..(226): a, c, t, g, unknown or other
  misc_feature (217)..(226): n is a, c, g, or t
tcagtacagatcgtcacgaccggtgctcgatttagtgtcacacgaaggagggtgccagggagccctggtcatcgtctcctcagcctccaccaagggcccatcggtcttccccctggcaccctcctccaagagcacctctggggcacagcggccctgggctgcctggtcaaggactacttccacgatctgtactgagcgggctggcaaggcgcatagnnnnnnnnnn

SEQ ID NO: 56916 - DNA, 503 bp, Homo sapiens
  misc_feature: GYAE6OF02JLDAF.35.79.H02.1.454.CMB.1.raw
  modified_base (288)..(288): a, c, t, g, unknown or other
  misc_feature (288)..(288): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (484)..(486): a, c, t, g, unknown or other
  misc_feature (484)..(486): n is a, c, g, or t
  modified_base (489)..(503): a, c, t, g, unknown or other
  misc_feature (489)..(503): n is a, c, g, or t
tcagtacagatcgtcacgaccggtgctcgatttagtgtcacacgaagggaaaggggcgtggaatgggtcgtcacttattagtggtagcgccgacttcacacactacgcagactccgtgatgggccggttctccatctccagagacaattccaacaacacggtgtatctgcaaatgaacagcctgagagccgagatacggccgtatactactgtcgcgaaacttgccgactacgatattttgagtggtcttgactactggggccagggagccctggtcatcgtctctcngcctccaccagggcccatccggtcttcccccgtggccacccgtcctcctaacgacgccacctcgtcgggggtcaccgacgccgggacccttgggcctcggacccgtcggtccgaaacgggacctaccgttcccgacggtactcgtcgtacccgtgacgccgggctcgggctaagggccgacacgtagnagntgntnnntcnnnnnnnnnnnnnnn

SEQ ID NO: 56917 - DNA, 471 bp, Homo sapiens
  misc_feature: GYAE6OF02JAFC9.35.79.H02.1.454.CMB.1.raw
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (395)..(395): a, c, t, g, unknown or other
  misc_feature (395)..(395): n is a, c, g, or t
  modified_base (441)..(443): a, c, t, g, unknown or other
  misc_feature (441)..(443): n is a, c, g, or t
  modified_base (446)..(471): a, c, t, g, unknown or other
  misc_feature (446)..(471): n is a, c, g, or t
tcagtacagatcgtcacgaccggtgctcgatttagtgtcacacgaagggaaaggggctgggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgaccgactacgatattttgagtggtcttgactacgtggggccagggagccctgggtcatcgtctcctcagcctcaccaagggcccatcggtctccccctggcaccctcctccaancgcacctntggggcacacgcgccgtggctgcctggtcaaggactacttccgacgatcngttacctgacggcgggcgtggcgtaaacgggcgacgatacggatgnnngcnnnnnnnnnnnnnnnnnnnnnnnnnn

SEQ ID NO: 56918 - DNA, 304 bp, Homo sapiens
  misc_feature: GYAE6OF02H5GLE.35.79.H02.1.454.CMB.1.raw
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
  modified_base (159)..(159): a, c, t, g, unknown or other
  misc_feature (159)..(159): n is a, c, g, or t
  modified_base (229)..(304): a, c, t, g, unknown or other
  misc_feature (229)..(304): n is a, c, g, or t
tcagtacagatcgtcacgaccggtgctcgattttagtgtcacacgaaggtaggggttggccagggagccctgggtcatcgtctcctcagcctccaaccaaggggccccatccggtcttccccctggcacccctcctccgaagngcacctntggggcacngcggccctggggctgcctggtcaaggctacttccacgatctgtactgagcgggctggcaaggcgcatagnnnnnnnnnnnnnnnnnnnnnnnnnnnnnnnnnnnnnnnnnnnnnnnnnnnnnnnnnnnnnnnnnnnnnnnnnnnn

SEQ ID NO: 56919 - DNA, 437 bp, Homo sapiens
  misc_feature: GYAE6OF02FIAD8.35.79.H02.1.454.CMB.1.raw
  modified_base (296)..(296): a, c, t, g, unknown or other
  misc_feature (296)..(296): n is a, c, g, or t
  modified_base (427)..(437): a, c, t, g, unknown or other
  misc_feature (427)..(437): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactgggggccaggggagccctggtcatcgtctcctcagcctccnccaagggcccatcggtcttccccctggcaccctcctccaagagccacctctgggggcacagcggccctgggctgcctggtcaaggactacttccacgatctgtactgagcgggctggcaacggcgcatagnnnnnnnnnnn

SEQ ID NO: 56920 - DNA, 478 bp, Homo sapiens
  misc_feature: GYAE6OF02IMC47.35.79.H02.1.454.CMB.1.raw
  modified_base (445)..(445): a, c, t, g, unknown or other
  misc_feature (445)..(445): n is a, c, g, or t
  modified_base (455)..(478): a, c, t, g, unknown or other
  misc_feature (455)..(478): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgacgaaacttgaccgactacgattattttgacgtggtcttgatacgtggggccaggagcctggtcatcgtctcctcagcctccaccgaacgggcccatcggtccttcccctggccaccctcctccaagcgccacctcgtggggccagcgcggcccgtggcctgaccgtggtacaacgggtacctccgttaccgcgaactctggtactggacgtcgggcgtcggacgagggacnctaagagcgnnnnnnnnnnnnnnnnnnnnnnnn

SEQ ID NO: 56921 - DNA, 446 bp, Homo sapiens
  misc_feature: GYAE6OF02FRQSN.35.79.H02.1.454.CMB.1.raw
  modified_base (336)..(336): a, c, t, g, unknown or other
  misc_feature (336)..(336): n is a, c, g, or t
  modified_base (429)..(446): a, c, t, g, unknown or other
  misc_feature (429)..(446): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactggggccagggagccctggtcatcgtctcctcagcctccaccaagggcccatcggtcttccccctgcacccctcctccaagngcacctctgggggcacagcggccctgggctgcctggtcaaggactacttccacgatctgtactgacgcgggctgggacaagggcgacataggnnnnnnnnnnnnnnnnnn

SEQ ID NO: 56922 - DNA, 438 bp, Homo sapiens
  misc_feature: GYAE6OF02HM3BV.35.79.H02.1.454.CMB.1.raw
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
  modified_base (425)..(426): a, c, t, g, unknown or other
  misc_feature (425)..(426): n is a, c, g, or t
  modified_base (428)..(438): a, c, t, g, unknown or other
  misc_feature (428)..(438): n is a, c, g, or t
tcagtacagatcgtcacgaccggtgctcgatttagtgtcacacgaagggaaaggggctggaatgggtctcacttattagtggtagcaccgacttcacacactacgcagactccgtgatgggccggttctccatctccagagacaattccgaacaacacggtgtatctgcaaatgaacagcctgagagcccgacgatacggccgtatactactgtgcgaaacttgccgactacgatatttgagtggtcttgactactggggccagggagccctggtcatcgttctcctcagcctccaccaaggcccatcgtcttcccccnggcaccctcctccaagngcacctctgggggcacacgcggccctgggctcgcctcggtcaaggactacttccacgatctgtactgagcgggctggcaggcgcatagnngnnnnnnnnnnn

SEQ ID NO: 56923 - DNA, 221 bp, Homo sapiens
  misc_feature: GYAE6OF02FO682.35.79.H02.1.454.CMB.1.raw
  modified_base (217)..(221): a, c, t, g, unknown or other
  misc_feature (217)..(221): n is a, c, g, or t
tcagtacagatcgtcacgaccggtgctcgatttagtgtcacacgaaggagggtgccagggagccctggtcatcgtctcctcagcctccaccaagggcccatcggtcttccccctggcaccctcctccaagagcacctctggggcacagcggccctgggctgcctggtcaaggactacttccacgatctgtactgagcgggctggcaaggcgcatagnnnnn

SEQ ID NO: 56924 - DNA, 425 bp, Homo sapiens
  misc_feature: GYAE6OF02FUFE4.35.79.H02.1.454.CMB.1.raw
  modified_base (420)..(425): a, c, t, g, unknown or other
  misc_feature (420)..(425): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactggtgccagggagccctggtcatcgtctcctcagcctccaccaagggcccatcggtcttccccctggcaccctcctccagagcacctctggggcacagcggccctgggctgcctggtcaaggactacttccacgatctgtactgagcggctggcaaggcgcatagnnnnnn

SEQ ID NO: 56925 - DNA, 606 bp, Homo sapiens
  misc_feature: GYAE6OF02G5SOB.35.79.H02.1.454.CMB.1.raw
  modified_base (155)..(155): a, c, t, g, unknown or other
  misc_feature (155)..(155): n is a, c, g, or t
  modified_base (211)..(211): a, c, t, g, unknown or other
  misc_feature (211)..(211): n is a, c, g, or t
  modified_base (269)..(269): a, c, t, g, unknown or other
  misc_feature (269)..(269): n is a, c, g, or t
  modified_base (537)..(537): a, c, t, g, unknown or other
  misc_feature (537)..(537): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (556)..(558): a, c, t, g, unknown or other
  misc_feature (556)..(558): n is a, c, g, or t
  modified_base (560)..(562): a, c, t, g, unknown or other
  misc_feature (560)..(562): n is a, c, g, or t
  modified_base (565)..(565): a, c, t, g, unknown or other
  misc_feature (565)..(565): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (603)..(604): a, c, t, g, unknown or other
  misc_feature (603)..(604): n is a, c, g, or t
tcagtacagatcgtcacgaccggtgctcgatttagtgtcacacgaagggaaaggggctggaatgggtctcacttattagtggtagcggccgacttcacacactacgcagactccgtgatgggccggttctccatcctccagagacaattccaaanaacaccggtgtatctgcaaatgaacagcctgagagccgagatacggcgtatactangtgcgaaacttgccgactacgatattttgatggtactgactacgtggggccagggacncccgtggtcctacgttcgtcccgttcctcacgtcccctaccgaacccgtaacgggccccctaagttcccgggtttcccttccccccgtggaccctaaccccgtcccttaccgaacgaccgcctaccgtccggtacggggtccacggcggtccgacccgtggggccttacgcccgttggaccgtaacgtacccttaaaccgttcccaacggtaacttcgttagttccgtagggcggaccggggtctacggacacgggacgtcacgtagnaacgtgactgacgnacncnnngnnntanagtacgngtncgtancgatngnagtngngtcgngncgnnga

SEQ ID NO: 56926 - DNA, 481 bp, Homo sapiens
  misc_feature: GYAE6OF02F1WGP.35.79.H02.1.454.CMB.1.raw
  modified_base (269)..(269): a, c, t, g, unknown or other
  misc_feature (269)..(269): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (468)..(481): a, c, t, g, unknown or other
  misc_feature (468)..(481): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatcctccagagacaattccaacaacacggtgtatctgcaaatgaacagcctgagagccgacgatacggcccgtatactactgtgcgaaacttcgccgactacgattactttgagtgtcttgactacgtgggccagggngccctggtcactcgttctcctcacgccctccaaccacgggccccagttccgggtccttcccccgtggccctacccctcctccaacgacgccacctcgtcggggccacgtacggccgtccgtcgggctcgcccgtggtacgaaggtacctacttccaacgtntcgtcgttacnggaggcgggtcgtgcgtaggcgcagtnnnnnnnnnnnnnn

SEQ ID NO: 56927 - DNA, 529 bp, Homo sapiens
  misc_feature: GYAE6OF02HBLG0.35.79.H02.1.454.CMB.1.raw
  modified_base (176)..(176): a, c, t, g, unknown or other
  misc_feature (176)..(176): n is a, c, g, or t
  modified_base (267)..(267): a, c, t, g, unknown or other
  misc_feature (267)..(267): n is a, c, g, or t
  modified_base (319)..(319): a, c, t, g, unknown or other
  misc_feature (319)..(319): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
tcagtacagatcgtcacgaccggtgctcgatttagtgtcacacgaagggaaaggggctggaatgggtctcacttattagtggtagcgccgacttcacacactacgcagactccgtgatgggccggttctccatctccagagacaattccaacaacacggtgtatctgcaaatgaanagcctgagagccgacgatacggccgtatactactgtgcgaaacttgccgactacgattagttttgagtggtcttgactactgggccagggngcctggtcatcgtctcctcagcctcaccgaacggcccagtcgtcctccccgnggccaccctcctccgaacgacgcaccgtcgtcggggccacgtacggccgcccgtgggcgtcgcctcggcgaacggtacctacgttccctacgcttctcggtactggcgcgggctgggccaaggccgacgtagtacgagngtnacgngcntgacngtcngntngtgngncgntcgtagagtagngtntntcagtagcgngcntcganagtn

SEQ ID NO: 56928 - DNA, 536 bp, Homo sapiens
  misc_feature: GYAE6OF01CFKZM.10.17.B06.1.454.CMB.1.raw
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatccgacggagggcccacgtggcatcccagccaggttcaggtgcagtgggtctgggacagcttcactctcaccatccaccggtcctagaccctgaacgtattttgctagtttacttactgtcagcagcgtagcagcctcgcccctctccctcgtacgtttcggcggacgggaccaagggtggagacgtacgaaacggacgtggtggcctgccaacctacttctcgttcttctcgttccccg

SEQ ID NO: 56929 - DNA, 505 bp, Homo sapiens
  misc_feature: GYAE6OF01B398V.10.17.B06.1.454.CMB.1.raw
  modified_base (197)..(197): a, c, t, g, unknown or other
  misc_feature (197)..(197): n is a, c, g, or t
  modified_base (501)..(501): a, c, t, g, unknown or other
  misc_feature (501)..(501): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccagggggaaanagtcaccctctcctgcagggccagtcagactattagtacaaacttggcctggtaccagcataaacctggccaggctcccaggctcctcatccatggtgcatcctccagggccactaatactcccagccaggttcagtggcagtgggtcgggtcagagttcactctcaccatcagcagcctgcagtctgaagtatttgctagtttattactgtcagtcagtatgtatacctggtcctcgtactacgtttcgggccggggtacagcgtgaatcaagcgactggtggctcgcactatctgtcttctnttcc

SEQ ID NO: 56930 - DNA, 525 bp, Homo sapiens
  misc_feature: GYAE6OF01DOFQW.10.17.B06.1.454.CMB.1.raw
  modified_base (197)..(197): a, c, t, g, unknown or other
  misc_feature (197)..(197): n is a, c, g, or t
  modified_base (369)..(369): a, c, t, g, unknown or other
  misc_feature (369)..(369): n is a, c, g, or t
  modified_base (431)..(431): a, c, t, g, unknown or other
  misc_feature (431)..(431): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagngtcaccctctcctgcagggccagtcagactattagtacaaacttggcctggtaccagcataaacctggccaggctcccaggctcctcatccatggtgcatcctccgagggcccactaatactcccagcctaggttcaggtggcaggtggggtcggggtcagtgttcacgtcncaccatcagcagcctgctagtctagaagtattttgactagtttattactgttcagtctagtntgtactacgtgccttccgtagttacgtttcgggccgggtacagcgtagaatcgaagcgaacgtgtggctagcacgtatctgtcttctgttcccg

SEQ ID NO: 56931 - DNA, 511 bp, Homo sapiens
  misc_feature: GYAE6OF01BMTMM.10.17.B06.1.454.CMB.1.raw
  modified_base (505)..(505): a, c, t, g, unknown or other
  misc_feature (505)..(505): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcaggtgggtcgggtcagagttcactctcaccatcagcagcctgcagtctgaagtattttgctagtttattactgtcagcagtatgataccgtgacctccgtactacgttttcgggcccggggtacagcgtaggaatcgaagcgaactgtaggctgcactatctgtcttctnttcccg

SEQ ID NO: 56932 - DNA, 593 bp, Homo sapiens
  misc_feature: GYAE6OF01CA6EH.10.17.B06.1.454.CMB.1.raw
  modified_base (197)..(197): a, c, t, g, unknown or other
  misc_feature (197)..(197): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
  modified_base (560)..(560): a, c, t, g, unknown or other
  misc_feature (560)..(560): n is a, c, g, or t
tcagcatagtagtgcacgaccggtgctcgatttagtcgatagtgaagggggaggaactgctcagttaggacccagacggaaccatggaagccccagctcagcttctcttcctcctgctactctggctcccagacaccaccggagaaattgtgttgacacagtctccagccacctgtctttgtctccgaaggggaaangccaccctctcctgcagggccagtcagagtgttggcgcctacgtagcctggtaccaacagaaacctggccaggcctccacggccctcatctatggtgcatccaacgagggccacgtggcactcccagccgaggttcagtcggctaggtggtcgtggggaacaggtaccttcaactctacacctatcatcacgtccgtgacgtccgtagaagtnttgttgtactagttttactacgtntactaactctacgtacgtacggtcggtcccggtccggggtccttaccggtttcccgggacccgttcggggaaccttaaaggtcgagttacgtaacgtaaacggtacttggtgccgttagacctacnttcgtcgtccttactacttcccttccgcctacg

SEQ ID NO: 56933 - DNA, 614 bp, Homo sapiens
  misc_feature: GYAE6OF01DQ2H5.10.17.B06.1.454.CMB.1.raw
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccgagggcccaactaatactcccagcctaggttcagtggcaggtgggtcgggtcagngttcactctcacctatcagtcagcctgcagtctagtaatntttgacttatttattacgtgtacagtctagtatgtacttaccgttcggtacccttacccgttaacgttaccgttttacggggacccggggtaacccgtaaggtccgttaaggtaaacgtaccgtaaacgggtaccggtaaacgttgggtacggtaccttacgggacccttaacccgtaattccgttaaggtttcccttacgtaccgtttacccccgg

SEQ ID NO: 56934 - DNA, 529 bp, Homo sapiens
  misc_feature: GYAE6OF01EBF9M.10.17.B06.1.454.CMB.1.raw
  modified_base (196)..(196): a, c, t, g, unknown or other
  misc_feature (196)..(196): n is a, c, g, or t
  modified_base (419)..(419): a, c, t, g, unknown or other
  misc_feature (419)..(419): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctcccaggctcctcatccatggtgcatcctccgagggcccactaatactcccagccaggttcagtggctaggtggggtcggggtcaggagttcactctcaccatcagcagcctgcagtctgaagtattttgctagtttattactgtcagntagtatgatcctggtccttccgtacttacgttttcgggccggggtaccacgcgtaggaatcgaagcgtaacgtggtcggtctcgcacctatcttgttcttctcttccccg

SEQ ID NO: 56935 - DNA, 783 bp, Homo sapiens
  misc_feature: GYAE6OF01CV6TD.10.17.B06.1.454.CMB.1.raw
  modified_base (198)..(198): a, c, t, g, unknown or other
  misc_feature (198)..(198): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtcctccggccaccctgtctgtgtctccaaggggaagngtcaccctctcctgcaggccagtcagactattagtacaaacttggcctaggtaccagacaactaaaccgtggaccaggcctcccgaggcctcctcactccatcggtgcactccctccgaggacccactaatactcccgagcctaggttcaggtcggacgtaggttcgggggtcggggtcaaggtacgtttccgactccgtaccaaccgtactacgacgtaccgacggtcccgtagccgtagttccgtaagtaaaggttacttttttcggaactttaaggtttttacttaacgttgttacgtagtaccgtaagtttacgtacggtaaccttacccggttcggtacccctttacccggtttaacgtttacccggggtttttaccggggggaaccccggggggttaacctaacgggttaccggttaaacgggtaaaaaccgttaccggaaaaccgggttaccggttaaaaccggtttgggttaccggggtacccggttacccggaacccccgttaaacccggtttaacctttacccgtttacgggttttaacccctttcccgggtttaaaccctttaccccccccggg

SEQ ID NO: 56936 - DNA, 569 bp, Homo sapiens
  misc_feature: GYAE6OF01A7MHZ.10.17.B06.1.454.CMB.1.raw
  modified_base (196)..(196): a, c, t, g, unknown or other
  misc_feature (196)..(196): n is a, c, g, or t
  modified_base (358)..(358): a, c, t, g, unknown or other
  misc_feature (358)..(358): n is a, c, g, or t
  modified_base (427)..(427): a, c, t, g, unknown or other
  misc_feature (427)..(427): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctcgaggggaaangtcaccctctcctgcagggccagtcagactattagtacaaacttggcctggtaccagcataaacctggccaggctcccaggctcctcatccatggtgcatcctccagggccaactaatactccccagccaggttcaggtggcaggtggggtcggggtcaggngttcactcgtcaccatcgagcagcctgcagtctgaagtattttgctagtttattactgtcagcagtatnagttacctcggccttacccggtactaccggttttcggggacccggggacctaacgtcgtaggtaaactcgaaacggcgtaaacgtggttcggcgttggacccgtacctacgttaccttagttcctttcgaacgtttcccccg

SEQ ID NO: 56937 - DNA, 525 bp, Homo sapiens
  misc_feature: GYAE6OF01A3UW9.10.17.B06.1.454.CMB.1.raw
tcagcatagtagtgcacgaccggtgctcgatttagtcgatagtgaaggggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatcggtgcatcctccagggccactaatactcccagccaggttcaggttggcagtgggtcggggtcaggagttcactctcaccatcagcagcctgcagtctgaagtattttgctagtttattacgtgttcagtctagtatgatacctggtcctccgtactacgttttcggccggggtaccaggctaggaatcgaagccgaactgtggctcgacacctatactgtcttcgacttcccg

SEQ ID NO: 56938 - DNA, 633 bp, Homo sapiens
  misc_feature: GYAE6OF01C9FV0.10.17.B06.1.454.CMB.1.raw
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaagagtcaccctctcctgcagggtcagtcagactattagacaaacttggcctggtaccagcaataacctggccaggcctcccgaggctcctcatccagtggtgcactcctccgaggaccactaatctacccagccaggtcagtggactaggtcggggtcgggtcaggtacgttcactctcacctatcagtcagtccgtgcagtctagaagttatttgacttagtttacttacgtgtctagctagtatacgtacgtaccgtcggtacccttacccgttaaccgttaccgggttttacggggacccggggggtaacccaagggtaccgttaacgggtaaaccgtccgtaaacggaccggtaaacggttacgggttacggtaccgtacggaccctaacccgtacttaccgttacgtttacccgttctacccgtttacccccg

SEQ ID NO: 56939 - DNA, 735 bp, Homo sapiens
  misc_feature: GYAE6OF01B58VY.10.17.B06.1.454.CMB.1.raw
  modified_base (200)..(200): a, c, t, g, unknown or other
  misc_feature (200)..(200): n is a, c, g, or t
  modified_base (315)..(315): a, c, t, g, unknown or other
  misc_feature (315)..(315): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtcctccggccaccctgtctgtgtctaccgaggggaaagngtccaccctctcctgcgacgggccagtcagactagttagtactaaacttcggcctggtaccagcaagtaaaccgtggaccaggcctcccgaggcctcctacactccagtcggtcncactcccgtccgacggcctaagtaactcctacccgacgtccgtaaggttcaaggttcggccgtaagggtcgggggtacggggtctaaggttaccgttccgacgttcctacctaaccgacttaccggacgactaccgggtcctacggacccgtagttaccgtaaggttaaggtttacttttccggaacgttaacggtttttactaccgttgtaaccgtaacgggtacgttaaggttactaggtaacccttacccgggttcggtacccccggttaccgttaccggttaccggtttccgggggtaaccccgggtactaacggtccgtaaaggtaaacgtccgtaacggacgtaaccggttggacggtccgtacggaccccttaacgtcgtttccgtacggttccttaccgtccgtttaccccg

SEQ ID NO: 56940 - DNA, 780 bp, Homo sapiens
  misc_feature: GYAE6OF01DNNVV.10.17.B06.1.454.CMB.1.raw
  modified_base (199)..(199): a, c, t, g, unknown or other
  misc_feature (199)..(199): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagacaccaccggagaaattgtgttgacacagtcctccagccacgctgtctttgtctaccgaaggggaanacgcccaccctctcctgcagggccagtcagtagtgttccgctacgttcggttagggtgtactcaactaataaactccggaccaggcctcccgaggtcctcctctacttctttagattcgtcctttaccgaacgtaccgggtccccgtcgggccgttccccgagggtccgtaggttccgaggtcggcgtagggtcgggtacgtgggactacgtaccttccactctaccaccatcgacgcacgtccgtaaggacgtaccgttaggtaaacgttacgtttttacgaacgtttaagtttttacgttaaccgttcggttacgaaccggtcgttaacgggtccggttaccggttaaccccgttttaaccgggttttccgggaaccggggtttacgggttacccgttcccggtttaaccgggttttacccgggggaaccggggtaaacggggttaaaacccctaaaaagggtacgggtaaaccgggttaaacccaaacgggtaaacgtcgggtaccggtacgttaccgaccgtaaccctgttccgttaccgttccttaccgtacctttccccgtaccccgtccttacg

SEQ ID NO: 56941 - DNA, 715 bp, Homo sapiens
  misc_feature: GYAE6OF01BHSH5.10.17.B06.1.454.CMB.1.raw
  modified_base (197)..(197): a, c, t, g, unknown or other
  misc_feature (197)..(197): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaagngtcaccctctcctgcagggccagtcagactattagtacaaacttggcctggtaccagcataaacctggaccaggcctccgaggcctcctcactccatcggtgctacttccctccgacgggaccaacttaatacctacccacgtaccgtaggttccaggtcggcgtagggttcgggggtacgggggtacaacggtacgtttaccgtaccgttcctacccgaaccctaacttaccgaagaccgaacggtcccgttcgaaccctacggttacgttaacggtaaacggtttacgtttttggacgtttaagttttttacgttacgttacggttacgtaacgtacgtaacgttagttacgtacgttaccgtccggtaccctttacccggttaaccgtttacgggttttaccgggggacccgggtaacgtacggacgttaacggaaacgtacgaaacggtaccgtaacggtggtacgggtctacggaccctaacgtcttacgttacgtcttcctaccgttccccg

SEQ ID NO: 56942 - DNA, 665 bp, Homo sapiens
  misc_feature: GYAE6OF01EKYRD.10.17.B06.1.454.CMB.1.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagcatagtagtgcacgaccggtgctcgatttagtcgatagtgaagggggaggaactgctcagttaggacccagacggaaccatggaagcccccagcgcagcttctcttcctcctgctactctggctcccagataccactggagaagtagtgatgacgcagtctccggccaccctgtctgtgtctccgaggggaaangtccaccctctcctgcagggccagtcagactattagtacaaacttggcctggtaccagcataaacctggccaggctccagctcctcatccatggngcatccnccgacggccaactaatactcccagcctaggtcaggtgcgaggtcgggtacggggtcagtacgttcgactcctacaccataccgacgtcacggtcctgacctagttcgtaggtaaagttagtttttacgacgttagttttaacttacgttgtacagtactaagttaattaagttacgttacgtttagggtttttaacttcgttaccgttttacccgggtacccggttacgggtaacccgttaaagggttacggttacgtttaacgaacggtaaccgtaacggtttcggtagggtaccttcggtaccctaacccgtcttaccggtttcgttaccctttacgttaaccgttccccgtttaccccccgg

SEQ ID NO: 56943 - DNA, 648 bp, Homo sapiens
  misc_feature: GYAE6OF01BFRPS.10.17.B06.1.454.CMB.1.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaanagtccaccctctcctgcgagggccagtcagactattagtactaaacttggcctggtaccagcataaacctggccaggctcccaggctcctcatccatggtncactccgtccgacggccaactaactactcccagccaggttcaggtggcaggtgggtcggggtacaggtacgtttcacgttctaccgacctattcgacgcacgaccgtagacgtccgtaggtaacgttatttttcgacgtttaagttttacttacgtcgtacgtacgtcagtccgttcgtccctacgggtttccgggcgggtacgggtccgaccgttaccgggtttaccgggacggggtaacgggtaaccaaaagggttaacgaacgggtaaccgtaaaacggtacgttagggtacggtcgtacgaccaacccgtataccgttcgttacctttctaccgttcccgttaccccg

SEQ ID NO: 56944 - DNA, 844 bp, Homo sapiens
  misc_feature: GYAE6OF01A7RR1.10.17.B06.1.454.CMB.1.raw
  modified_base (196)..(196): a, c, t, g, unknown or other
  misc_feature (196)..(196): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgagggaagngtccaccctctcctgcgagggccagtcagacttatagtactaacttcggcctaggtaccagcactaaaccgtggaccagcctacccaggtcctcctactactccagtggtcgctactcccgtaccgacgggtaccctactaactactaccccgacgtacccgtacggttaccaggttcggaccggtaggggttccgggggttaccgggggtaccgtacgggttaacgtttccccgtaacgtttccccgtaaccgtaaccccgtagttaaccgaaccgtaccgtaaccgggttcccgtcgtaccggttaggtttaccgttaagggttaaacgtttaacgtttttacggtaacgtttaaacggtttttacgtttaccgttacggttaccgtacggttaacgttacggttaacggttacggttaaccgttaccggttaccgggttaccccgtttacccggtttaacccgtttaccgggtttttacccgggggacccgggggttaaccgtaaccggtaccggttaaacgggtaaaccgttaccggtaaaaccgggtaccggtaaccggttacgggtacgggtaccttacggtaaccctaacccgtttacgttacccgttacgtttaccttccccgttacgtttaccccccgg

SEQ ID NO: 56945 - DNA, 820 bp, Homo sapiens
  misc_feature: GYAE6OF01ADYKF.10.17.B06.1.454.CMB.1.raw
  modified_base (195)..(195): a, c, t, g, unknown or other
  misc_feature (195)..(195): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctcgaggggaancgtccaccctctcctgcacgggccagtcagtactatacgtacaacgttcggcctaggtaccagacctaacgtaaaccgtggaccacggcctaccccgacggtccttaccgtacaacttcccgtaagtcggggtactcctaaccgtcccgtaccgaacgggtaccctaacttaaactcctaccccgaggtcccgtaaggttccgaacgggtcgggtaccggtagggttcgggggtaccgggggtactaaacgggttcggtttacccaaccgtttccgtaacccgtaacccgtaacgttacccggaacgtaccgtaaccggtcccgttacggacctaacgggtttaccgtaaggttaaacgttttcgttttacggaaccttttaaggtttttaactaccgttgtaacccgaggtacgtaacgttagtacgttaccgttaaccgtccggttacccgttaccggtaaccggttacggtttaccgggggacccgggttaaccagggtaacgttacgggtaaactaccggtaaaggtcccgtttaaacggtcgggtttaacgcccgttaccggtacctaacccgttcttaccgttaccgttaccctttacccggttaacctttccccccgg

SEQ ID NO: 56946 - DNA, 896 bp, Homo sapiens
  misc_feature: GYAE6OF01DTUOU.10.17.B06.1.454.CMB.1.raw
  modified_base (156)..(156): a, c, t, g, unknown or other
  misc_feature (156)..(156): n is a, c, g, or t
  modified_base (796)..(796): a, c, t, g, unknown or other
  misc_feature (796)..(796): n is a, c, g, or t
tcagcatagtagtgcacgaccggtgctcgatttagtcgatagtgaagggggaggaactgctcagttaggacccagacggaaccatggaacgccccagcgcagcttctccttcctcctgctactctgcctcccagactaccacgtggagaagttagngatgacgcacgtcctcccggccctaccgttgtccttgtcgtccgtaccgggaaggggaaactctccctaccctcgtccgtgccgaagggcctaggtctaactactttaagttaacggaacctaagttccggacgttacgtaaccagtaacctaaacgtaaccggcggaccgtacggaccctacgaccggtccctacctactatccgtaggtcggtcgacctcttacccgaccgacggtaccaataacgtcctacccgagtaccgtagtgaggtcggtacggacggttgggtaccggatagggtactaccgtactccaacgtacaacggtagaccggtacctacgggttcaacggtcgttaacggttacaacggtttagtttagtttaaccggtaaccttttaaggtttaactttacccgggtagtaaccggttaacgtaaccggtttaaagtaccggtttaaccggttaccgtttaacccggggttaccccgggtttaaccccgttcccggggttaaaccgggtttttaccccggggttaaccggggggttaaccccccgggggtaaattaaccggggtaaacggtttaacgggaaaaccccggtttacccgaaaaaccggggtttcgggtttaaaccgnggggtttaaccccgaacgtacggtttaaacccccggacttttccggttttaacccgtaaggtttttcccctaacccgggttaacctttaacccccccggg

SEQ ID NO: 56947 - DNA, 755 bp, Homo sapiens
  misc_feature: GYAE6OF01C7979.10.17.B06.1.454.CMB.1.raw
tcagcatagtagtgcacgaccggtgctcgatttagtcgatagtgaagggggaggaactgctcagttaggacccagacggaaccatggaagccccagcgcagcttctcttcctcctgctactctggctcccagactaccacgtggagaagtagtgatgacgcagtcctccggccaccctgtctgtcgtcctaccgaaggggaaatcgtccaccctctccgtgcgacggccagtcaagtacttagttaacgtaactaaacgtttcggaccgttaggtaaccaggaacctaaacgtaaacccggtcggacccgacgaccctacccgagtccctcgtactacgtccgtaggtcggtcgtacctaccgttccccgaaccggtaccggtaccctaaacgttaacctacccgaccccgtacggtaccgttacggtaccgtagggtcggtacggtcggggttcgggggtaccggtacgtaacggttaccgtacctaccgtcctaacctacgtacgtacgacgacgtccgtaccgtagtacgtcgttaaccggtaagttaacgtttacgtttacgacgtttaaagttttactacgtagtaccgaagtctaagttcgttacgaccttccggtaccgtcccgtttaacgttaccgggtttccgggtaccgggaaccggtactaggacgttaacggaactaccgagtaccggtagtcggtacgcgtacctacgtactacgttactcgttacctcgtaccgttccccg

SEQ ID NO: 56948 - DNA, 554 bp, Homo sapiens
  misc_feature: GYAE6OF01BEM9B.10.17.B06.1.454.CMB.1.raw
  modified_base (196)..(196): a, c, t, g, unknown or other
  misc_feature (196)..(196): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactatagtacaacttggcctggtaccagcataaacctggccaggctcccaggctcctcactccatggtgccatcctcacgggccactaatatcccagccaggttcagtcgcaggtgggtcgggtcagtgttcactctcactatcagcagcctgactntgtagtagttnttgtagtttagtttactacgtcgtacgacgtagtagtatacgtactccgtcgtacctcgtacgtttcggtacgggaccggtaatacggtacgtaaggactagaacgtacgtacggtaggtcgtcgcgtacctacgtctacgttaccttctcctcgttaccccg

SEQ ID NO: 56949 - DNA, 928 bp, Homo sapiens
  misc_feature: GYAE6OF01AJN0F.10.17.B06.1.454.CMB.1.raw
tcagcatagtagtgcacgaccggtgctcgatttagtcgatagtgaagggggaggaactgctcagttaggacccagacggaaccatggaagccccagcgcagcttctcttcctcctgctactctggctcccagataccaccggaagaaattgtgttgacacagtctccagccacgcttcgtctttgtctccgaaggggaaacacgcccaccctctcctgcagggccagtcagtagttgttcgactacgttcggttaggggtggtacttacaaacattaaacgtcccggtaccaacgggtcctaccccgaggtccttaccgtactacgttccttttaggacttacgttccttttaaccgaaaccggtaccggggtccccttcggggtcccgttacccgacgggtccttacgggtttcacggggttcggaccggtcgggttacgggttccggtacgggggaaacctacggttaaccgtttcccggaaccctttacccggttcccaaccgttaacgttaccgaacggtccaaaccggttacccgttaacggtaaccgggttacccgttaaagggaaaccgttttagtttttacggaacgttttaaacggttttttaacgttaacggttacgttaccgtaaacggtccggtacggtaccggttcccgtaacccgtttaccggttttaccggggggaaccgggttaccgggtttacgggtaccccgtttacgggtttacccggggggtaaccgggtaacgggtaaaacccgttaaaaacgggttcgggtaaaccgggtttaaacccgttaaaacggggtaaacccggttacggggttacggtaccgttaaccggaccgttaccggtaaccgttttccgttaccggtttaccttcccgttaaaccgtttccccgttaccccgtccgtttaacccg

SEQ ID NO: 56950 - DNA, 650 bp, Homo sapiens
  misc_feature: GYAE6OF01BUSZU.10.17.B06.1.454.CMB.1.raw
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctcggccacccttgtctgtgtctccgaggggaaancgtccaccctctccgtgcagggtccagtcagtactattagtacaacttggcctaggtaccagcaataaccnggccaggcctcccagcctctcatccagtgtncactcctaccgacggccaagtaactctcccgagacctaggtactaggtcggctagggtcggggtcgggtanacgtagtttcacgttccncacctactccgagtccacgccgtcgaccgtaggtctaaggtaacgtttgtttacgcgtttaaagtttacttaccgttatacgacttacgagtttatacgtacgttcgtaccggtccttaccggtaccgtttcggtttaccggggaccgggtaactacgggtacgtacggtaaactcgaaacggttaccggaacgttcgggtacggttccggtactaccctaaccggtctttacggtacgtttccttccctacgttccccccg

SEQ ID NO: 56951 - DNA, 871 bp, Homo sapiens
  misc_feature: GYAE6OF01A3NLZ.10.17.B06.1.454.CMB.1.raw
  modified_base (197)..(197): a, c, t, g, unknown or other
  misc_feature (197)..(197): n is a, c, g, or t
tcagcatagtagtgcacgaccggtgctcgatttagtcgatagtgaagggggaggaactgctcagttaggacccagacggaaccatggaagccccagcgcagcttctcttcctccgtgctactctggctcccagataccactggagaagtagtgatgacgcagtctccggccaccctgtctgtgtctccgaggggaangtccaccctctcctgcgacgggccagtccagtacttattacgtaactaaacgttcggaccgttggtaaccagactaactaaaccgtcggacctacggcctacccgacggtcctccgtacactacccgagttcgggtacgacctaaccgttccccgtaccggaaccggggtaccctaaaccgttaaaccttaccgtaccccgtaacggtaccccgtaagggttttaccgaagggttccgggaccggttaacggggttccggggggttaccggggttacgaagggttaccgtttaccgtaaccgtttccgtaaccctaacccgtaacgttacccggtacgtaccgttaccggtaccccgttacggtacccgtacggtttacgttaacgggtttaaacggttttaacgtttttccgggaaccttttaaagtttttaacgtttaccgttacggtaaccgtacggtaaaccgttaagtttaacgtaccggttaaccttaacccgggttcgttaccccggtttaccgtaacggtttaccgggttttaccggggaacccgggtactaacgggtaccgttaagggtaaacctacggtaaccggtacgtaacggtgggttacgtccgtacggaacctaaccgttacgttaccgttacgtttacctccgttcccgtttaccccg

SEQ ID NO: 56952 - DNA, 943 bp, Homo sapiens
  misc_feature: GYAE6OF01AJ2NO.10.17.B06.1.454.CMB.1.raw
  modified_base (199)..(199): a, c, t, g, unknown or other
  misc_feature (199)..(199): n is a, c, g, or t
tcagcatagtagtgcacgaccggtgctcgatttagtcgatagtgaagggggaggaactgctcagttaggacccagacggaaccatggaagccccagcgcagcttctctcctcctgctactctggctcccagataccactggagaagtagtgatgacgcagtctccggccaccctgtctgtcgtctaccgaggggaacgngtccaccctctccgtgccgacggcctaaggtcaagtacttagttacgtaactaaaacgttcggaccttcggtaaccgacgtaccgaacttaaacccgttggtacccgacggtaccgtccccgaacggtccctaccgttaccaccttacccgtaagttcgggtaccgtacccgtaacgttacccccgtcccggaaccgggggtacccttaaaccgttaaacccgttaaccgtacccccggtaacggtaccccggttaaaaccggggttcgtaaaccggggtcggtacccggggtaaggggttccggggggttaccggggttacgtaaacgggttacgttaccgtaacccgtcccgttaaccgacccgttagtaacccggacgtacccgtacggaaccccgtttcgacccgttaacggttcccggtaagttaaaccggtttacggttttccgggttaactttaaacggttttacttacccgggttaccggtaccggtaaacgttacggtaaccgtttaagttacccggtaaggtttaccccggttacccggttacccccgtttaaccgggtttaccgtttaacccggggtttacccgggggtaacccccgggttaacggtaccggtttaaccggtaacgggttaaaccgttacggtaaccggtaacgtaacgggttccggtacgggtaccgttacgtaacccgtcggtacgttcgtaccgttaccgttaccgtccttaacccccgg

SEQ ID NO: 56953 - DNA, 905 bp, Homo sapiens
  misc_feature: GYAE6OF01BECES.10.17.B06.1.454.CMB.1.raw
  modified_base (225)..(225): a, c, t, g, unknown or other
  misc_feature (225)..(225): n is a, c, g, or t
tcagcatagtagtgcacgaccggtgctcgatttagtcgatagtgaagggggaggaactgctcagttaggacccagacggaaccatggaacgccccagcgcagcttctcttcctcctgctactctggctcccagactaccacgtggaagaagtagtgatgacgcagtcctccggccacccgtgtctgtcgtctaccggaaggggaaactcgtccacccctctccgngccgacggcctagtccaagtacttaagttaacgtaacctaacgttcggccgttaggtacccaagacctaaactaaaccgtcggaccgaccgacctcccgaacgtcctacctacaactccgtagtcggtctcctaccgtccgtacccggaccgggtaccctaaacttaaccgtaccctaccccggaacgttacccggttaacgggttacgaccgggtttacgggacgggttaacggggttacgggggttaccgggggtaactaacggggtttactttacccctaacgttcccgttaaacccaacccgtaagttacccggaacggacccgtaccggtaccgtacgtccgttaacggttaccgttaaggtttaaaccgttttagttttaaccgacgttttaaacgttttaacgtaacgttcggttaacgtaacgttaccggttaagttaaccggtaacttaaccgttaacccgggtcccgtacccgttttaaccccgggtacgttttacccggggttaccgggggaaacccgggttcgtaaacgggtcgtttaaaaaccggtaaccgtacggtaaaaaccgtacccggtttaagtaccgggtacgggtccttaccggaaaccctaaccgttccggtttaccggttttaccgttaaccttcccgtaaccccgttttaacccccg

SEQ ID NO: 56954 - DNA, 711 bp, Homo sapiens
  misc_feature: GYAE6OF01D1S69.10.17.B06.1.454.CMB.1.raw
  modified_base (195)..(195): a, c, t, g, unknown or other
  misc_feature (195)..(195): n is a, c, g, or t
  modified_base (503)..(503): a, c, t, g, unknown or other
  misc_feature (503)..(503): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtcctccggccaccctgtctgtgtctcgagggaangtccaccctctcctgcgaggccagtcagactattacgtaactaaacgttcggcctaggtaccagactaactaaaccgtcggaccacggcccttacccgaggtccttccctacacttacccgagttcgggtcgcctaccgttccccgtaccgaacgggtaccctaacgttaacctaccttaccccgaaggtcccgtaggtttaccgagggtcggacgtagggttcgggggtacgggtactaggtacgtttccaccgtcctaccgacctatcgacgcgacgtccgtgtactacgttacgtagtaaagttnttttacggactttaagttttacttacgtagttaccagtactaagttacttacgtaaccttaccggtccgtacccgtttaccgttaaccgtttccgggtttaccggggaacccggggttaacaacgggtcgtaaacggaaacgtacggaacgtacgtaacggttggacgtctcgacctaacggtcttacgtcttctccgtcgttccccg

SEQ ID NO: 56955 - DNA, 723 bp, Homo sapiens
  misc_feature: GYAE6OF01ARFB5.10.17.B06.1.454.CMB.1.raw
  modified_base (201)..(201): a, c, t, g, unknown or other
  misc_feature (201)..(201): n is a, c, g, or t
  modified_base (439)..(439): a, c, t, g, unknown or other
  misc_feature (439)..(439): n is a, c, g, or t
  modified_base (655)..(655): a, c, t, g, unknown or other
  misc_feature (655)..(655): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagactaccacgtggagaagtgtgatgacgcagtcctcccggcctacctgtctgtcgtctacggaagggaancgtccaccctctccgtgacgaggccagtcagtactaagttacgtaacctaacgttcggccgttacggtaacccaggtaacctaactaaaccgtcggacccgaacgtccctacccgaacggtcctaccctacactccgtagtcgggtccacctaccgttcccgtaccgacggtaccctaaacttacctaccgtcccacgtcccgtaggttcgaggtcggacgtagggtcgggtcggtanacggtatcgtactcgactacctagcacgcgacgtccgagtcgtacgtcgtagtatttacgtttagacgtttacgtttagtacttacggtactaggcttaacgtagtacgttaccgtaccgtcgttacccgttaccggttaacgttccggggtttacgggaccgggtaactcggtaacggtacgtaaaacgtcggtaaaccggtcggttaaaccggngggttaccggacgttaccctaaccgttactaacgtttccgttaaccgttcttacccgtcgtttacccg

SEQ ID NO: 56956 - DNA, 506 bp, Homo sapiens
  misc_feature: GYAE6OF02IR3YN.10.17.B06.1.454.CMB.1.raw
  modified_base (196)..(196): a, c, t, g, unknown or other
  misc_feature (196)..(196): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctccccaggctcctcatccatggtgcatcctccagggccactaatatcccagccaggttcagtggcagtgggtcggggtcagagttcactctcaccatcagcagcctgcagtctgaagattttgctagtttattactgttcagcagtatgatacctggtcctccgtactacgttttggccggggtaccaggctggaatcgaagcgaactgtggctgcaccatctgtcttcattccg

SEQ ID NO: 56957 - DNA, 502 bp, Homo sapiens
  misc_feature: GYAE6OF02H4OLC.10.17.B06.1.454.CMB.1.raw
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagatttgctagtttattactgtcagcagttatgatacctggcctccgtactacttttgggccggggtaccaagctggaatcaagcgaactgtggctgcaccatctgtcttcattccc

SEQ ID NO: 56958 - DNA, 523 bp, Homo sapiens
  misc_feature: GYAE6OF02G8JXL.10.17.B06.1.454.CMB.1.raw
  modified_base (196)..(196): a, c, t, g, unknown or other
  misc_feature (196)..(196): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagtatttgctagtttattactgttcagcagcgtgcctacgtttcggcggtaggtcgccgtacgtttcgggcgggtacggaaccgaaagtagaggtacaaacggaacgtggtggctgcaccgatctgtcttcattcccg

SEQ ID NO: 56959 - DNA, 498 bp, Homo sapiens
  misc_feature: GYAE6OF02F59MD.10.17.B06.1.454.CMB.1.raw
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagtatttgctagtttatactgttcagcagtatgatactggcctcgtactacgtttcggccggggtaccagctaggaatcgaagcgaactgtggctgcacntctgtcttcntcc

SEQ ID NO: 56960 - DNA, 528 bp, Homo sapiens
  misc_feature: GYAE6OF02II3Y6.10.17.B06.1.454.CMB.1.raw
  modified_base (293)..(293): a, c, t, g, unknown or other
  misc_feature (293)..(293): n is a, c, g, or t
  modified_base (426)..(426): a, c, t, g, unknown or other
  misc_feature (426)..(426): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcaataaacctggccaggctccaggctctcatccatggtncatcctcaggccactggcatcccagacagttcagtgcagtggtctgggacagacttcactctcacatcagcagacgtggagcctagaagtatttgctagtgtattactgtactagacagtagtggtcgcccgngtcctacgtacggtttcggcgggacggacctaagggttacgagtaacgtacgaaaacggtactggtacggtctgaccaccgattcgtcgttaccttctaccg

SEQ ID NO: 56961 - DNA, 509 bp, Homo sapiens
  misc_feature: GYAE6OF02HIJ43.10.17.B06.1.454.CMB.1.raw
  modified_base (496)..(496): a, c, t, g, unknown or other
  misc_feature (496)..(496): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctacagggccagtcagactattagtacaaacttggcctggtaccagcataaacctggccaggctcccaggctcctcatccatggtgcatcctccagggccactaatatcccagcccaggttcagtggcagtgggtcggggtcagagttcactctcaccatcagcagccctgcagtctgaagattttgctagtttattactgtcagcagtataatagctggcccgtgtacgttcggaccgaagggaccgagggtcggaattcaaacgactgaggctgcacatctgtctnactcttccgctac

SEQ ID NO: 56962 - DNA, 543 bp, Homo sapiens
  misc_feature: GYAE6OF02IZ1JW.10.17.B06.1.454.CMB.1.raw
  modified_base (197)..(197): a, c, t, g, unknown or other
  misc_feature (197)..(197): n is a, c, g, or t
  modified_base (394)..(394): a, c, t, g, unknown or other
  misc_feature (394)..(394): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccagggggaaanagtcaccctctcctgcagggccagtcagactattagtacaaacttggcctggtaccagcataacctggccaggctcccaggctcctcatccatggtgcatcctccgagggccactaatactcccagccaggttcagtggcaggtgggtcgggtcaggagttcactcacaccatcagcagcctgcacgtcgtgaagtntttgctagtttacttactgttcagtcagtatgtatacctgcccttcgtacttacgtttcgggaccggggtaccaacggtcgtaggaactcgaacgtacgtaacgtggtacggtcgtcgacaccgtactctacgtcttacgtacttcccg

SEQ ID NO: 56963 - DNA, 496 bp, Homo sapiens
  misc_feature: GYAE6OF02FQEMU.10.17.B06.1.454.CMB.1.raw
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagatttgcagtgtattattgtcagcaatatggtaggtcacctgggacttttggcgaggggaccaagctggagatacaacgaactgtaggctgcacatctgtcttcattccg

SEQ ID NO: 56964 - DNA, 520 bp, Homo sapiens
  misc_feature: GYAE6OF02JZVHB.10.17.B06.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (336)..(336): a, c, t, g, unknown or other
  misc_feature (336)..(336): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaangtcaccctntcctgcagggccagtcagactattagtacaacttggcctggtaccagcataaacctggccaggctcccaggctcctcatccatcggtgcatccctccagggcccactaatactcccagccaggttcagtgcngtcgggtcgggtcagacgttcactctcaccatcagcagcctgcagtcngaagtntttgactagtttatactgtcagtctagtatatgtattggtttatcgtacgtttcgccttagggacctaagtcgtattcgagtacgagtggtgcgtgaccactactcttcggtcttacgtcttccttcccg

SEQ ID NO: 56965 - DNA, 508 bp, Homo sapiens
  misc_feature: GYAE6OF02HLWXL.10.17.B06.1.454.CMB.1.raw
  modified_base (196)..(196): a, c, t, g, unknown or other
  misc_feature (196)..(196): n is a, c, g, or t
  modified_base (386)..(386): a, c, t, g, unknown or other
  misc_feature (386)..(386): n is a, c, g, or t
  modified_base (488)..(488): a, c, t, g, unknown or other
  misc_feature (488)..(488): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtgcatcctccagggccactaatatcccagccaggttcagtgcagtgggtctggaacagagttcactctcaccatcagcgctgcagtctgaagtnttttgctagtttattactgtcagctagtataatgtacttggttttatctactttcggccttgggacctaaagtgtattcgagacgtacgtggtgctgcactntctgtcttctatccttcccg

SEQ ID NO: 56966 - DNA, 678 bp, Homo sapiens
  misc_feature: GYAE6OF02GSQNS.10.17.B06.1.454.CMB.1.raw
  modified_base (197)..(197): a, c, t, g, unknown or other
  misc_feature (197)..(197): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaangtcaccctctcctgcagggccagtcagactattagtacaacttggcctggaccagcataaactggccaggctccagctcctcatccatggtgcactcctccgacgggcctaactaatactcccacgccaggttcaggtcggacgtaggtcgggggtcggggtacgaggtagttcacttcgtacctaaccataccgagcctacgccgtcgacgtacgtcgttagtaaacggttattttacgtacttaacggttttaactttaacgttgttaccgtagtacgtaagttacgttagtaaccgttaccgttcgggtacccctttacccggttaaccgtttaccggttttaccgggggtaccccgggggtaaccgtaaacggtaccggtaacgggtaaactacggaaacggtaccggtaacgttagggtcggccgttacgacctaccgtacgttccgttacggtttcctttacctacgtttccccg

SEQ ID NO: 56967 - DNA, 528 bp, Homo sapiens
  misc_feature: GYAE6OF02H2S9M.10.17.B06.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (350)..(350): a, c, t, g, unknown or other
  misc_feature (350)..(350): n is a, c, g, or t
  modified_base (394)..(394): a, c, t, g, unknown or other
  misc_feature (394)..(394): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaanagtcaccctntcctgcagggccagtcagactattagtacaacttggcctggtaccagcataaacctggccaggctccaggctcctcatccatggtgcatcctccagggccactaactatcccagccaggttcagtggcagtgggtcggggtcagnggttcactctcaccatcagcagcctgcagtctagtagattttgntagtttattatgttcgagtctagtatgacttactggccttcgtacacgtagtttcgggccggggtacaacgcgtaggaatacaaggcgaacgtggtggtctgacctaccgtaattcgtacgttccttattaccg

SEQ ID NO: 56968 - DNA, 568 bp, Homo sapiens
  misc_feature: GYAE6OF02FHERO.10.17.B06.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccagggggaaangtccaccctctcctgcagggccagtcagngtgttcgctacttcggttagggtgtatcaacataaatccggcaggcncccaggcctcctcatctttgatgctttcaacngggccctggccgtccgagcaggttcaggtggcaggtgggtcngggacagacttcactctcacatcagccagcctagacgccgtagaagtattttgactagttttattactgtcagcagcgtcgcctacgtttcgggcggtaggtcgcccgtacgtttccgggcgggtaacgggaacctaaaagtacggaggtaaccaacggtaacgtaggtcggctacgacaacctacgttactcgttaccttccacttcccttacccgtacc

SEQ ID NO: 56969 - DNA, 610 bp, Homo sapiens
  misc_feature: GYAE6OF02GHJWO.10.17.B06.1.454.CMB.1.raw
  modified_base (397)..(397): a, c, t, g, unknown or other
  misc_feature (397)..(397): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctccaggctcctcatccatggtgcatcctccgagggccactaatatcccagccaggttcagtggcaggtgggtcggggtcagtaggttcactctacacctatcagcagcctgccaggtctagaagtnttttggacggtttactacgtgttacagccgtaaggccgtacggcctaacgtcggtccgtggtccgtttccccgtttccgggcccgttaggggaaccctaaagggttcggaacgttactacgtaaaaccgtaacggttgggttacgacgttccggaccgtaaccgtaactttcggttaccgttaccgtttactaccgtttcccttaccccccgg

SEQ ID NO: 56970 - DNA, 589 bp, Homo sapiens
  misc_feature: GYAE6OF02HEX7S.10.17.B06.1.454.CMB.1.raw
  modified_base (286)..(286): a, c, t, g, unknown or other
  misc_feature (286)..(286): n is a, c, g, or t
  modified_base (458)..(458): a, c, t, g, unknown or other
  misc_feature (458)..(458): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaagagtcaccctctcctgcagggccagtcagactattagtacaaacttggcctggtaccagcataaacctggccaggctcccaggcctcctnatccatggtgcatcctccgacgggccaactaatactcccacgccacggttcaggtcggcaggtcgggtcgggggtcaggtagttccactctaccaacctatcacgcagtccctgctacgtctagaaagttatttggacttaggttttacttactacggttcaggtctagttntagtactacgtcgtcccttcgtacgttcgttttacggggacccggggtaacctaaggtcgtaggtaactcgaagtacgaacgttggtcggtacgtcgactaccgtacgttcctagttcctctaccttcccg

SEQ ID NO: 56971 - DNA, 633 bp, Homo sapiens
  misc_feature: GYAE6OF02GMIWP.10.17.B06.1.454.CMB.1.raw
  modified_base (197)..(197): a, c, t, g, unknown or other
  misc_feature (197)..(197): n is a, c, g, or t
  modified_base (436)..(436): a, c, t, g, unknown or other
  misc_feature (436)..(436): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaanagtcaccctctcctgcagggccagtcagactattagtacaacttggcctggtaccagcaataaacctggaccaggcctcccgaggcctccctcactccatggtgctactccctccgagggtcccaactaatactcccagacctaggttccaggtcggcgtaggtgggggtccgggggtcagggtacgtttcaacttccgtaccacctactcacgcacgccgtgacagtctaggaagttntttgacttagtttattacgtgttacagtctagttatcgtacttaccgtcggtcccttaccggttacttaccggttttcggggacccggggaaccaacggtccgtaagggtaaacctcggaacggtaccggtaaacgttgggtacggtacttcggacctaacctcgttccgttacggttcctttaccgactttccccg

SEQ ID NO: 56972 - DNA, 709 bp, Homo sapiens
  misc_feature: GYAE6OF02JDXTK.10.17.B06.1.454.CMB.1.raw
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
tcagcatagtagtgcacgaccggtgctcgatttagtcgatagtgaagggggaggaacgtgctcagttaggacccagacggaaccatggaagcccagcgcagcttctcttcctctgctactctggctcccagactaccactggagaagtagtgatgacgcagtctccggccacctgtctgtcgtctccgaggggaaancgtccaccctctccgtgcgagggccagtccaagtactattacgtaacaaccttggccttggaccagtcaataaccgtgccagcctccgagtcctcgtacactccagttcggngctctcccgtcgacggcctaacgttaatacctccccagaccttacggttacgacggtggaccgtagggttcgggggtaccggggtacaggtaccgtttcaccgttcgtacctaaaccgattccggaacgcctaaacggtcccgtcggtacctacggttcctaaggtaaacgtttacgttttaacgacgtttaacggttttacgttaacgttcgtacgtacgacttaagttacgtagtaacgtcgtacggtacccgttccggtttaacgttaccggttttacggggaaccgggttaacccgtaacggtacgtaagtaaccgtacgtaacggaccggtaaaccgttggtaccgggtcttacgggacctaacttcgtaccttcgtttactactccgttacccg

SEQ ID NO: 56973 - DNA, 723 bp, Homo sapiens
  misc_feature: GYAE6OF02JL1LJ.10.17.B06.1.454.CMB.1.raw
  modified_base (182)..(182): a, c, t, g, unknown or other
  misc_feature (182)..(182): n is a, c, g, or t
  modified_base (210)..(210): a, c, t, g, unknown or other
  misc_feature (210)..(210): n is a, c, g, or t
tcagcatagtagtgcacgaccggtgctcgatttagtcgatagtgaaggggaggaacgtgctcagttaggaccagacggaaccatggaagcccagcgcagcttctcttcctcctgctactctggcctcccagactaccactggagaagtagtgatgacgcagtctccggccaccctgtctgtntcctccgaggggaaacagtccacccgtntcctgcagggccagtcagacttattacgacaaacttcggcctaggtaccagacactaaaccgtcgaccgacgcctccacggcctcctccactccagttcggtcgctacctcctccgacggcctaactaactactcccagcctaggttcacgtacggcgtacggtcggggtccgggtcacggtacgtttcaccgttcgtacctaccagtccacggtcaacggtcctacgctacgtacgtacgtaacgttatttcggacttaagttttacttacgttgtaccgtaagtaccgttagttattacgaaccgtttaccgacggttcccctaccggtttaccgtttacggtttttacccggggggaccggggtaacctaaacggtcgtaacgggttaaacctcggttaaaccgggtaccgttaacggttacggttacgggacccgttaacggttacccggtaactttacccgggttaccgtttaccggttaaccgtttaccgtacccgtttacccccgg

SEQ ID NO: 56974 - DNA, 653 bp, Homo sapiens
  misc_feature: GYAE6OF02H3LHD.10.17.B06.1.454.CMB.1.raw
  modified_base (207)..(207): a, c, t, g, unknown or other
  misc_feature (207)..(207): n is a, c, g, or t
  modified_base (308)..(308): a, c, t, g, unknown or other
  misc_feature (308)..(308): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaaggggaagagtcaccctntcctgcaggccagtcagactattagtaacaaacttggccttggaccagcaactaaacctggaccgacggcctaccgacggctacctcacgtccatcggtcncactcccgtacaggtcccaataactaactcccaagccaggttacagtcggctagtggggtcggggtacaggtacgtttacgacctgtaccaaccgtattacccaggaccacggtacccgtcgccgtaagttcgttaacgtaaaggttaagtttttaccgacgttaagtttttaactttaaacgtgttaccgtaagacgttaatagtagtacgtaaccgtcgttacccgttaccgtactttacggtttcgggaccggggtacaaacggtcgtaggaactacgaacggtacgtaacgtcgtggtcgtcgacgtacctacttccgtacgttcttaccgtattccccgg

SEQ ID NO: 56975 - DNA, 777 bp, Homo sapiens
  misc_feature: GYAE6OF02GC5BW.10.17.B06.1.454.CMB.1.raw
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggtaaagcgtccacccttcctccgtgcgacgggccctagtcaacgtacttagttacgtaacctaaacggttcggtccgtacggtaccacgtacaactaaaccgtcggaccacggccctaccccgacggtccctcccgtactacctccgtagttacggtcgacctacctcccttaccggaccgggacctaaacgttaacgtacctcccgaacgaccgttacggttaccgaggttcgggcgtacggggttcgggggttaccggggtcgtacggttaacggtacctaccgtcccgttaaccacccgttaacctcgacgtacccgtacgtcccgtacgtaccgtacgtacgttaacggtaaagtttacgtttcgtacgtttacgttttaacgttacgtgttacagtacgtagttacgttacgaccgttaccgtccggttaccttaccgtttaacgtttaccgggtttacggggtaacccgggtaaactaacggtaagttacggtaactacggaagtaccgtaacgttgggaccgtcggtaccaccgttaccgttacgtaccttccgttaccttacctacgtttacccccg

SEQ ID NO: 56976 - DNA, 638 bp, Homo sapiens
  misc_feature: GYAE6OF02G28YT.10.17.B06.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
tcagcatagtagtgcacgaccggtgctcgatttagtcgatagtgaaggggggaggaactgctcagttaggacccagacggaaccatggaagccccagcgcagcttctcttcctcctgctactctggctcccagataccactggagaagtagtgatgacgcagtctccggccaccctgtctgtgtctccagggggaaangtcaccctntccngccagggccagtcagactattagaacaaattcggcctaggtaaccagtcaataaacctggaccaggctccgagctacccgtnactccgatggtncactccgtacgacgggccaactaacgtactacccgagaccgtaggttacaaggtcgggcaggttcgggggtcggggtacaggtattctactctacactactacaggtcagcctgcttacgtactaggtaacgtagtttcgacgttaagtttaacgttacgtgtacgtaggtactaaggttactacgacgttaccgtggtaccctccgttaacgttcgtttacggggaccgggtaaacacggtacgtaaggtaactacgaaggtaccgtaagttacggtgggtaccttaggaccctactaacgttccttacggttacttacgtacgtttccccg

SEQ ID NO: 56977 - DNA, 590 bp, Homo sapiens
  misc_feature: GYAE6OF02H35EQ.10.17.B06.1.454.CMB.1.raw
  modified_base (197)..(197): a, c, t, g, unknown or other
  misc_feature (197)..(197): n is a, c, g, or t
  modified_base (361)..(361): a, c, t, g, unknown or other
  misc_feature (361)..(361): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtcctccagggggaanagtcaccctctcctgcagggccagtcagctatagtacaaacttggcctggtaccagcataaacctggaccaggctcccaggctcctcactcatggtgctatcctccacgggccactaatactaccccgagccaggttcagtggctaggtggggtcgggtcaggnggttccacgtctacctaccattcagccacggcctagcagtctaggaagtattttgacttagtttattacgttgtgtagactagttactgtacttaccgtcggtacccgttccggttactacgggtttccgggaccggggtacctaacggtcgtaggaactacgtaacgtacgtaaccgttgtacggtcgacgaccactacgtcgttcgttaccttacctagttaccccg

SEQ ID NO: 56978 - DNA, 733 bp, Homo sapiens
  misc_feature: GYAE6OF02IUR0R.10.17.B06.1.454.CMB.1.raw
  modified_base (193)..(193): a, c, t, g, unknown or other
  misc_feature (193)..(193): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccacctgtctgtgtctcgagggaangtccaccctctcctgctagggccagtcagacttattaacgtacaaacgttcggcctacggtaccacgtacaactaaaccgtcggaccaacgggcctaccccgaagggtcccttaccccttacctaactacccaagttcgggtcggactacctcccgtaccgacgggaccctactaaactacctccccgacgtccgtaggttccaggtcgacgaggttcgggggaccgggttagacggtaacgtttacctacgttcctacccgtaaccgcttaccgacgacgaacgtccgtacgtaccgtaacgtttccgtaaggtaaaccggttagttttcgacctttaaggtttttaacgtttaccgttaggttactacggtacgttaaggttattacggtaacgttacccgtcggttacccgtttaccggtacgtttaccgggtttcgggggtaccccgggtaatacggtaacgtacgaactacgaacgtcggtaacgtcggtacggtcacgactaccgtattccgtcgttcctacgtacttaccccg

SEQ ID NO: 56979 - DNA, 776 bp, Homo sapiens
  misc_feature: GYAE6OF02I940V.10.17.B06.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (588)..(588): a, c, t, g, unknown or other
  misc_feature (588)..(588): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggcctcccagactacacgtggacaagtagtgatgacgcagtctccggccacctgtctgtcgtctaccgaggggtaaacgngttccaccctctccgtgacgacgggcngtcaacgtacttagtaaggtacctaaacgtcgggtaccttacggtaccagaccaaacgttaaacccgtcggccgaacggcccttaccgacgggtcctccctcctaacgtccagttcgggtcgacgtacctccgtccggaacgggacctaactaaccttacgtacccccgacggtaccgttacgggttaccgagggttcgggaaccgttaggggttacggggggttacccgggggtttaacacgggttacggtttacccgtacctccgtaacctacgtacgttaccgaggtcctaacgtcgtcggactacggtactacggtaacttacgtttacgtacgttaagttacttacgtacgtntacgacgtacgtagttacgtcgttaaccgtcggtcccttacgtacggttaccggtttacgggacccgggtaaccggtacgtaacgaacgtaaccgtacgtaacggttaccgtaacggttcggttaaccgtcgtaaccgtaccgtaccgttaccgttacgtcgtttacccgtattacccgttaccccgg

SEQ ID NO: 56980 - DNA, 832 bp, Homo sapiens
  misc_feature: GYAE6OF02FNP0R.10.17.B06.1.454.CMB.1.raw
  modified_base (159)..(159): a, c, t, g, unknown or other
  misc_feature (159)..(159): n is a, c, g, or t
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgnagtctccggccacctgtctgtgtctccgagggggaaangtcacctcgtcctgcagggccagtcagactattaacgtaacaaacgttcgccgtagggtacccagcaactaaaaccnggaccaggcctcccgaaggtcctacctccacgtccagttgggtcgacctacttcccctccggaacgggacccaacgtttaaactaccgttacccccgaagggacccctaaagggtttccgaaggttcgggaccgtagggtccgggggggtacgggggttaaccagggttaacggtttccaaccgtttaccgtacaaccctaaacggttccgaaggcctaacggtcccgttaggtaccgaagtttccgttaaagggtaaacgtttagttttacgaaccgtttaagttttaaccgtttacgtaggttaccgaaggtactaaacggtttaacgtacggttaaccgttaaccgttcgggttacccgttacccggttttaaggttaacccgggttttttcgggggggaaacccccggggtaaaccggtaaccggtaacgttaaacggggtaaactaccggaaaacgggtcccggttaaaacggttcgggttccggggaccgtttacggtaccccgaacgtttacggtcccgttttaacgttccggttacctaaccgtttcccg

SEQ ID NO: 56981 - DNA, 795 bp, Homo sapiens
  misc_feature: GYAE6OF02G84O6.10.17.B06.1.454.CMB.1.raw
tcagcatagtagtgcacgaccggtgctcgatttagtcgatagtgaagggggaggaactgctcagttaggacccagacggaaccatggaagccccagcgcagcttctcttcctcctagctactctggctcccagataccactggaagaagttagtgatgacgtcagtctccggctaccctgtctgtcgtctccgagggaagagtccaccctctccgtgcgaggccacgtcaagtacttagttagtaacctaaacgttggtcctaggtaccaggtaccaataaccgtcggaccacggccctaccgagtcctccgactacgctaggtgtcgacttaccgttcccgcggtacgacctaagtaccttccaaccgtcgtaccgttacggacgttacgggtcggtacgttaggggttaccggggtaccggtaacgtacggttacggttacccgtaccgtttcggaaaccctagttacccggttaacgacggtaaccccgtaacggtccggtacgtaacccggtaacgggttaaccgtaacgggttaacgtttttaacgtttaaccggttaacgttttaaggtttaacccgtttaagttccggttaaacgttagttaaacccggtaagtttaacgttaaaccggtacggttaaccggtccgggtaaccggttaccggttaccggtaccggtaccggtaacggtacggtacggacgtaaccgtaccgtaagtaccggtggttaccgtaggacctaacgtcgtttcgacgttcgtttaccgtcctacccgttcgtaacccgtacc

SEQ ID NO: 56982 - DNA, 720 bp, Homo sapiens
  misc_feature: GYAE6OF02H92HT.10.17.B06.1.454.CMB.1.raw
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
  modified_base (451)..(451): a, c, t, g, unknown or other
  misc_feature (451)..(451): n is a, c, g, or t
  modified_base (578)..(578): a, c, t, g, unknown or other
  misc_feature (578)..(578): n is a, c, g, or t
  modified_base (679)..(679): a, c, t, g, unknown or other
  misc_feature (679)..(679): n is a, c, g, or t
tcagcatagtagtgcacgaccggtgctcgatttagtcgatagtgaagggggaggaactgctcagttaggacccagacggaaccatggaacgcccagcgcagcttctcttcctctgctactctcggctccagactaccagtggaagaagtagtgagcgacgctagtctccgaccctaccgtgtctgtgtcgtacggaagggaancgtcctacctcgtcgngacgacggactgtacagtacttattaagtaaacctaacgttcggtccgtagggaaccngtaacctaaacgtaaaccggtcgaccgacggtccacccgagtcccctctaccactccgtagttcggctaccgtactccccgtacggaccgaccttaacgttaacctaccgacccgacgtaccggttaggttacgtacggcgggacggtacggggttcgggggtaccgggtaacnggtttaccgtttaccaccttaccgtaccgaaaccgttctaccggacccgttccggaacgtccgttacgaccgtttggtacgttaacggtcgttaagttcgtaactttagttaccttaggtcctaagngtacgtatgtactccgtacgtctacccgtataccggttcgtccggaccggaactgtaacgtagaacgttacgaacgtgtaacgcgttagaccggtcgaccncgttaacgttccgttccgttactcccgttacgttacccccg

SEQ ID NO: 56983 - DNA, 807 bp, Homo sapiens
  misc_feature: GYAE6OF02GCWNF.10.17.B06.1.454.CMB.1.raw
  modified_base (194)..(194): a, c, t, g, unknown or other
  misc_feature (194)..(194): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctgctcccagactaccactggagaagtagtgatgacgcagtctccggccaccctgtctgtgtctcgagggaangtcacctctctgcgaggccagtcagactatagtacaattggcctggtacagcataacctggcaggctccgaggcctcctcactcctagtggtcgctactcccgtaccgacgggacctaacgttaacttaccgtacccctacggcccgtaacggtttaccgaacggttcgggacgttaacggggttcgggggttaccggggggtacgtaagggttaccggtttaccggtaccgtttaccgtacccgtaacctaccttaccggaacggtacccgtaaccgtcccgtttacggacgttacggtaccgttaaggtaacggttttagtttttacggacgtttaacgggtttttaacgtttaccgtttacggttacgtaccggttacgtaagtttaaattaacgtaacggtcgttaccgggacccgttaccggttaccgggttacccgggaaccggtaaacggggtaaccccggtaggggttaaccggtaaacgtttaaccgaaaccgggttaacgttacggggtaacggtaccgttaacggaccctaacccggttaacgttcccggttaccgtttacccgtaccgttaacccggttttcccgtaccccggttaacccg

SEQ ID NO: 56984 - DNA, 229 bp, Homo sapiens
  misc_feature: GYAE6OF01BYCTZ.44.53.E09.1.454.CMB.1.raw
  modified_base (229)..(229): a, c, t, g, unknown or other
  misc_feature (229)..(229): n is a, c, g, or t
tcagacagtatatacacgaccggtgctcgatttagagagagtgtgttgggttgggagccgggagtgaggccgactattactgtcaggtgtgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagn

SEQ ID NO: 56985 - DNA, 229 bp, Homo sapiens
  misc_feature: GYAE6OF01BL599.44.53.E09.1.454.CMB.1.raw
  modified_base (228)..(229): a, c, t, g, unknown or other
  misc_feature (228)..(229): n is a, c, g, or t
tcagacagtatatacacgaccggtgctcgatttagagagagtgtgttgggttgggagccgggatgaggccgactattactgtcaggtgtgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagnn

SEQ ID NO: 56986 - DNA, 529 bp, Homo sapiens
  misc_feature: GYAE6OF01BD02K.44.53.E09.1.454.CMB.1.raw
  modified_base (325)..(325): a, c, t, g, unknown or other
  misc_feature (325)..(325): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacgcccccaaactcatcatctatgaggcctataagaggccctnaggggtttctaatcgcttcactgcctccaagtccggcaacacggcctcctgacatctctgggctccaggctgaggacgaggctgatttattattgttgcttcagtatgttcgtcgctatcactttatgttcttcggaagtcgggaacctaaggtccaccgtcctaggtccacgccccaacggcccaaccccatcgtctcgtccg

SEQ ID NO: 56987 - DNA, 231 bp, Homo sapiens
  misc_feature: GYAE6OF01E4D5M.44.53.E09.1.454.CMB.1.raw
  modified_base (230)..(231): a, c, t, g, unknown or other
  misc_feature (230)..(231): n is a, c, g, or t
tcagacagtatatacacgaccggtgctcgatttagagagagtgtgttgggtttgggagccggggatgaggccgactattactgtcaggtgtgggatagtagtagtgatcatcgggtgttcggcggagggaccaagctgaccgtcctaggtcagcccaaggctgccccctcggtcactctgttcccaccctcctctatatactgtctgagcgggctggcaaggcgcatagnn

SEQ ID NO: 56988 - DNA, 617 bp, Homo sapiens
  misc_feature: GYAE6OF01D0D64.44.53.E09.1.454.CMB.1.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
tcagacagtatatacacgaccggtgctcgatttagagagagtgtgttggggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggacnccagcggtaatnttcttagtcttaacttgtctctgtatcaacatcatacaaggtaaacgccccaaactcatcatctatgacgtcctaataacggacgtccctacgtagggtttactaatcgtaccttcacctcgacctaccgaacgtcccggacaaccgaccggtccctccctagacctaattcctcgtcgggcctccgaggtcgtaggaggacggaggtctagtatttagtttattggttgcttagagtagtttcggttcgtcgtctacttctactttacgttgttcgttacgggaaggttacgggaaccgtaacggttccgtacccggtacgttacggtcaccggacccaaccgggtccccaaacccgtctacggtcctccgttcccg

SEQ ID NO: 56989 - DNA, 229 bp, Homo sapiens
  misc_feature: GYAE6OF01BPP4K.44.53.E09.1.454.CMB.1.raw
tcagacagtatatacacgaccggtgctcgatttagagagagtgtgttgggtttgggagccggggatgaggccgactattactgtcaggtgtgggatagtagtagtgatcatcgggtgttcggcggagggaccaagctgaccgtcctaggtcagcccaaggctgccccctggtcactctgttcccgccctcctctatatactgtctgagcgggctggcaaggcgcaatag

SEQ ID NO: 56990 - DNA, 621 bp, Homo sapiens
  misc_feature: GYAE6OF01BC3UI.44.53.E09.1.454.CMB.1.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (326)..(326): a, c, t, g, unknown or other
  misc_feature (326)..(326): n is a, c, g, or t
tcagacagtatatacacgaccggtgctcgatttagagagagtgtgttgggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcncctggacagtcgtcacatctctgcatgganccagcgtaatntctatcttacttgctctgtatcantcatcagtaacgccccaatcactcatctagtgagactagtaacgcgcctacgtagggttactaatcgtnttcgactcgcctacgacgtccgacaaccgaccggcctccgtagactaactccgtacgtcggtacctccgtaggctacggaacggacgtaaggtcctagttactttagttagttcgttgccttagtagtacgttcggttccgtaccgtacgtacttactaactttagttcggttacgttacgggtaaggtccgggtaaaccgtaaccggttccgtaccggttaccggttaacggtaccgaccggtaaccccgaacgggtaaccccaaccccgtagtccgtaccgtaccgttccccg

SEQ ID NO: 56991 - DNA, 867 bp, Homo sapiens
  misc_feature: GYAE6OF01B2VQY.44.53.E09.1.454.CMB.1.raw
  modified_base (208)..(208): a, c, t, g, unknown or other
  misc_feature (208)..(208): n is a, c, g, or t
tcagacagtatatacacgaccggtgctcgatttagagagagtgtgttgggtttgggggaggaactgctcagttaggacccagacggaaccatggaagccccagcgcagcttctcttcctcctgctactctggctccagataccactggaagaaatagtgatgacgcagtctccacgccaccctgtctgtcgtctaccgaaggggaaancgcccaccctctacctgcgacgggccagtcagtagtcgttaccagtactaacgttcgaccgttacggtaacccaaccgtaacggaaaaccgtcgggaccgtacgggtacccgtacccgtaacgggtcccttaccgtaccgtaaactccgttaacgtacgggaaacctaacctaccccgaacccggtacggggaccctaacgttaccggttaacctacccccgtaaccccggtagggttaccgtacgggttaccggaccggtacggggttaccgggggtacccggggaaaccgtaggtacgtttaccctaacggttccctaccgaaacccgtgtaccgaaccgggccggtaccttggaccgttacggtcgttacgggtacggtttatttccgtaacgtttacgttttaactacggtttcgtactaacgtacgtaagtttaaacttaacgtaacgttcccggtacctttaccgttaacccggttacgggtttacccggggggaccggggttaacggtaacgggttacgggaacggttaacgtaaaccgggtaaaaccggttcggttacgggtacggtcccgttaacggtaccctaacgttccgtttaccggtttcgtacccggtttacctaaacgttttcccccgttcccgtaacgttacg

SEQ ID NO: 56992 - DNA, 830 bp, Homo sapiens
  misc_feature: GYAE6OF01DGM5G.44.53.E09.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
tcagacagtatatacacgaccggtgctcgatttagagagagtgtgttgggtttggggggggtcaacaagaggcagcgctctcgggacgtctccaccatggcctgggctctgctgctcctcactctcctcaccaggacacagggtcctgggcccagtctgccctgactcagcctgcctcgtgtctgggtctccgtggacagtcggtacaccatcctcctgcacgtgganccagcgtaatnttctagtctttaacttgtctcgtgtactactaacatactaataccgaacggtaaaccgacccccaactcactactatctagtacggacggtaccttaagtaacggaccgtacccgttacggtacgggtttactaacttcgtacttcgtactcgtaccctaccgtaacggtcccggtaccgaaccgtacccggtcccttacccgagtaacctaaacgttccgttacggtccgggtaccctaccggtacgggtaccgtacgggaacgggtacgtaacgggtacgtagttaacttttagtttacgtttaggttacgtaccgttagtaacgttaacggtttcggtttaacccggttacgttaaccgttaacgtttaccgttaaccgtttagtttaccggttttaccgggttaaccggggttaaacgggttacccggggtaaacccgtttaaccggggtaccccgtttaaaccccgggttaccggtttaaaccgggtccccggtaaaaccccgggtaaccccgtaaaccccgggtaccccctaaaacccccggttacgtttacccggttaaccccgttcccgttttaaccccccgg

SEQ ID NO: 56993 - DNA, 231 bp, Homo sapiens
  misc_feature: GYAE6OF02HL1SI.44.53.E09.1.454.CMB.1.raw
  modified_base (230)..(231): a, c, t, g, unknown or other
  misc_feature (230)..(231): n is a, c, g, or t
tcagacagtatatacacgaccggtgctcgatttagagagagtgtgttgggtttgggagccggggatgaggccgactattactgtcaggtgtgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagnn

SEQ ID NO: 56994 - DNA, 673 bp, Homo sapiens
  misc_feature: GYAE6OF02IWU02.44.53.E09.1.454.CMB.1.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
tcagacagtatatacacgaccggtgctcgatttagagagagtgtgttgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttctagtcttacttgtctcctggtatcaacatcatccagtaaacgcccccaaatcatcattactatagaggtacctaagtaacgacggtcccctagtacggggttttacctaagtcgtcttacactcgtcctacctaacgtcccggacaaccaccggccctcccgtagaactacttcgtcgtcgggctacctagggctggaggacgaggtccgttagtatttaagtttagtttcgttgtcttaccgtagtgtttacggtttcgtaggacctattaccgttacgtttaagtttcggttaccgttttaggggaaacggttccggggtaacccgttaacgggttccgtaacccggtttacccgttacgggttacccaccgggtaccccaaacgggtaccccctaaaccccgtacgtccgtttaccggaccctttcccgg

SEQ ID NO: 56995 - DNA, 700 bp, Homo sapiens
  misc_feature: GYAE6OF02JAE2E.44.53.E09.1.454.CMB.1.raw
  modified_base (191)..(191): a, c, t, g, unknown or other
  misc_feature (191)..(191): n is a, c, g, or t
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (288)..(288): a, c, t, g, unknown or other
  misc_feature (288)..(288): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtcgtgggtcncctggactgtcggtcaccgattcctccgtgcactgggacnccaggccgtaatnttcttagtcttaattgctctggtatcaattcatcctaggtaacnccctaaatcatcatcatgagacctagtaagcgtcctgtagggttactagtctactcacctcgtccaccggaacgtccggaccaaccgtaccggtcctacccgttacgaactaactccggtaccgtcgggtacctaccggaggttaccgtacgggaacggtacggaacggtccgtttaagacgttttagttaaccggtttgtttcgtaccgttaaccgtaggttaagtttcggtacgttaaccggcttaacttaccggttaacttttacgtaccggtttcggttaacgggtaaggttacccggggtacgttaacggtccgtaaccccggtttaacggacgttaccgaccggttaacccgtaaccggaaccccctaaccccgttacggttccgttaccgtaacccgttcccggg

SEQ ID NO: 56996 - DNA, 826 bp, Homo sapiens
  misc_feature: GYAE6OF02GRILZ.44.53.E09.1.454.CMB.1.raw
tcagacagtatatacacgaccggtgctcgatttagagagagtgtgttgggtttgggggggggtcacaagaggcagcgctctcgggacgtctccaccatggcctgggctctgctgctcctcactctcctcaccaggacacagggtcctcgggcccagtctcgccctgactcacgcctcgcctccgtcggtcccgggtctccgtggactagtcagtccaccactcctcctgctattacggaaccaacgtagtcgtacggttcggttcgttttacggaccgttcgttcctccgttaggtaaccagaccaaccgaaccccaagaaaccacccgaacccccaaactctaatttactttagtcggacgtactaagttccggttcccgtccccgttccggttcgttcccgtaggaccgtccgtccgtttccgttccggtccgggtaccctaacggttccgtacgggacccaaccggtaccccggtaccccttacccgtacgtaaaccgtaccttccggtacgttccgggggtacctacccggtacgggtaccgtacggggaaccggggtaacggacgggttacgttaagtttaacgttttaacgttttacgtttcggttacgttccgtacgtaaggttcgtttcggtttaccggaccgtacttaaccgttacttaacgttttcgttacggttaccggttacggtaaacgggttccgggtaaaccgtacggtacccgttaccggttacgttacggcccgttaaccggaacccgtaaccggacccctaaccgtcctacgtacccgtaccgttccggttccccgttacccctcccc

SEQ ID NO: 56997 - DNA, 736 bp, Homo sapiens
  misc_feature: GYAE6OF02GBYOJ.44.53.E09.1.454.CMB.1.raw
  modified_base (204)..(204): a, c, t, g, unknown or other
  misc_feature (204)..(204): n is a, c, g, or t
tcagacagtatatacacgaccggtgctcgatttagagagagtgtgttgggtttgggggcagaagtctctctcagtcaggacacagcatggacatgagggtccctgctcagctcctgggactcctgctgctctggctcccagatactagatgtgacttccagatcgacccagtctccatcctccctgtctgcatcgtggtggganacagacgtccaaccatacctacgtttcgggcccgggtacgtacgtcgacggtcctaagtttacgacttaaatttacgtttaacgccttaggtatcaagcaaacgaaaccgaacgggaaacccttccgtaacccttcctaggtacttcgtttcgcttacgcctacttccctatttcgacctaacgttccggaacgggttcccagttcgttcggttacgaggcgtacagggtcggtaattcggtagggtactagttactttcctccgtactacctaccgtattcgaacgccgtagccttcggactaccggtactaacgtagttagttacgtacgacctttaaacgtttacgttaacgttacggtaaaacgtaaaaccgtaaactaacggttaacccgttacccgtaccccttaaccgtacccgtttaccggttttaccccgggaaccccggttaacgggaaaaccggtttaaggtaacccggtaaacgtttaacccgtaaacccggtaaaccggttacggttcgggtaacccgg

SEQ ID NO: 56998 - DNA, 653 bp, Homo sapiens
  misc_feature: GYAE6OF02I4OPU.44.53.E09.1.454.CMB.1.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
  modified_base (441)..(441): a, c, t, g, unknown or other
  misc_feature (441)..(441): n is a, c, g, or t
tcagacagtatatacacgaccggtgctcgatttagagagagtgtgttggggtttggggggggtcacaagaggcagcgctctcgggacgtctccaccatggcctgggctctgctgctcctcactctcctcaccaggacacagggtcctgggcccagtctgccctgactcagcctgcctccgtgtctgggtcncctggacagtcgtcaccatctcctgcacgtgganccgagcggtaatattcttagtcttaactttgtctctgtatcaacntcatccaggtaaccnccccaactcatctagtctangagtcctagaacgacgcccttaggtagggtttacactcgactttcactgcccttacgaacggtcccganaaccgtacgcccttcccgtacgaactacgtccgttcgacggtcctccgaggtctacgggacggacgngggtactaggttatttaaggttatttacggtcgtacgtacgtaagttcgttacgtcggttaccgtctaagttccgtaacgtttacgttcggttacgtttacggggacgttaccgggtaacgtacggttacccgaccggtttagtaccggtaacgaacccgtaccgaacccggacccgtaaaccccttggtacccgttcccaacgtttccccg

SEQ ID NO: 56999 - DNA, 685 bp, Homo sapiens
  misc_feature: GYAE6OF02JYL9D.44.53.E09.1.454.CMB.1.raw
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (554)..(554): a, c, t, g, unknown or other
  misc_feature (554)..(554): n is a, c, g, or t
  modified_base (575)..(575): a, c, t, g, unknown or other
  misc_feature (575)..(575): n is a, c, g, or t
  modified_base (589)..(589): a, c, t, g, unknown or other
  misc_feature (589)..(589): n is a, c, g, or t
  modified_base (675)..(675): a, c, t, g, unknown or other
  misc_feature (675)..(675): n is a, c, g, or t
tcagacagtatatacacgaccggtgctcgatttagagagagtgtgttggggtttggggggggtcacagaggcagcgctcgtcgggacgtctccaccatggcctgggctctgctgctcctcactctcctcaccaggacacagggtcctgggcccagtctcgccctagctcagtcctgcccgtcgtgtcgttggggtccaccgtggacctagtcggtacacctatcctcgtcgactacgtgggaactccgaggtcgttaatacgtttcttaacgtnttaaccgtttgtctaccgtggtacnctaanactcactacgaggtaaccnccccaatcaatcgtatctatacggacgtccgtaaggtaacgccgtaccttagggtacggtttactaactcgtaccttcctacgtaccgtaccgtaccgtaaccggtacggtaccaaccggttaacccgggcccttaccgttcggaacctacgtccgttacggtagggtcccctaggaccgtcggacgggacggagtaggtctaggttattaccgtttattggtacgttacntggtacgtttcggacggttcncgtactaaccgttnttacgtttcgtacgttacggaggttaggaccgtacgtccgtcccggaggttcgaactcccgagaaccggtcccgaacctgtacctntaccttcccg

SEQ ID NO: 57000 - DNA, 160 bp, Homo sapiens
  misc_feature: GYAE6OF01CSSN1.49.9.A09.1.454.CMB.1.raw
  modified_base (160)..(160): a, c, t, g, unknown or other
  misc_feature (160)..(160): n is a, c, g, or t
tcagagtcgagagacacgaccggtgctcgatttagcgagacgcgcagggcacgaccggtgctcgatttagtcacgcgagaaagggaaggggctggccctgacgtgtttctgttcccacctcctctctctcgactctgagcgggctggcaaggcgcatagn

SEQ ID NO: 57001 - DNA, 180 bp, Homo sapiens
  misc_feature: GYAE6OF01EO5S1.49.9.A09.1.454.CMB.1.raw
  modified_base (161)..(180): a, c, t, g, unknown or other
  misc_feature (161)..(180): n is a, c, g, or t
tcagagtcgagagacacgaccggtgctcgatttagcgagacgcgcagggcacgaccggtgctcgatttagtcacgcgagaaagggaaggggctggccctgacgtgtttctgttcccgccctcctctctctcgactctgagcgggctggcaaggcgcatagnnnnnnnnnnnnnnnnnnnn

SEQ ID NO: 57002 - DNA, 162 bp, Homo sapiens
  misc_feature: GYAE6OF01B8SUX.49.9.A09.1.454.CMB.1.raw
  modified_base (162)..(162): a, c, t, g, unknown or other
  misc_feature (162)..(162): n is a, c, g, or t
tcagagtcgagagacacgaccggtgctcgatttagcgagacgcgcagggcacgaccggtgctcgatttattcacgcgagaaagggaaaggggctggccctgacgtgtttctgttcccaccctcctctctctcgactctgagcgggctggcaaggcgcatagn

SEQ ID NO: 57003 - DNA, 507 bp, Homo sapiens
  misc_feature: GYAE6OF01BFVIX.49.9.A09.1.454.CMB.1.raw
  modified_base (166)..(166): a, c, t, g, unknown or other
  misc_feature (166)..(166): n is a, c, g, or t
  modified_base (224)..(224): a, c, t, g, unknown or other
  misc_feature (224)..(224): n is a, c, g, or t
  modified_base (227)..(228): a, c, t, g, unknown or other
  misc_feature (227)..(228): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (268)..(269): a, c, t, g, unknown or other
  misc_feature (268)..(269): n is a, c, g, or t
  modified_base (271)..(271): a, c, t, g, unknown or other
  misc_feature (271)..(271): n is a, c, g, or t
  modified_base (277)..(278): a, c, t, g, unknown or other
  misc_feature (277)..(278): n is a, c, g, or t
  modified_base (285)..(286): a, c, t, g, unknown or other
  misc_feature (285)..(286): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (337)..(338): a, c, t, g, unknown or other
  misc_feature (337)..(338): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (355)..(356): a, c, t, g, unknown or other
  misc_feature (355)..(356): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (497)..(497): a, c, t, g, unknown or other
  misc_feature (497)..(497): n is a, c, g, or t
tcagagtcgagagacacgaccggtgctcgattttagcgagacgcgcaaggggacgaacgggaccggtgctacgattttaggcttctacgctccaggggctacgaccggttgctcgtatttagtcacggcgagaaagggaaagggggctggcccgtgacgtgtttcngttcccaccctcctctcctctcgacctcgtgagcgggctggcgaaggcgcgactacgncanncagcagcangtgttanacagcacananatatcnctgccannanacagannctctatnntntntntgnctcgcggcggtccggtccgcgacntngcgngngcgtgngagnntatcnctcncacacncnncncncgtcgcgacgngtagagtgtgtgtagttattattcgtgtcgatatattattatagtcgtactagtacgttacggtcggtacggtacgtacgtacgtagagtacgtaacgaacgtacgtagtgtcgcgacactctctntctctcgtcc

SEQ ID NO: 57004 - DNA, 527 bp, Homo sapiens
  misc_feature: GYAE6OF01CUUZT.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggataggtagtagtgctcgttccgggggtgttcggcggagggaccaagttgaccgtgttggcagcccaggctcgcccctggtcactctcgttcccaccctcctctctctcgtac

SEQ ID NO: 57005 - DNA, 163 bp, Homo sapiens
  misc_feature: GYAE6OF01D3O0F.49.9.A09.1.454.CMB.1.raw
  modified_base (162)..(163): a, c, t, g, unknown or other
  misc_feature (162)..(163): n is a, c, g, or t
tcagagtcgagagacacgaccggtgctcgatttagcgagacgcgcagggcacgaccggtgctcgatttagtcacgcgagaaagggaaaggggctggccctgacgtgtttctgttcccaccctcctctctctcgactctgagcgggctggcaaggcgcatagnn

SEQ ID NO: 57006 - DNA, 531 bp, Homo sapiens
  misc_feature: GYAE6OF01BH651.49.9.A09.1.454.CMB.1.raw
  modified_base (331)..(331): a, c, t, g, unknown or other
  misc_feature (331)..(331): n is a, c, g, or t
  modified_base (444)..(444): a, c, t, g, unknown or other
  misc_feature (444)..(444): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcgagggatccctgagcgattttcnggctccaagtctgggaacacggccaccctgaccgtcagcagggtcgaagccggggatggaggccgactatatctgtcaggtgtgggatagtagtagtgctcgttccgggggtnttcgggcggagggacctaaggttgaccgtgttggcagcccaggcctcgcccctggtcactctcgtccccacctcctctctctcgtac

SEQ ID NO: 57007 - DNA, 163 bp, Homo sapiens
  misc_feature: GYAE6OF01A07ZL.49.9.A09.1.454.CMB.1.raw
  modified_base (160)..(163): a, c, t, g, unknown or other
  misc_feature (160)..(163): n is a, c, g, or t
tcagagtcgagagacacgaccggtgctcgatttagcgagacgcgcagggcacgaccggtgctcgatttagtcacgcgagaaagggaaaggggctggccctgacgtgttctgttcccgcctcctctctctcgactctgagcgggctggcaaggcgcatagnnnn

SEQ ID NO: 57008 - DNA, 533 bp, Homo sapiens
  misc_feature: GYAE6OF01AWKYR.49.9.A09.1.454.CMB.1.raw
  modified_base (504)..(504): a, c, t, g, unknown or other
  misc_feature (504)..(504): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatggaggccgactatatctgtcaggtgtgggatagtagtagtgcgtcgttccgggggtgttcgggcggagggacctaaggttgaccgttcgttggtcagcccaggctcgcccctggtcnctctcgttcccacctcctctcttcgctcg

SEQ ID NO: 57009 - DNA, 207 bp, Homo sapiens
  misc_feature: GYAE6OF01DRWHP.49.9.A09.1.454.CMB.1.raw
  modified_base (205)..(207): a, c, t, g, unknown or other
  misc_feature (205)..(207): n is a, c, g, or t
tcagagtcgagagacacgaccggtgctcgatttagcgagacgcgcagggcacgaccggtgctcgatttagagaggtgttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 57010 - DNA, 163 bp, Homo sapiens; identical to SEQ ID NO: 57005
  misc_feature: GYAE6OF01BDKHA.49.9.A09.1.454.CMB.1.raw
  modified_base (162)..(163): a, c, t, g, unknown or other
  misc_feature (162)..(163): n is a, c, g, or t

SEQ ID NO: 57011 - DNA, 216 bp, Homo sapiens
  misc_feature: GYAE6OF01CV3S3.49.9.A09.1.454.CMB.1.raw
  modified_base (202)..(216): a, c, t, g, unknown or other
  misc_feature (202)..(216): n is a, c, g, or t
tcagagtcgagagacacgaccggtgctcgatttagcgagacgcgcagggcacgaccggtgctcgatttagactcgcgcacagagagaagggcacgaccggtgctcgatttagcacgagagaaagggaaggggctggccctgacgtgtttctgttcccgccctcctctctctcgactctgagcgggctggcaaggcgcatagnnnnnnnnnnnnnnn

SEQ ID NO: 57012 - DNA, 572 bp, Homo sapiens
  misc_feature: GYAE6OF01ACP06.49.9.A09.1.454.CMB.1.raw
  modified_base (333)..(333): a, c, t, g, unknown or other
  misc_feature (333)..(333): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcgagggactccctgagcgtattttcnggctccaagtctagggaacacggccaccctgaccgtcagcgagggtcgaaggccggggatggaggccgactatactctgtcgaggtgtgggatagtagtagtgctcgttccgggggtgttcgggcggacgggacctaaggttcgaccggttcgttggtccgacgcccgaaggcccgtccgtcccccgtcggtcctcttccgttccgttcccctacccttccctctcctccgtcgtaccg

SEQ ID NO: 57013 - DNA, 551 bp, Homo sapiens
  misc_feature: GYAE6OF01AUWA9.49.9.A09.1.454.CMB.1.raw
  modified_base (212)..(212): a, c, t, g, unknown or other
  misc_feature (212)..(212): n is a, c, g, or t
  modified_base (334)..(334): a, c, t, g, unknown or other
  misc_feature (334)..(334): n is a, c, g, or t
  modified_base (396)..(396): a, c, t, g, unknown or other
  misc_feature (396)..(396): n is a, c, g, or t
tcagagtcgagagacacgaccggtgctcgatttagcgagacgcgcaggggctggggcctaaggaagcagcactggtggtgcctcagccatggcctggaccgttctcctcctcggcctcctctctcactgcacagactctgtgacctcctatgtgttgacgcagccaccctcggtgtcccgtggccccaggaccagacggccagggtttcccngtcgagggcaacaacattggtggtaaaggtgtgcactggtaccagcagaagccaggccaggcccctgtgttggtcgtccatgatgacagcgaccggccctcaggatccctgagcgattttcnggctccgaagtctggacacggcacctgaccgtcagcaggtcgaagccgggatgagccgatanatctagtcaggtgtgggatagtagtagtgctcgttaccgggggttttcgggcggtagggaccctaaggttcgaccgttcgttggtcaggcccaagggcctcggcccccgtggtccacgtccgtagttccccacccgttctacctctcctcgtacc

SEQ ID NO: 57014 - DNA, 587 bp, Homo sapiens
  misc_feature: GYAE6OF01DF0Z3.49.9.A09.1.454.CMB.1.raw
tcagagtcgagagacacgaccggtgctcgatttagcgagacgcgcaagggctgggaccgtaaggaagccgagcactggttggtgcctcagccatggcctgggaccgttctcctcctcgcctcctctctcactgcacacgactctgtgaccttcctattcgtcgttgacgcagccaccctcggtgtccgtggccccaggacagaacggccaggttccctgtgaggcaacacattggtcgtaaaggtgtgcactggtaccgagcacgaacgccggccaggcccctggtcgttggtgatgtataaagcactgagaggcctgaggatccctagagcgagtctctggctccaggtcagggacaacggtcacattcggccagtcagtggatcacggcagaggacgaggctgactagttagttggtacaagtctaacagtacctaccatttaggtacttaagtcgttacgtttcggtaactcgacgtaccgtaaggttccaaccgtttccgtgggttcaaggtcccctaagggcccaaaccccgagttacgtactaaccgtttctccggtttacccccacccgttcccttcccg

SEQ ID NO: 57015 - DNA, 161 bp, Homo sapiens
  misc_feature: GYAE6OF01DL4RO.49.9.A09.1.454.CMB.1.raw
  modified_base (134)..(134): a, c, t, g, unknown or other
  misc_feature (134)..(134): n is a, c, g, or t
  modified_base (151)..(151): a, c, t, g, unknown or other
  misc_feature (151)..(151): n is a, c, g, or t
  modified_base (155)..(161): a, c, t, g, unknown or other
  misc_feature (155)..(161): n is a, c, g, or t
tcagagtcgagagacacgaccggtgctcgatttagcgagacgcgcagggcacgaccggtgctcgatttagcacgcgagaaaggaaggggctggccctgacgtgtttctgttcccgcctcctctctctcgactcngagcggctggcaaggcnatgnnnnnnn

SEQ ID NO: 57016 - DNA, 524 bp, Homo sapiens
  misc_feature: GYAE6OF01D7FUP.49.9.A09.1.454.CMB.1.raw
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (496)..(496): a, c, t, g, unknown or other
  misc_feature (496)..(496): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacncggccacctgaccgtcagcaggtcgaagccgggatgaggccgactatatctgtcaggtgtgggatagtagtagtgctcgttccgggggtgttcgggcggaggacctagttcgaccgtcgttggtcagccaggctcgccccctggtcnctctcgttcccacctcctctctctcgac

SEQ ID NO: 57017 - DNA, 556 bp, Homo sapiens
  misc_feature: GYAE6OF01BZDCH.49.9.A09.1.454.CMB.1.raw
  modified_base (516)..(516): a, c, t, g, unknown or other
  misc_feature (516)..(516): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatcccctgagcgtattttctggcctccaagtctgggaacaccggccacccgtgaccgtcagcagggtcgaagccggggatgaggccgactatatctgtctaggtttgggatagtgtagtgctcgttcggggtgttcgggcggagggaccgtaagttcgtaccggtcgttggtcacgcccgaaggccgtcgcccccgtcggtccncgtcctcgttccccacccctccttcctcctctccgctccg

SEQ ID NO: 57018 - DNA, 166 bp, Homo sapiens
  misc_feature: GYAE6OF01CK3MF.49.9.A09.1.454.CMB.1.raw
  modified_base (161)..(166): a, c, t, g, unknown or other
  misc_feature (161)..(166): n is a, c, g, or t
tcagagtcgagagacacgaccggtgctcgatttagcgagacgcgcagggcacgaccggtgctcgatttagtcacgcgagaaagggaaggggctggccctgacgtgtttctgttcccaccctcctctctctcgactctgagcgggctggcaaggcgcatagnnnnnn

SEQ ID NO: 57019 - DNA, 532 bp, Homo sapiens
  misc_feature: GYAE6OF01DVQBV.49.9.A09.1.454.CMB.1.raw
  modified_base (503)..(503): a, c, t, g, unknown or other
  misc_feature (503)..(503): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcaggggatccctgagcgtattttctggctccaagtctgggaacacggccaccctgaccgtcagcagggtcgaaggccggggatggaggccgactatatctgtcaggtgtgggataggtagtagtgctcgttccgggggtgttcgggcggagggacctaagttgaccgtgttggtcagcccaggctcgccccctgcnctctgtccccacctcctctctcgtcgtac

SEQ ID NO: 57020 - DNA, 546 bp, Homo sapiens
  misc_feature: GYAE6OF01DDS00.49.9.A09.1.454.CMB.1.raw
  modified_base (510)..(510): a, c, t, g, unknown or other
  misc_feature (510)..(510): n is a, c, g, or t
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaaacaacattggtggtaaaggtgtgcactggtaccagcagaagccaggccaggcccctgtgttggtcgccatgatgacagcgaccggccctcagggactcccctgacgcgtattttctggctccgaagtcgtagggaacacggcccaccctgaccgtcagcgagggtcgaaggccggggatggacggccgactatatcgtgtcgtaggtgtagggatagtagtagtgctcgttcggggtgttcggcggaggaccaagttcgacgtcgttggcagccaaggctcgcccctggtccnctcgtcgtcccctacccttcctctcctcgtcgtacg

SEQ ID NO: 57021 - DNA, 564 bp, Homo sapiens
  misc_feature: GYAE6OF01DC3DJ.49.9.A09.1.454.CMB.1.raw
  modified_base (334)..(334): a, c, t, g, unknown or other
  misc_feature (334)..(334): n is a, c, g, or t
  modified_base (463)..(463): a, c, t, g, unknown or other
  misc_feature (463)..(463): n is a, c, g, or t
  modified_base (526)..(526): a, c, t, g, unknown or other
  misc_feature (526)..(526): n is a, c, g, or t
  modified_base (552)..(552): a, c, t, g, unknown or other
  misc_feature (552)..(552): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaaacaacattggtggttaaaggtgtgcactggtaccagcagaagccaggccaggcccctgtgttggtcgtccatgatgacagcgaccggccctcagggactccctgagcgtattttcnggctccgaagtcgtgggaacacggccaccctgaccgtcagcgagggtcgaagccggggatggacggccgactatacgtctgtcgaggtgtagggatagtagtagtgcgttcgttccgggggtgttcggngggaggacctaaggttcggaccgttcgttggtcacggcccgaaggctccgcccccgttggccnccttcgtccgttccccaccctccctntcctcctcgtac

SEQ ID NO: 57022 - DNA, 544 bp, Homo sapiens
  misc_feature: GYAE6OF01BBGAR.49.9.A09.1.454.CMB.1.raw
  modified_base (333)..(333): a, c, t, g, unknown or other
  misc_feature (333)..(333): n is a, c, g, or t
  modified_base (456)..(456): a, c, t, g, unknown or other
  misc_feature (456)..(456): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
  modified_base (539)..(539): a, c, t, g, unknown or other
  misc_feature (539)..(539): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggactccctgagcgtattttcgnggcctccaagtctagggaacacggccaccctgaccgtcagcgaggggtcgaaggcccggggatggacggacccgatatatctgtcagggtgtgggattagtgtagtgcttcgttccgggggtnttccggcggagggacctaggttcgaccgtgttggcagcccaggcctcgcccctggcncgtctcgttcccncctcctactctcncgtac

SEQ ID NO: 57023 - DNA, 589 bp, Homo sapiens
  misc_feature: GYAE6OF01CRX02.49.9.A09.1.454.CMB.1.raw
  modified_base (207)..(207): a, c, t, g, unknown or other
  misc_feature (207)..(207): n is a, c, g, or t
  modified_base (336)..(336): a, c, t, g, unknown or other
  misc_feature (336)..(336): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggttcccngtgagggcaacacattggtggtaaaggtgtgcacgtggtaccagcagaagccaggccaggccctgtgttggtcgtccatgatgacagcgaccggccctcgacgggactcccgtgaacgcgtatttttcncggtctccaaagtctagggaacacggccacccgtgaccgtcagcgagggtcgaaggccgggatggacggcgactatatctgtcgaggtgtgggataggtagtagtcgtcgtcggtttccgggggtgtttcggcgggtagggtacctaggttacggaccgttggttggtaccgacggtcccgaagtcgtaccgtcccccgttaggtacctcgtaccgttcgttcccccacccttcctccttctccgtcgtaccg

SEQ ID NO: 57024 - DNA, 524 bp, Homo sapiens
  misc_feature: GYAE6OF01CY2KZ.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggcaccctgaccgtcagcagggtcaagccggggatgaggcgactatatctgtcaggtgtgggatagtagtagtgctcttccgggggtgttcggcggagggaccaaggttgaccgtcgttggtcagcccaaaggctgccccctggtcactctgttcccgccctcctctctctcgac

SEQ ID NO: 57025 - DNA, 160 bp, Homo sapiens; identical to SEQ ID NO: 57000
  misc_feature: GYAE6OF01DWSAG.49.9.A09.1.454.CMB.1.raw
  modified_base (160)..(160): a, c, t, g, unknown or other
  misc_feature (160)..(160): n is a, c, g, or t

SEQ ID NO: 57026 - DNA, 521 bp, Homo sapiens
  misc_feature: GYAE6OF01BCEV2.49.9.A09.1.454.CMB.1.raw
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (511)..(511): a, c, t, g, unknown or other
  misc_feature (511)..(511): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacncggccaccctgaccgtcagcagggtcgaaggccggggatggaggccgactatactctgtcgaggtgtagggatagtagtagtgcttcgtcggggtgtcggcggaggacctaagttcgacgtgttgcngccaggctcgcccctgcnctctgtcccacctcctntctctcgtac

SEQ ID NO: 57027 - DNA, 573 bp, Homo sapiens
  misc_feature: GYAE6OF01BFLJF.49.9.A09.1.454.CMB.1.raw
  modified_base (330)..(330): a, c, t, g, unknown or other
  misc_feature (330)..(330): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacacggccaccctgaccgtcagcagggtcgaaggccggggatggaggccgatatatctgtcaggtgtgggataggtagtagtgcttcgttccggggggtgttcgggcgggagggacctaaggtttcggaccggttcggttggtcacggccccgtaaagggccttcggccccccgttgggtccaccttccgtcgttcccccacccttccctcctcttcctcggtaccc

SEQ ID NO: 57028 - DNA, 539 bp, Homo sapiens
  misc_feature: GYAE6OF01ETFYG.49.9.A09.1.454.CMB.1.raw
  modified_base (332)..(332): a, c, t, g, unknown or other
  misc_feature (332)..(332): n is a, c, g, or t
  modified_base (504)..(504): a, c, t, g, unknown or other
  misc_feature (504)..(504): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggacaggcccctgtgttggtcgtccatgatgacagcgaccggccctcgagggactccctgagcgattttcnggctccaagtctgggaacacggccaccctgaccgtcagcgagggtcgaaggccggggatggacggccgactatatctgtcgaggtgtgggatagtagtagtgctcgttcggggtgtcgggcggagggacctaggttgaccgtgtggtcagcccgaggctcgccccgtggtcnctcgtcgttccccacccttcctctctcgtcgtacc

SEQ ID NO: 57029 - DNA, 577 bp, Homo sapiens
  misc_feature: GYAE6OF01BKLD3.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaggtgtgcactggtaccagcagaagccaggccaggcccctgtgttggtcgtccatgatgacagcgaccggccctcgagggactccctgagcgtattttctggcctccaagtctagggaacacggccaccctgaccgtcagcgagggtcgaaggccggggatggaggccgactatatctgtcaggtgtgggatagtagtagtgctcgttcggggtgttcgggcgggagggacctaaggttcgaccggttcgttggtcgacggcccgaagggcctccggccccccgttggtcctaccgttccgtcgtttcccccacccgttccctaccttcctccgtccgtaccg

SEQ ID NO: 57030 - DNA, 560 bp, Homo sapiens
  misc_feature: GYAE6OF01DSVGF.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggccccctgtgttggtcgtccatgatgacagcgaccggccctcagggatccctgagcgattttctggctccaagtctgggaacacggccacccgtgacccgtcagcgagggtcgaacggccggggatggaggccgactatatctgtcaggtgtgggataggtagtagtgcgttcgttccgggggtgttcgggcgggacgggacctaaggttcggaccggttcgttggtcacgcccgaaggcctacggccccctggtcctactccgtcttccccaccctccctctctctcgtacc

SEQ ID NO: 57031 - DNA, 112 bp, Homo sapiens
  misc_feature: GYAE6OF01C2NFQ.49.9.A09.1.454.CMB.1.raw
  modified_base (109)..(112): a, c, t, g, unknown or other
  misc_feature (109)..(112): n is a, c, g, or t
tcagagtcgagagacacgaccggtgctcgatttagcgagacgcgcagggcacgaccggtgctcgatttagtcacggagaaagggagagcgggctggcaaggcgcatagnnnn

SEQ ID NO: 57032 - DNA, 518 bp, Homo sapiens
  misc_feature: GYAE6OF01AFC4N.49.9.A09.1.454.CMB.1.raw
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcgagggactccctgagcgtattttctggctccaagtcgtagggaacacggccacctgaccgtcagcagggtcgaacggccggggatggacggccgactatatcgtgtacgaggtgtgggtataggtagtagtgcgtcgttcggggtgtcggcggaggactagtgcgtgtgcngcagcncgccctgcnctctctcccncctcnctctctcgc

SEQ ID NO: 57033 - DNA, 161 bp, Homo sapiens
  misc_feature: GYAE6OF01ELZG5.49.9.A09.1.454.CMB.1.raw
  modified_base (161)..(161): a, c, t, g, unknown or other
  misc_feature (161)..(161): n is a, c, g, or t
tcagagtcgagagacacgaccggtgctcgatttagcgagacgcgcagggcacgaccggtgctcgatttattcacgcgagaaagggaaaggggctggccctgacgtgttctgttcccgccctcctctctctcgactctgagcgggctggcaaggcgcatagn

SEQ ID NO: 57034 - DNA, 637 bp, Homo sapiens
  misc_feature: GYAE6OF01BF99T.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccacggcccctgtgttggtcgtccatgatgacagcgaccggccctcgacgggactccctgacgcgtattttcgtggtcctccgtaagtcgtagggaaaccaccggcccaccccgtcgacccgtcgacgcgagggtacgaaacgggccgggggatcgggacggtacccgacttaacgtatcgtgtacgtagggtggtagggagttaggtagtagtgtcgttcggttcgggggtgttcgggacgggtagggaccgtaaggttcgaccggttcggttggccgacggcccgaaggtcccgtccggcccccgttcgggtcctaccgttccgttccggttccccccgtccccttccctcctttccctcgtcccgtacccg

SEQ ID NO: 57035 - DNA, 729 bp, Homo sapiens
  misc_feature: GYAE6OF01AZ4AT.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactcgtgtgacctcctatgtgttgacgcagccaccctcggtgtccgtcggccccaggacagacggccaggttccctgtgaggcaacacattggtaggtaaaggtgtgcacgtggtaccagcagaagccaggccacggcccctgtgttggtcgtccatgatgacagccgaccggccctcgagggactcccgtgacgtcgtattttcgtcggcctaccgaacgtcgtacgggaaccgaccggccctacccgtcgacccgtcgacggaccgaaggggtaccgaaacggcccgggggatcgggacggtacccgtaacgttaacgtacgttcgttcggtacgtaggggttacggtggggtaagttagggttagggttaacgttcggtccgtttccgggtttccggggggttcggtttaccggggacggggtacggggtaaccgttaagggttccggttaccgggttcgggttacgggtccacgggtaccccgtaacgggtcccgttcccggtaccccccgttcggggtacccttaccgtttcccgttcccgggttcccccgtccccgtttcccgtcccttcccggttccgtccggtacccg

SEQ ID NO: 57036 - DNA, 539 bp, Homo sapiens
  misc_feature: GYAE6OF01AI7JU.49.9.A09.1.454.CMB.1.raw
  modified_base (331)..(331): a, c, t, g, unknown or other
  misc_feature (331)..(331): n is a, c, g, or t
  modified_base (489)..(489): a, c, t, g, unknown or other
  misc_feature (489)..(489): n is a, c, g, or t
  modified_base (510)..(510): a, c, t, g, unknown or other
  misc_feature (510)..(510): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacacattggtggtaaaggtgtgcactggtaccagcagaagccaggccaggcccctgtgttggtcgtccatgatgacagcgaccggccctcagggactccctgagcgtattttcnggctccaagtctgggaacacggccacccgtgaccgtcagcagggtcgaaggccgggatggacggccgactatactctgtcaggtgtgggataggtagtagtgctcgttccgggggttgttcgggcgggaggaccgtaaggttcgaccgttgtcggtcngcccaggctcgccccgtggcnctcgtcgtcccgcctcctctctctcgtcc

SEQ ID NO: 57037 - DNA, 873 bp, Homo sapiens
  misc_feature: GYAE6OF01CGFKK.49.9.A09.1.454.CMB.1.raw
tcagagtcgagagacacgaccggtgctcgatttagcgagacgcgcgaggggctgggcctaaaggaagcagcacgtggtggtgcctcagccatggcctggaccgttctcctcctcggcctcctctctcactgcacagactctgtcgacctcctatgtgttgacgcacgcccacccgtcggtcgtccgtcggccccaggacgacggaccggccgtacggtttccctggtaggaacgggaccaaaacaacgtaagtttcgggtaagggtaaaaggtggtcggtacctaaccggttacgggtaaccaaggaccaaaggaacgacccgaacgggcccgtaacgggtcccccttaggttcggtttacgggtaccggttacccaagttcggaactacggaaccgacggacccggaacccggtccccttacggaacgggtaaccttccccggtaggtaacggtcccgtttaagtttttccgacgggtaccctaaccgtaaggtccgtaaacggggaaccaacccggccctaaacccgttgaacccgtcgacggaccggtaacggggtaccgaaaacgggcccggggtaatacgggaacggtaccgtaacttaacgtacgttcggttacggtacgtaaggggttggttacgggtaagtttaacgggtaaggtttacggtcggtaccgtttcggggtttaccgggggttcggttaccgggacgggtaccggtaaccggttaggttaccggacggtttcgggtacggaccggtaaccgacccgtaagggtcccgtaacccggtcccccggttaggtccctaccggtttacccgtccccgttcccccgtccccttacccttccgttcccttccgtcccgttaccg

SEQ ID NO: 57038 - DNA, 537 bp, Homo sapiens
  misc_feature: GYAE6OF01DXKN9.49.9.A09.1.454.CMB.1.raw
  modified_base (331)..(331): a, c, t, g, unknown or other
  misc_feature (331)..(331): n is a, c, g, or t
  modified_base (507)..(507): a, c, t, g, unknown or other
  misc_feature (507)..(507): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgtattttcnggctccaagtctagggaacacggccaccctgaccgtcagcagggtcgaagccggggatgaggccgactatatctgtcgaggtgtgggatagtagtagtgcttcgttcgggggtgttcgggcggagggacctaaggttcgaccgttgtggtcaggcccaaggctcgcccccttggcnctctcgttccccaccctctctctctcgtac

SEQ ID NO: 57039 - DNA, 649 bp, Homo sapiens
  misc_feature: GYAE6OF01CC4B5.49.9.A09.1.454.CMB.1.raw
tcagagtcgagagacacgaccggtgctcgatttagcgagacgcgcagggggggcctaaggaagcagcactggtggtgcctcagccatggcctggaccgttctcctcctcggcctcctctctcactgcacagactctgtgacctcctatgtgctgactcagcccaccctcggtgtcagtcggcccctggacagacggccaggattaccgtggtagggggaaaacacagttaggaaagtaagactgtgcacgtggaccagcagaagccaggccaggcccctgtgctggtcgtctagtggtgagtcggccgaccggccctcgagggactcccgtgacgcgtattctcgtcggcctacaactcgtacgggaacccgccacccgtgaccatcgacggccgggtacgaaagggacggggatacggacggtaccgaacttagttacgtgtacgtagggtgtagggtataggtgggttagtggtcgtcgttcgtcgggacgtcgtcgggaccgtacggggtcctacccggtcgtacggtccaaccggtaccccgaacggaccccaaccccgtacgtccggtacctacccttcccgttacccgtttcccccctaaccccgttcccttacccttcccttcccgttccgtccgttaccgg

SEQ ID NO: 57040 - DNA, 753 bp, Homo sapiens
  misc_feature: GYAE6OF01EHPF0.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctccgtcggccctcctctctcactgcacagactctgtgacctcctatgtgttgacgcacgcccacccgtcggtcgtccggtcggccccaggacaggaccggccgtacggtttccctgtggaggacaaacaactagttggtaggtaaaggtgtgcacgttggtaccagacgaagaacgccgacggaccgacggtcccccgtggttggttcgggtccgtaccagtgtaagtgacgaggacccggacccggtccctacggaagggcctccccgtggacgtcgtactttttcgcggtcctaccgaagttcgtacgggaaccaccggacccacccgtcgacccgtcacggcgtagggtaccggaacgggccggggagtcggaacgggccgtaacgttattacgttcgtaggtacgtagggttcggtagggtaacgttaagggtagttacggtcgtccgtttccggggtttccgggggtttaggttcggggacgggtaacggggtaacccgtaagggtttccggtaccggttcggttacgggtacgaccggacccgtaaagggtcccgtcccgtcccccgttgggttaccctcccgttccgttcccggttacccccctccccttcccgttacccttccgttccgtccgtacccg

SEQ ID NO: 57041 - DNA, 545 bp, Homo sapiens
  misc_feature: GYAE6OF01D8Q2U.49.9.A09.1.454.CMB.1.raw
  modified_base (208)..(208): a, c, t, g, unknown or other
  misc_feature (208)..(208): n is a, c, g, or t
  modified_base (332)..(332): a, c, t, g, unknown or other
  misc_feature (332)..(332): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttcccngtgagggcaacaacattggtggtaaaggtgtgcactggtaccagcagaagccaggccaggcccctgtgttggtcgtccatgatgacagcgaccggccctcgagggatccctgagcgtattttcnggctccaagtctgggaacacggccacccgtgaccgtcagcagggtcgaagccgggatgaggccgactatatctgtcaggtgtgggatagtagtagtgctcgttccgggggtgttcgggcgggagggacctaagttgaccgttcgtggtcaggacccgaaggcctcgcccccgtggtcacctcgtcgttcccctaccctcctctctctcgtacc

SEQ ID NO: 57042 - DNA, 737 bp, Homo sapiens
  misc_feature: GYAE6OF01EGKIO.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcctacggtttccctgtgaggacaaacaactagttggtaggtaaaggtgtgcacgtggtaccagcaagaacgccgacggccacggcccctggtgttggtccgtccatgatgacaggccggacccggccctacgacgggtactcccgtgacgtcgttacttttcgcggtcctaccgtaagtccgtagggaaaccgaccggacccaccccgtcggacccgtcgacggcgaacggggtaccggaacgggcgggggtatagggacgggacccgtaacgtataacgttcgtaggtacgtagggtggtagggtaacttaggtaggttagtcggtccgttccgggtttccgggggtggttccggggacggggtaacgggtacccgttaagggttccggtacccggttcgggtttcggtaccgaaccggaccccgtaaacgggtcccgttccccgggtccccccgttcgggttacccacccgtttcccgttacccgggttcccccccgtccccgtttccccttaccgttcccttcccgtcccgttacccg

SEQ ID NO: 57043 - DNA, 583 bp, Homo sapiens
  misc_feature: GYAE6OF01D5NNY.49.9.A09.1.454.CMB.1.raw
  modified_base (208)..(208): a, c, t, g, unknown or other
  misc_feature (208)..(208): n is a, c, g, or t
  modified_base (335)..(335): a, c, t, g, unknown or other
  misc_feature (335)..(335): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttcccngtgagggcaacaacattggtaggtaaaggtgtgcactggtaccagcagaagccaggccaggcccctgtgttggtcgtccatgatgacagcgaccggccctcgagggactccctgagcgtattttcgnggctccgaagtctcgggaacacggcccacccgtgaccgtcacgcgagggtcgaaggccggggatggacggccgactatatctgtcgaggtgtgggatagtagtagtgcttcggttccggggtgttcgggacggaggaccgtaaggttcgaccggttcgtggtacacggcccgaaggccgtaccggcccccttgggtaccaccgtccgttccgttcccccgacccttcccttactcctcctccggtacc

SEQ ID NO: 57044 - DNA, 549 bp, Homo sapiens
  misc_feature: GYAE6OF01AYETE.49.9.A09.1.454.CMB.1.raw
  modified_base (331)..(331): a, c, t, g, unknown or other
  misc_feature (331)..(331): n is a, c, g, or t
  modified_base (418)..(418): a, c, t, g, unknown or other
  misc_feature (418)..(418): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgtattttcnggctccaagtctgggaacacggccaccctgaccgtcagcagggtcgaaggccgggatcggaggccgaatagtatcgtgtcgaggtgngggatagtagtagtgcgtcgttccggggtgtcggcgggaggaccgtagttcgaccggtcggttggcaggcccaaggccgtcgcccccgtggtccactctccgttccccaccctcctcctcctcctcgtacc

SEQ ID NO: 57045 - DNA, 688 bp, Homo sapiens
  misc_feature: GYAE6OF01C8WI4.49.9.A09.1.454.CMB.1.raw
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattgggtgtaaaggtgtgcactggtaccagcagaagccaggccaaggcccctggtgttggtcgtccatgatgacagccgaccggccctcgagggatcccgtagacgcgtacttttcgnggctccaagtcgtggggaaacnccggccaccctcgaccgtcacgcgagggtcgaaggccggggatcggaggcccgtaactataagtctggtcaagggttcgtaggggattagggtaacgtaggttcgtcgtttaccggtttccgggggggtgtttccggggacgggtaacggggaccgttaacgggttcggtaacccggtttcggtttagggtccgtaaccgggtccccgtaaacgggtcccgtccgggtacccccccgttcggggttacccttaaccggttcccgtttcccggttccccccggtccccttacccgttcccgttacccttccgttccggttaaccccg

SEQ ID NO: 57046 - DNA, 637 bp, Homo sapiens
  misc_feature: GYAE6OF01AYDAR.49.9.A09.1.454.CMB.1.raw
  modified_base (337)..(337): a, c, t, g, unknown or other
  misc_feature (337)..(337): n is a, c, g, or t
  modified_base (442)..(442): a, c, t, g, unknown or other
  misc_feature (442)..(442): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaggtgtgcactggtaccagcagaagccaggccaggcccctgtgttggtcgtccatgatgacagccgaccggccctcgagggactcccgtgagcgtattttcgnggctccgaagtcgtgggaacacggccacccgtgaccgtcacgcgacggggtcgaacggccgggggtatcggacggcccgaatacgtatcgtggtcgagggttcgngggtataggtagtagtgtcttcgggttccgggggtgttccgggcgggtagggacctaaggtttcggaaccggttcgggttacggtccgacggtcccgtaaacgggtcccttacccggccccccgttagggtccctaccgttccgttcccgttaccccctaccccttcccgtcctttccttcccgtccgttacccg

SEQ ID NO: 57047 - DNA, 582 bp, Homo sapiens
  misc_feature: GYAE6OF01C6XTM.49.9.A09.1.454.CMB.1.raw
  modified_base (368)..(368): a, c, t, g, unknown or other
  misc_feature (368)..(368): n is a, c, g, or t
  modified_base (578)..(578): a, c, t, g, unknown or other
  misc_feature (578)..(578): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccaccctcggtgtccgtggccccaggacaggacggcctaggtttccctgtggagggcaaacaactagttggtaggtaaaggtgtgcacgtggtaaccagcaagaacgccgaggccacggccctgtgttggcgtccatgatgacaggccgaccggccctcgaggactccgtgacgcgtatttcgcgctaccaagtcgtaggaaccncggacccaccgtcgaccgtacgacgcgaggtacggaaggccgggatcggacggaccgaacgtatacgtcgtgtcgagggtgagggtataggtagtgtgcgttcggtccggggtgtcggacggacggacctaggttcgacgttcgtggacacgccgacggtcctccggtccccgtggcctcgttccgtccgttccccgcctctcttcctcncgtc

SEQ ID NO: 57048 - DNA, 646 bp, Homo sapiens
  misc_feature: GYAE6OF01DQINL.49.9.A09.1.454.CMB.1.raw
  modified_base (307)..(307): a, c, t, g, unknown or other
  misc_feature (307)..(307): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaaacaacagttggtaggtaaaggtgtgcactggtacagcagaagccaggccaggccctgtgtgtcgtccatgatgacagcgaccggccctnagggactcccgtgagcgtattttcgtggctccgaagtcgtcgggaacacggccaccccgtgaccgtcacgcgtagggtacgaaggccggggatcggacgggaccgactagtactacgttgtacgagggttggtaggggtattaacggttaaggtagtcggtacgttcggtttcgggggttcggtttcggggacgggtacgggaccgtaaggttcggtaaccggttcggttcgggtaccgacggtcccgaaacggtccgtccggccccccgttggtaccctacccttccgttcccgttcccctaccccgttcccttacccttccttccgtcccgtacccg

SEQ ID NO: 57049 - DNA, 552 bp, Homo sapiens
  misc_feature: GYAE6OF01CGS7I.49.9.A09.1.454.CMB.1.raw
  modified_base (517)..(517): a, c, t, g, unknown or other
  misc_feature (517)..(517): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtggtgggggaaacacattggaaagtaagactgtgcactggtaccagcagaagccaggccaggccctgtgctggtcgtctagtggtgatggccgaccggccctcgagggactcccgtgacgcgattctcgtggctccaactcgtacgggaacccgccaccctgaccatcacggccgggtacgaaggacggggatggacggccgactattacgtgtcgaggttgtgggataggtggtaggtggtgtcgtcgttcggagtcgtgggaccgtagggtccaccggtctaggtcacgcccgaacggcccaacccngtcgtcactctcgttcccacccttctctctctccg

SEQ ID NO: 57050 - DNA, 510 bp, Homo sapiens
  misc_feature: GYAE6OF01DE9MS.49.9.A09.1.454.CMB.1.raw
  modified_base (499)..(499): a, c, t, g, unknown or other
  misc_feature (499)..(499): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtctccatgatgacagccgaccggccctcgagggatccctgagcgattctctggctccagcctcgagggacaacagtcaccttgaccatcagtggagtccgcagaggcgaggctgactatactgtcagtccgcagacagcagtggctagttatgtctagttcggcggaggactcgctgaccgtcctaggtcacggcccgaaggccctcgccccctggtcncgttcctcccg

SEQ ID NO: 57051 - DNA, 615 bp, Homo sapiens
  misc_feature: GYAE6OF01EQ2DD.49.9.A09.1.454.CMB.1.raw
  modified_base (338)..(338): a, c, t, g, unknown or other
  misc_feature (338)..(338): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaggtgtgcacgtggtaccagcagaagccaggccaggcccctgtgttggtcgtccatgatgacagccgaccggccctcgagggactccctgacgcgtattttcgnggctccaagtcgtagggaacacggccacctgaccgtcagcgaggtcgaaaggccggggatcggaggccgatatatctgtcgaggtgtgggatagtagtagtcgcgttcggttccgggggtgttcgggcgggtacgggaccgtaaggttcggaccggttcggttacgggtccgacggtacccgtaaagggtccttcccggccccccgttgggtaccctaccgttccgttacccgttaccccctacccttcccttcccgttccttccgtcccgtacccg

SEQ ID NO: 57052 - DNA, 719 bp, Homo sapiens
  misc_feature: GYAE6OF01DYC04.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgaggcaacaacattggtaggtaaaggtgtgcactggtaccagcagaacgccaggccacggcccctgtgttggtcgtccatgatgacaggccgacccggccctcgagggtactcccgtgacgtcgttacttttcgtcggtcctaccgtaaggtccgtacggggaaacctaccgggcccaaccccgtcggacccgtacgacggccggtaacggggtaccggaacgggcccgggggaagtcgggaacgggacccgtaacttatacgttcgtggtcgtagggttggtaggggtagttaggttgggttaggttgggttgttcggttcgttcgggacgtccggtacggggaccgtacggggtacctacccggttccgtacgggtccgaccggacccgaaaccgggaccccctaaaccccgtcgttacccgtaccctaaccgtttccccgttacccggtttacccccccttacccccgttcccctttcccgttcccttcccgttcccgttacccgg

SEQ ID NO: 57053 - DNA, 578 bp, Homo sapiens
  misc_feature: GYAE6OF01D6SY4.49.9.A09.1.454.CMB.1.raw
  modified_base (208)..(208): a, c, t, g, unknown or other
  misc_feature (208)..(208): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttcccngtgagggcaacaacattggtaggtaaaggtgtgcactggtaccagcagaagccaggccaggcccctgtgttggtgatgtataaagacactgagaggccctcgagggactccctgacgcgattctctggctccgaggtcgagggacaacggtcacattcggccatcagtggagtccgaggcaggaggacgaggctgaactattattgtacaatcaacagactacctagttcggtaacttatcgttcgttacggaacttcggaccgaccgtaaggtccacccggttccgtgggtccgacggaccccgaaacgggtccccaaacccccgacgttacgtacccacttccgttcccgttccccgccccttccccg

SEQ ID NO: 57054 - DNA, 591 bp, Homo sapiens
  misc_feature: GYAE6OF01DDNL8.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccactctcggtgtccgtggccccaggacagacggccaggtttccctgtgagggcaacaacattggtaggtaaaggtgtgcactggtaccagcagaagccaggccaggcccctgtgtggtcatccatgatgacagcgaccggcctcacgggactcccgtgacgcgtattttctggtctaccgaagtcgtgggaacacggcccaccctgaccgtcagcgagggtcgaaggccgggatggacggccgaactatctctgtcagggtgtgggataggtagtagtgcgttcggttccgggggtgttcgggcgggtacgggaccaaggttcggaccggttcggttcggtcgacgtcccgaacgggcctacggcccccttcggtacctaccgttccgtaccggttcccccgcccctttccctccttcccgttacccg

SEQ ID NO: 57055 - DNA, 556 bp, Homo sapiens
  misc_feature: GYAE6OF01C6JZK.49.9.A09.1.454.CMB.1.raw
  modified_base (364)..(364): a, c, t, g, unknown or other
  misc_feature (364)..(364): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggcccccaggacagacggccaggtttccctgtgagggcaacaacattggtggtaaaggtgtgcactggtaccagcagaagccaggccaggcccctgtgttggtcgtcatgatgacagccgaccgccctcaggatcctgagcgtatttctggctccagtcgtgggaacacggccaccctcgcgtcngcagggtcgaaggcgggatgaggccgaactatagtctcgtcgacggtggtgggatagtagtagtgtctcgttcggggtgtcggcgggaggacgtagtcgacgtcgtggtcacgcccgaaggtccgtccggtcccccgtggtcctacgttcccgttcgttcccccacccttccctcttccctcgtcgtacccg

SEQ ID NO: 57056 - DNA, 755 bp, Homo sapiens
  misc_feature: GYAE6OF01CUTLV.49.9.A09.1.454.CMB.1.raw
  modified_base (174)..(174): a, c, t, g, unknown or other
  misc_feature (174)..(174): n is a, c, g, or t
  modified_base (210)..(210): a, c, t, g, unknown or other
  misc_feature (210)..(210): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
  modified_base (445)..(445): a, c, t, g, unknown or other
  misc_feature (445)..(445): n is a, c, g, or t
tcagagtcgagagacacgaccggtgctcgatttagcgagacgcgcagggggctgggcctaaggaagccagcaactggtggtgcctcagccatggccctggaccgttctcctcctcgcctcctctctcactgcacagactctgtgacctccatgtgtgacgcagcccacctcggngtccgtggccccaggacagacggctacggtttcccngtggaggcaaacaacgagttagggtggtaaaaggtgtacggcaaccgttgggtaaccaggacaaggaacggccaaggccaaggcccctagtgttggtacctccaatggaatgacacgccggaccgcctacgagggacttccgngagcgtaatttcncggactccgaaagtcgagggaacaacggaccacccgtgacccgtanacgacgaaggggtaccgaaaggcccgggttaancggacggacccgtaacgtaactacgtacgttcggacgtaagggtgtacggggtaattaagggttaacggttaagttacggtacctttcggggtttccccgggggggttggtttacccgggggaccgggttaacggggggaaacccttaaacgggttacggtacccggttacccggggtttggtaccgaaccggttacccgaaacgggtcctaccgggtaccccccgtagggtaaccgttaccgtaccgggttcccgttaccccccggtccccgttcccgtacccttttcccgcgttccccggtaacccgg

SEQ ID NO: 57057 - DNA, 553 bp, Homo sapiens
  misc_feature: GYAE6OF01BDX1H.49.9.A09.1.454.CMB.1.raw
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (431)..(431): a, c, t, g, unknown or other
  misc_feature (431)..(431): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacncggccaccctgaccgtcagcagggtcgaaggccgggggatcggaggcccgactatatctgtcaggtgtgggatagtagtagngcttcgttcggggtgttcgggcgggagggacctaaggttcgaccgttcggttggtcgacggcccaagggcctcgccccctggtccacgttctcgttccccaccttcctctcctctcgtaccg

SEQ ID NO: 57058 - DNA, 555 bp, Homo sapiens
  misc_feature: GYAE6OF01A8LK6.49.9.A09.1.454.CMB.1.raw
  modified_base (294)..(294): a, c, t, g, unknown or other
  misc_feature (294)..(294): n is a, c, g, or t
  modified_base (332)..(332): a, c, t, g, unknown or other
  misc_feature (332)..(332): n is a, c, g, or t
  modified_base (462)..(462): a, c, t, g, unknown or other
  misc_feature (462)..(462): n is a, c, g, or t
  modified_base (493)..(493): a, c, t, g, unknown or other
  misc_feature (493)..(493): n is a, c, g, or t
  modified_base (549)..(549): a, c, t, g, unknown or other
  misc_feature (549)..(549): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagagccaggccaggcccctgtgttggtcgtccatgatgacngcgaccggccctcagggactcccgtgagcgtattttcnggctccaacgtcgtacgggaacaccggccaccctcgaccgtcaggcaggggtcgaacggccggggatggaggccgactatatctgtcgaggtgtgggataggtagtagtgcgttcggtcggggtgtcggnggacggactaaggttcgacgttcggtgtacncgacccgagtcctccgccccttcggctcgtcgtcttcccctacctcctctcctccncgtacc

SEQ ID NO: 57059 - DNA, 574 bp, Homo sapiens
  misc_feature: GYAE6OF01BHOUI.49.9.A09.1.454.CMB.1.raw
  modified_base (359)..(359): a, c, t, g, unknown or other
  misc_feature (359)..(359): n is a, c, g, or t
  modified_base (536)..(536): a, c, t, g, unknown or other
  misc_feature (536)..(536): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggactcccctgacgcggtattttcgtggcctccgaagtcgtgggaaacncggccaccctgaccgtcagcagggtcgaaggccggggatggaggccgactagtactctgtcaggtgtgggataggtagtagtgcgttcgttccgggggtgttcgggcggagggaccgtaaggttcgaccgttcggttggtcgacggcccgaagggcctccggtcccccgtgggtccncttccgtccgttccccacccttcctctcctctcgtacc

SEQ ID NO: 57060 - DNA, 685 bp, Homo sapiens
  misc_feature: GYAE6OF01C9AT1.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcctaggttccctgtgagggcaacaacagttggtaggtaaaggtgtgcactggtaccagcagagccaggccacggcccctggtgttggtcgtccatgatgacagccggaccggccctcgacgggactccctgacgcgtattttcgtggcctaccgaagtcgtacgggaaacaccggccacccgtacgacccgtcgacggacgtaggggtacgaacgggccggggatcgggacggtcccgtaactattacgtcgtacgtacgtagggttggtaggggattaggttagtaggtcgtccgttccgggtttccgggggttggttccggggacgggtaacgggtaccgtaaggtttccgggaccggttggttcgggtaccgacggacccggaacggtccgttccccgggtcccccgttcgggacccttcccgttcccgtttacccgttacccccctaccccttcccgttacccttcccgttccgtcgttacccgg

SEQ ID NO: 57061 - DNA, 919 bp, Homo sapiens
  misc_feature: GYAE6OF01CRDFL.49.9.A09.1.454.CMB.1.raw
tcagagtcgagagacacgaccggtgctcgatttagcgagacgcgctagggggtctcgggcctaaggaagcgagcactggtcggtgcctcgacgccactgggcctggaaccgttctcctccgtcggcccgtccctctctcgactgcctacgagacctctcgtcgacctcctatgtgttcgacgcgtacgcccaccctcggtgtccggtcggtccccgtagggtaccgagggaccggtccggtacgggtttccctggtcggacgggacgaaacgactagttggtaggtaaaggtggtagctacgtcgtaccagcgaggaacgccacggtccacggtcccctgtcgttcggtcgtccagtgatcgacacgccgaccggccgtccacggggactcccgtcgaacggtccttaacgttttccgtagggaccttaccgaaggttcgtacggggtaacctaccgggccccgacccgtacggaccgtacgaccgggtacgtaacggggttacgtaacgggccggggacgtcggaacgggtaccgtaacgttagtaacgttcgttacggttacgtaggggtttcgggttagggttaacgttaaccggttaacgggttaacggttacgggtccggtttacccgggggttttacccgggggggttacgggtttaccgggggaccggggggtaaccgggggtaaacccgggtttaagggtttaccgggtaccccggggttttaccgggtttacccgggtacccggtaacccgtacccgggtaaacccgggttaccccggtacccccggggttccccccgttccccggggttaacccgttccccggttttaccccgtttcccccggttacccccgtaacccccgttacccccgtttccccttacccgttccggttaccccggttaccccggg

SEQ ID NO: 57062 - DNA, 531 bp, Homo sapiens
  misc_feature: GYAE6OF01DQ9YG.49.9.A09.1.454.CMB.1.raw
  modified_base (332)..(332): a, c, t, g, unknown or other
  misc_feature (332)..(332): n is a, c, g, or t
  modified_base (463)..(463): a, c, t, g, unknown or other
  misc_feature (463)..(463): n is a, c, g, or t
  modified_base (505)..(505): a, c, t, g, unknown or other
  misc_feature (505)..(505): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtcatgatgacagcgaccggccctcgagggactccctgagcgtattttcnggctccaagtcgtaggggaacacggcccacccgtgacccgtcacgcgaaggggtcgaaggccggggatgaacggccgaactatatctgtcaggtgtgggatagtagtgtgcgtcgttccggggtgttcggnggaggactagtcgacgtgtcgcacgcaggctcgccctggtcnctctcgtcccgcctctctctctcgtc

SEQ ID NO: 57063 - DNA, 809 bp, Homo sapiens
  misc_feature: GYAE6OF01CYV6R.49.9.A09.1.454.CMB.1.raw
  modified_base (793)..(793): a, c, t, g, unknown or other
  misc_feature (793)..(793): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcacgcccacccgtcggtgtcccgtcggccccgaggacacggaccggccgtacggtttccctgtggacgggacaaacaacgtagttagggtaggtaaaggtgtcgactacgtacggtaccagaccgaaaggaacgcccgagggcccgaccgggtcccccgttggtcggtttcgggtaccgtaccctagttagaacgttacggaaccgtacggcccgggaacccggtccccttaccggaacggggtaccttccccggtaggtaacggtccgtttaagtttttccggcgggtacccttacccgggacggttaccggaaacgggggtaaccaaccggggtactaaccgtaggttcgggaccctagtacgtaggtgggaaccgtaccgagggtacgaaggaccggggtaacgagggtcttacgtaacgtttaagtttagttcggtaactaaacgtaccaaacgacgtaactaacccgtttagtttacggtttaactttacggtacgttttaccgttaacgggtacctcgggaacctaaaccgggtacgtacctaccgggttccgtacgggtaccaccgaccccgtaacggaccccaaccccgtacgttacgaccgtacccgttcgtacccggttccccncccgttcccgtacccg

SEQ ID NO: 57064 - DNA, 555 bp, Homo sapiens
  misc_feature: GYAE6OF01C2J9T.49.9.A09.1.454.CMB.1.raw
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (522)..(522): a, c, t, g, unknown or other
  misc_feature (522)..(522): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgaggcaaacaacagttggtaggtaaaaggtgtgcacgtggtaccagcagaagccaggccaggcccctgtgttggtcgtccatgatgacagccgaccggccctcgagggactcccngagcgtattttcgnggctccgaagtcgtacgggaacaccggcccacccgtgacccgtcgacgcgagggtacgaaacggccggggatggacggccgactatatcgtgtcgaggtgtgggatagtagtagtgcttcggtcggggtgtcggcggaggactagtcgacgttgtgcgcgaccaggcctcgtccccgtgtccncgttctcgttccccgtcctcctctcctgtcgtc

SEQ ID NO: 57065 - DNA, 653 bp, Homo sapiens
  misc_feature: GYAE6OF01DDY17.49.9.A09.1.454.CMB.1.raw
  modified_base (375)..(375): a, c, t, g, unknown or other
  misc_feature (375)..(375): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggccccaggacacgacggcctaggtttccctgtgagggcaaacaacagttggtaggtaaaggtgtgcactggtacagcagaagccaggccgaggcccctgtgttcggtctccatgatgacagcgaccggccctcgagggactcccgtgacgtcgtacttttcgtcggtcctaccgaagttcgtacggggaaaccnccgggtacccacccgtcggaccgtcgacgcggagggtacgaacgggccggggatacggacggcccgtacgtaatcgttcgtggtacgtagggttggtagggtattaggtagtagtcgtcgttcggttccgggggtgttccggacgggtacggtacgtaaggttccgaccggttcggttcggtcgacgtacccgaacggtccctcccggtcccccgtgggtccctaccgttccgttcccgttccccctacccgttccctccttccgtcctccggtaccc

SEQ ID NO: 57066 - DNA, 584 bp, Homo sapiens
  misc_feature: GYAE6OF01ELJ9N.49.9.A09.1.454.CMB.1.raw
  modified_base (338)..(338): a, c, t, g, unknown or other
  misc_feature (338)..(338): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctggtgtccgtggccccagggacagacggccaggtttccctgtgagggcaaacaacattggtaggtaaaggtgtgcactggtaccagcagaagccaggccaggcccctgtgttggtcgtccatgatgacagccgaccggccctcgagggactcccgtgagcgtattttcgnggcctccaagtcgtagggaacaccggccaccctcgaccgtcagcgacgggtcgaaggccggggatcggacggcccgagtatacgtctgtcgtaggtgtgggatagtagtagtgcgttcggttcggggtgtcggcggaggtaccgagtttcggcgttcgtggacacggccgaacggcctaccggcccccttcgggtcctccgtccttccgttacccccacccttcctcctccgttccgtccgtaccg

SEQ ID NO: 57067 - DNA, 626 bp, Homo sapiens
  misc_feature: GYAE6OF01EHB0N.49.9.A09.1.454.CMB.1.raw
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
  modified_base (410)..(410): a, c, t, g, unknown or other
  misc_feature (410)..(410): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgaggcaacaacattggtggtaaaggtgtgcactggtaccagcagaagccaggccaggcccctgtgttggtcgtccatgatgacagccgaccggccctcagggactcccgtgagcgtattttcgnggcctccaagtctaggggaacncggccaccctgaccgtcacgcagggtacgaacggccgggatggacggccgactntatctgtcgaggtgtgggattagtagtagtgcgtcggttcggggtgttcgggcgggacgggaccgtaaggttcgacccggttcgggttacggtccgtacggaccccgaagggtcccgttccggtcccccccgttcgggttccctaacccgttcccgttcccgggtttccccccgtcccccttcccctttcccttacccttccgttcccggtacccg

SEQ ID NO: 57068 - DNA, 717 bp, Homo sapiens
  misc_feature: GYAE6OF01CM1U4.49.9.A09.1.454.CMB.1.raw
  modified_base (210)..(210): a, c, t, g, unknown or other
  misc_feature (210)..(210): n is a, c, g, or t
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtgacctcctatgtgttgacgcagccacccgtggtagtccgtggccccaggaccagaccggcctaggttcccngtgagggcaactactagttggtaggtaaaggtgtcgacctacgtgggtaccaggtcacgacgtccgacggtaccgtacggtcccttggtacggttcggtaccgtaccgtagtcgtacgtcgaccgacggtccggtaccggtcccgtacggtacggtactaccgtggtacgtcgttacgtttcgcggtacctacgtacgtccggtacggaaccgtaccggtcctaccgtcggaccgtacgtacggtacggtacggtaccgacggtccgggtagtaccggtacgtaccggtacgtacgtacgtacgtacggtacgtacgggtacggtacggtacgtacggttacgtacggtcgtcggttccgggttacgggtacgtccgggacggtacggtactacggttcggtaccgttcgggtacgtaccgtacggtaccgtacgtcgtaccgtcccgttagtccgtaccgttccgtaccggtcccgtaccgttccgttaccgtcgtccgtcgtacg

SEQ ID NO: 57069 - DNA, 585 bp, Homo sapiens
  misc_feature: GYAE6OF01D60BS.49.9.A09.1.454.CMB.1.raw
  modified_base (355)..(355): a, c, t, g, unknown or other
  misc_feature (355)..(355): n is a, c, g, or t
  modified_base (417)..(417): a, c, t, g, unknown or other
  misc_feature (417)..(417): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgaggcaacaacattggtggtaaaggtgtgcactggtaccagcagaagccaggccaggcccctgtgttggtcgtccatgatgacagccggaccggccctcgaggggactcccgtgagcgtattttctggctccaagtctgggaacncggaccacctgaccgtcagcgagggtacgaaggcgggagtgaggccgaactatatctgtcgnggtgtgggatagtagtgtgtcgttcggttccggggtgtcggacgggaggtaccgtaagttcgtaccggttcggttggtacgcggacccgaagggccttccggtccccccgtggtccctccgttccgtccgtttaccccctcccttccttcctcctccgttccgtaccg

SEQ ID NO: 57070 - DNA, 622 bp, Homo sapiens
  misc_feature: GYAE6OF01A1V48.49.9.A09.1.454.CMB.1.raw
  modified_base (330)..(330): a, c, t, g, unknown or other
  misc_feature (330)..(330): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgaggcaacaacagttggtaggtaaaggtgtgcacgtggtaccagcaagaacgccgaggccacggcccctgtgttggtgatgtaataaagacactggagacggccctcgagggactcccgngacgcgattctcgtcggcctccgaggtcgagggaaccgaacggtcacgtagtcggccagtcgaggtggacgtaccgaggcgaggacggacggaggtcgtagtacttaatttagttgtacaaatcaacgagaccactatttaggtaacttagtcgttacgttacggaacttcgacgaaccgtaagtaccgtaccgttccggtacgggtaccgaccggtaccccaaacgggtcccccctaaacccgtaccttcggtaccctacttacccgtcccttccccctaccccgttcccc

SEQ ID NO: 57071 - DNA, 560 bp, Homo sapiens
  misc_feature: GYAE6OF01BDLWN.49.9.A09.1.454.CMB.1.raw
  modified_base (331)..(331): a, c, t, g, unknown or other
  misc_feature (331)..(331): n is a, c, g, or t
  modified_base (417)..(417): a, c, t, g, unknown or other
  misc_feature (417)..(417): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgtattttcnggctccaagtctgggaacacggccaccctgaccgtcagcgagggtcgaaaggccggggatggaggccgatatatctgtcagggtgngggataggtagtagtgcttcgttccgggggtgttcgggcgggagggacctaaggttggaccgttcgttgggtcagcccgaaggtcctacggcccccctgggtccacctcgtcgttcccccaccttccctctcctcgtcgtacc

SEQ ID NO: 57072 - DNA, 696 bp, Homo sapiens
  misc_feature: GYAE6OF01CZ3TH.49.9.A09.1.454.CMB.1.raw
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtcccgtcggccccaggacacggaccggccacggtttccctggtggagggacaaacaactagttggtaggtaaaggtgtgcacgtggtaccagcaagaacgccgacggccacggccctggtgtcggtcgtccatggatgacgacggccgacccggccctacggacggggtactcccgtaggacgcgttactttcgtcgctaccgaagttcgtacgggaaccnccggccacccgtgaccgtnacgcgaggggtcgaacgggcccggggtaatcgggacggaccgtacgtaacgtacgtcgttcggtacgtaaggggttggtagggtaagttaggtaggtaggtgtacgtgtagttgggttggttacgggtcgggacgggtacgggaccgaaggtccgtacggacccgttcggacggtaccgtaccgacccggtacggtaccgtccccgggtacccccgttccggtacccgttacccgttcccggtttacccggtccccccgtcccttcccgttcccttacccgg

SEQ ID NO: 57073 - DNA, 553 bp, Homo sapiens
  misc_feature: GYAE6OF01ACSTJ.49.9.A09.1.454.CMB.1.raw
  modified_base (479)..(479): a, c, t, g, unknown or other
  misc_feature (479)..(479): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcgagggatccccgtgagcgtattttcgtcggcctccaagttcgtaggggaaccaccgggcccaccccgtggacccgtcgacgccgacggggtcgaacggccgggggatggacggccgactatatctgtcaggtgtgggatagtagtagtgcgtcgtcggggtgtcggcgggnggaccgtagttcgacgtcgtggtcagcccaggctcgcccctggcncctctcgttcccncctctcctctctcgtc

SEQ ID NO: 57074 - DNA, 632 bp, Homo sapiens
  misc_feature: GYAE6OF01CWGA8.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggccccctgtgctggtcgtctatggtgagtggcgaccggccctacagggatcccgtgagcgattctctggcctccaactccgtcgggaaccccggccaccctgacccatcgaggccgggtacgaaggaccggggatacggacggccggaacttaattaccgtagtcgagggttgtacggggataggtgggtaggtggtggttcgtcgttcgggagtcgtggggacccaggggtccaacccggttcctacgggtccacggaccccgaaagggcccctaaaccccccgagttcgtacccaaccgttccgttaccggttaccccctaaccccgtttccctacctttccctccctccggtcccttaccgg

SEQ ID NO: 57075 - DNA, 538 bp, Homo sapiens
  misc_feature: GYAE6OF01BFB5C.49.9.A09.1.454.CMB.1.raw
  modified_base (470)..(470): a, c, t, g, unknown or other
  misc_feature (470)..(470): n is a, c, g, or t
  modified_base (493)..(493): a, c, t, g, unknown or other
  misc_feature (493)..(493): n is a, c, g, or t
  modified_base (511)..(511): a, c, t, g, unknown or other
  misc_feature (511)..(511): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacagttggtaggtaaaggtgtgcactggtaccagcagaagccaggccaggcccctgtgttggtcgtccatgatgacagccgaccggccctcgaggggactccccgtgagcgtattttcgtggcctccgaagtcgtagggaacacggccaccctgaccgtcagcgaggggtcgaaacggccggggatggaggccgactatatcgtgtcaggtggtgggatagtagtagtgcgtcgttcggggtgttcgggnggagggactaggtgacgtgtgcngccagctcgccccgtgcnctctcgtcccacctctctctcgtcgtc

SEQ ID NO: 57076 - DNA, 719 bp, Homo sapiens
  misc_feature: GYAE6OF01C8G08.49.9.A09.1.454.CMB.1.raw
  modified_base (209)..(209): a, c, t, g, unknown or other
  misc_feature (209)..(209): n is a, c, g, or t
  modified_base (390)..(390): a, c, t, g, unknown or other
  misc_feature (390)..(390): n is a, c, g, or t
tcagagtcgagagacacgaccggtgctcgatttagcgagacgcgcgagggcggtggcctaaggaagcagcactggtggtgcctcagccatggcctggaccggttctcctcctcgcctcctctctcactgcacagactctgtgacctcctatgtgttgacgcagccaccctggcgtccgtggccccaggacagtacggccaggtttcccngtgacggcaactaacagttggtaggtaaaacggtgtcgcacgtggtaccaggcgaagtaagcctaaggccacggtccccttggtgttcgtcgtccatgatgacaggccgaccggcctagaggtactcccgtgtacgtcgtactttcgtcggtcgtacctaacggttcgtacgggtaaaccnccggccctaacccgtcgtaccgtacgacgtacgacgggttccgaacgggcccggggtatacgggaccgtaccgtaacttacgtacgtcgttgtacggtaagggttcggtacgggtaacgtttaggttaacgttaggttccggttcggttaccggtttcggggggttcttccggggacggggtaacggtaaccggtaggtttacggaccggtttacggttcggttaaccgaccggtaccgacggtccgtccggtcccccgttagggtcctaacccgtttccgtcccggttccccgtacccgtttcctccgttacctcgtcccggtacccg

SEQ ID NO: 57077 - DNA, 663 bp, Homo sapiens
  misc_feature: GYAE6OF01BCICO.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcgcctcctctctcactgcacagactctgtgacctcctatgtgttgacgcagccaccctcggtcgtccgtcggccccaggacgagaccggcctacggtttcccgtgtggagggacaaacgaactagttggtaggtaaaaggtgtgcactggtaccagcagaagccaggccaggccctgtgttggtcgtccatgatgacagccgacccggccctcgagggactcccgtgacgcgtattttcgcggctccgaaagtcgtagggaactaccggcccacccgtgacccgtcacgcgagggtcgaacggccgggatcggaggcccgatactagtctgtacgtagggtggtagggtacgttagtaggtacgtgtcgtttcggttccgggggttagttccggggacgggtaacggggtaccgtaacgggttcggtaccggttcggttggtaccgtacggacccgtaacggcccgttaccgtccccccggttaggtccctacccgttcgttaccccggttacccctaccccgttccctaccctttccctcgttacccgtccg

SEQ ID NO: 57078 - DNA, 680 bp, Homo sapiens
  misc_feature: GYAE6OF01CL49Q.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacaggacggcctaggtttccctgtgagggcaacaacagttgggtaggtaaaggtgtgcacgtggtaccagcagaacgccaggccacggcccctggtgttcggtcgtccatgatggacacggccgacccggccctacgacgggtactcccgtgacgtcgttattttcgcggtctaccgaagttcgtagggaaccaccggccctacccgtcgaccgtcacggcgacggggtacgaacgggccggggtatcgggacggaccgtactagttacgtcgtggtcgagggttggtacgggtaagttaggtaagtaggtcgtcgttcgggttccgggggttggtccgggacggggacgggtaccgtaagggttccggaccggttcggtttcggaccgtaccggtacccggtaagggtcccgttccccggcccccggttggttccctaccgttcccgttcccggttccccgcccttccctccgttcctcccgtcgtacccg

SEQ ID NO: 57079 - DNA, 562 bp, Homo sapiens
  misc_feature: GYAE6OF01A9VOC.49.9.A09.1.454.CMB.1.raw
  modified_base (303)..(303): a, c, t, g, unknown or other
  misc_feature (303)..(303): n is a, c, g, or t
  modified_base (389)..(389): a, c, t, g, unknown or other
  misc_feature (389)..(389): n is a, c, g, or t
  modified_base (532)..(532): a, c, t, g, unknown or other
  misc_feature (532)..(532): n is a, c, g, or t
  modified_base (545)..(545): a, c, t, g, unknown or other
  misc_feature (545)..(545): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccaccctcggtgtccgtcggccccaggacagacggccacggtttccctgtgagggcaaacaacagttggtaggtaaaggtgtgcacgtggtaccagcagaacgccaggccaggcccctgtgttggtcgtccatgatgacnggccgacccggccctcgagggactcccgtgagcgtattttcgcggtctccgaagtcgtagggaacaccggccacccgtgacccgtnacgccgagggtcgaggccggggatcggacggccgtatagtatctcgtcgagggtgtagggtataggtagtgtgcgttcggtcggggtgtcggcgggtaggacgtagttcgacgttcgtgcgacgccgagcctcgccccgtgcncgtcctcgtcccnccctcnctcntccgtcg

SEQ ID NO: 57080 - DNA, 614 bp, Homo sapiens
  misc_feature: GYAE6OF01CIGEC.49.9.A09.1.454.CMB.1.raw
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaaacaacagttggtaggtaaaggtgtgcactggtaccagcagaagccaggccaggccctgtgttggtcgtccatgatgacaggccgaccggccctcgagggtactcccgtgacgctattttcgnggctaccaagtcgagggaacacggccaccgtgaccgtnacgcgagggtcgaaacggccgggatcggacggccgtaactagtatcgtagtcgtaggtggtagggataggtagtagtgtcgttcggttccggggtgtcgggacgggtaggaaccgtaaggttcgtacggttcggttcggtacgacgtcccgaggtcccgtaccggccccccgttagggtcctaccgtccgttccggttccccccgtcccttcccgtccttccctccgtccgtaccg

SEQ ID NO: 57081 - DNA, 822 bp, Homo sapiens
  misc_feature: GYAE6OF01A8LO9.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaggtgtgcactggtaccagcagaagccaggccaggcccctgtgttggtcgtccatgatgacaggccgacccggccctcgacgggactccccgtggacgtccgttaatttttcgcgggtccttaccgaaacggttcgtacgggggtaaacccacccggggacccctaaccccgttcggaacccggttccgaacgggacccggtaacgggggtaccggaaacggggcccggggggtaattcgggaaccgggtacccgtaacgttaagttacgttccgttggtaccggtaggggttggtaggggtaagttaaggtacggttaggtcggttccggtttccggggtttcccgggggggttcggtttaccgggggacggggtaacggggtaacccgttaacggggtttccggtaacccgggtttacgggtttacgggtacccggaaccgggtaccccggtaaagggtccccgttacccgggtcccccccggttacggggttaccccgttacccgtttccccggttcccggtttacccccccgtccccgtttccccttcccgttaccccgtttccccgttaccggttaaccccgg

SEQ ID NO: 57082 - DNA, 701 bp, Homo sapiens
  misc_feature: GYAE6OF01BNYY0.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcctagttttccctgtgagggcaacaacattggtaggtaaaggtgtgctacgtggtaccagcagaagccaggccaggcccctgtggtggtcgtccatgatggacaggccggacccggccctcgacggggtactccccgtgacgcgtattttcgtgggtcctccgaagttcgtacggggaaaccaccggtcccacccgtcggaacccgtacgacggaccgaaggggtaccggaacgggcccggggggtatacgggacgggacccgtaacgttacgtattcgtaggtcgtaagggttgggtagggtagttaaggtagttaggtcgtcggttccgggtttccggggggtggttccggggcgggtacgggtaaccgtagggtttacggaccgggttcggttagggtccgacggacccgaaggtcccgtccggcccccgttcggtcctaccgtcccgtttcccgttaccccccggtcccttcccctcccgttaccttccgtccggttcccg

SEQ ID NO: 57083 - DNA, 793 bp, Homo sapiens
  misc_feature: GYAE6OF01A4573.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaggtgtgcactggtaccagcagaagccaggccaggccctgtgttggtcgtccatgatgacagccgaccggccctcgacgggactccccgtgacgcgtacttttcgtcggtccttaccaaaggttcgtacggggaaaccacccgggtcccaaccccgttcggaacccgttcgaacggccggtaacggggtaccggaaacggggcccgggggtaagtacgggaacgggtacccgtaacgttaattaacgttcccgttaggtaccgtaagggttgggttaggggtaacgttaagggttaacggttaaggttcggtcccggtttacccggggttttcccgggggggttcggtttccgggggaccggggtacggggtaacccggttaaagggtttccggtaccggggtttcggtttacgggtacccgaacggtacccccggtaagggtcccggttacccggtcccccccggttcgggtacccttacccgttcccgtttaccccggtttacccccccgtaccccctttacccgttcccttcccgttccccgttcccggttacccg

SEQ ID NO: 57084 - DNA, 689 bp, Homo sapiens
  misc_feature: GYAE6OF01D9O45.49.9.A09.1.454.CMB.1.raw
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
tcagagtcgagagacacgaccggtgctcgatttagcgagacgcgcaggggctgggcctaaggaaggcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaggtgtgcactggtaccagcagaagccaaggccaggcccctgtgttggtcgtccatgatgacagcgaccggccctcgagggatccctgacgcgtactttttcgnggctccaagtcgtagggaacnccggccaccctcgaccgtcacgcagggtcgaaacggccggggatcggaacggtcccgaacttagtaacttcgtcgtaccgtagggtaggtcggggaacttaaggtaggtttacgggtgtccgttaccgggtttccgggggggtagtttccggggcgggtaacggggaccctaaagggtttcggaacccgggttcggtttacgggccctaacggggccccgtaaagggtcccgttaccggtcccccccgttgggggttacccctacgttcccgttaccgtttacccccccaaccccgtttcccgttcccttccccgtcgttcccgtaccg

SEQ ID NO: 57085 - DNA, 890 bp, Homo sapiens
  misc_feature: GYAE6OF01DYWTN.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggccccaggacagacggcctacggtttccctgtggagggacaacaactagttggtaggtaaaggtgtgcacgtggtaccagcaagaacgccaggccacggccccgtggtgttcggtcgtaccagtgatagacgacggccggacccggcccgtacgacgggtactcccgtagacgtcgttacttttccgtcggtcctaccgtaagtccgtacggggaaccacccggaccctacccggtacggacccgtacgacggaccggtaacggggtaccggaaaccggggtacccgggggtagtacgggaacccgggtacccgtaacgttaacgttacgttcccggttaggtaccgggtaggggttgggttacggggtaagtttaacgggttaagggtttacggttccggttacccggtttccgggggttttacccggggggggttcggttttaccggggggaccgggggttaaaccgggggtaaacccggtttaacggggttttacccgggttaacccggggttttcggggttttaccggggtacccgtaacccgggtacccccgggtaaacgggtccccggtttacccccgggtacccccccggtttaccggggttacccgttaccccgtttcccccgtttaccccgtttaccccccccgtaccccccgtttacccctttacccgtttccccgttcccggttccccggttacccgg

SEQ ID NO: 57086 - DNA, 594 bp, Homo sapiens
  misc_feature: GYAE6OF01DR8IE.49.9.A09.1.454.CMB.1.raw
  modified_base (211)..(211): a, c, t, g, unknown or other
  misc_feature (211)..(211): n is a, c, g, or t
  modified_base (345)..(345): a, c, t, g, unknown or other
  misc_feature (345)..(345): n is a, c, g, or t
  modified_base (490)..(490): a, c, t, g, unknown or other
  misc_feature (490)..(490): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccgtcggtgtccgtggccccaggacagaccggcctaggtttcccngtgagggcaaacaactagttggtaggtaaaggtgtgcacgtaggtaccagcaagaagccaggccaggcccctgtgttggtcgtcatgatgacagccgaccggccctgagggactcccgtgacgtcgtattttcnggtctccgaagtctagggaaccacggcccaaccgtgacccgtcacggcgacgggtcgaacggccggggtatacggaacggcccgtaatatacgtcgtgacgagggtgtgggattaggtagtagtgtccgttcggttccgggggtnttccgggcggtaggaccgtaagttgaccgttcgtgtcacgccgaggtcctccggccccgttgctaccctcgtccttcccctaccctcctctccgtctcgtaccg

SEQ ID NO: 57087 - DNA, 653 bp, Homo sapiens
  misc_feature: GYAE6OF01AYAUI.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagaccggcctaggtttccctgtgagggcaaacaacagttggtaggtaaaggtgtgcacgtggtaccagcagaagccaggccaggcccctgtgttggtcgtccatgatggacaggccggacccggccctacgacggggactcccgtggacgcgtatttttcgtaggccttaccgaagtccgtaggggaaccaccggacccacccctggaccccgtcacggcgacggggtaccgaaggcccgggggatgggaacggccgactatacgtctagtcgagggtgtagggattaggtagtagtcgtcgttcggttccgggggttgttcgggacgggagggtacctaagggtttcgaccggttggttcggaccgaggtaccccgtaaggccgttcccggacccccgttggaccctccttccggttcccgttcccccgtcccttacccgtccttcccgtcgtcccgtaccg

SEQ ID NO: 57088 - DNA, 866 bp, Homo sapiens
  misc_feature: GYAE6OF01DNMRI.49.9.A09.1.454.CMB.1.raw
  modified_base (417)..(417): a, c, t, g, unknown or other
  misc_feature (417)..(417): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctctatgtgttgacgcacgcccacccgtcggtgtccgtcggccccaggacaggacgcctaggtttccctggtggagggacaacaactagttgggtaggtaaaggtgtgcacgtggtacagcagaacgccaggccgaggccctggtgttcggtcgttccagtgatgaacgacggtccggacccggtccctaggaacggggaccttccccgtaggacgtcgtttaacgttttccgtcgggtcctacccgtaaaggttccgaacgggggtaaacccncccggacccgtaacccccgtgggtaaccccgtacggaccggaccgggtaacgggggtaccggaaaccggggccggggtaagtaccgggacgggacccggtaacgttaacgttacgtttcccggtaggttaccggtagggttacgggttaaggggtaacgtttaagggttaacgggttagggttccgttccgggtttccgggggtttacccggggggttcgggtttaccgggggacggggtaaccggggttaaacccgtttaacgggggtttaccggtacccggggttttccgggttacgggtacccggaaccggtccccgggtaaacggtcccggttaccccggtccccccggttaccgggttaccctacccggttttccggttaccccgtttaccccccgtaccccgtttcccgtcccgtttccccgttcccgttccggttaccccgg

SEQ ID NO: 57089 - DNA, 543 bp, Homo sapiens
  misc_feature: GYAE6OF01BRCXV.49.9.A09.1.454.CMB.1.raw
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (496)..(496): a, c, t, g, unknown or other
  misc_feature (496)..(496): n is a, c, g, or t
  modified_base (516)..(516): a, c, t, g, unknown or other
  misc_feature (516)..(516): n is a, c, g, or t
  modified_base (534)..(534): a, c, t, g, unknown or other
  misc_feature (534)..(534): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaggtgtgcacgtggtaccagcagaagccaggccaggcccctgtgtggtcgtccatgatgacagcgaccggccctcgaggctcccgngagcgtatttcngtcctcaagtcgtaggaacaccggccaccctgaccgtcagacgaggggtacgaaacgggccggggatggacggccgaactagtactctggtcgagggtggtagggatagtggtagtcgcgttcggttcgggtggttcggcggagggactagtcgtacgtgtgcncgccgagtctcgccctgccnctcgtctccccgtctccntctgtcgtc

SEQ ID NO: 57090 - DNA, 623 bp, Homo sapiens
  misc_feature: GYAE6OF01DF0HJ.49.9.A09.1.454.CMB.1.raw
  modified_base (234)..(234): a, c, t, g, unknown or other
  misc_feature (234)..(234): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacaggacggcctaggtttccctgtgagggacaacaactagtttggnggtaaagtgtgctacgtggtaccagcaagaagccgaggccacggcccctgtggttcggtcgtccatgatgacaggccgaccggccctcgagggactccgtgacgcgtatttcgcggctctaagtcgnggaacncggccacctcgacctcagtcgaggtacgaacggccgggatcggacggaccgtactatacttgtcgtcgtaggtcggtagggtattaggtagtagttcgtcgtcggtttcgggggtacgttcgggacgggtacgggtaccgtaggttacggaccggtttcggtcgggtcgaaccgcccggaaaggtcccgtacccgtccccggtcgtcccacttcccggtacgttccccgtccctacctcccttcgtcctcgtaccg

SEQ ID NO: 57091 - DNA, 856 bp, Homo sapiens
  misc_feature: GYAE6OF01BTSR2.49.9.A09.1.454.CMB.1.raw
  modified_base (208)..(208): a, c, t, g, unknown or other
  misc_feature (208)..(208): n is a, c, g, or t
  modified_base (349)..(349): a, c, t, g, unknown or other
  misc_feature (349)..(349): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttcccngtgagggcaaacaacagttggtaggtaaaggtgtgcacgtggtaccagcagaacgccgacggccacggcccctgtgttggtcgtccatgatgacgagccggacccggccctcgacgggactcccgtgaggcgtattttcgnggtcctaccgaaagttcgtacggggaaaccgaccggcccgaccccgtacggacccgtaccgacggaccggtaggggtacggaaacggggcccgggggtaagtcgggaacgggtcccggtaaacgttaacgttaacgttcccggttacggttaccggtaaggggtttacggggttaggggtaacgtttaaacggggttaaggtttacgggttaccggtcccggttttaccgggggtttcccggggggggtttaggtttcccggggggtaaccgggggtaaccgggggttaaccccggttaacgggtttaccggggtaacccgggttttacggggttcgggtaccccggtaaacggaccccgggtaaaccggggttcccggttcccccgggtaccccccggttaccggggttaccctaccccggtttcccggtttaccccggttccccccccgttcccccgtttaccccgtttacccgttcccgtttacccgttcccggttaaccccgg

SEQ ID NO: 57092 - DNA, 669 bp, Homo sapiens
  misc_feature: GYAE6OF01A7CFF.49.9.A09.1.454.CMB.1.raw
tcagagtcgagagacacgaccggtgctcgattttagcgagacgcgcagggctgggaccggtaaggaagcacgcactggtggtgcctcgagtccattggcctggaccgttctcctcctcggcctcctctctcactgcacagtacgtctgtgacctccttattgttgttttgacgtcacgccaccgtcggtggtccgtggccccgaggacgagggacggccgaggtttccctgtggagggcaacaactagttggtacggtaaaggtgtgcacgtggtaccagcagacgccgaggccgacgtcctgtcgttcggtcgtcagtgagtcgacgaggccggaccggtccgtacggacggtctccgtgtacgtacgttatttcgtcggtactacgtaacggtcgtaacgggaacgaccggaccctacccgtcgtaccgtacgacggacggtaacgggtacggaacgggtaccgggtagtacgggacggtaccgtaacgttacgtacgttacgtggttacggtagggttcggtaagggtaattaggtagtacgtcgtcggttcgggttccggggtcggtcgggacggacggtacgtacggttacgtccgttggtcgcgacgccgacgtccgtccgcccgtgtctcgtcgtccgtccctcctctccgtctcgtcgtcg

SEQ ID NO: 57093 - DNA, 884 bp, Homo sapiens
  misc_feature: GYAE6OF01D59C4.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcgcctcctctctcactgcacagactctgtgacctctatgtgttgacgcacgcctacccgtcggtcgtccgtcggccccaaggacacggaccggtcctacggttttcccgtggtggacgggacaaacgtaactagtttggtaggtaaaggtgtcgactacgtaggtaccagacaagaacgccgacggccgacggtccctggtgttcggtcgtccgtatgacgtcgacgacggccggacccggcccgtcggacggtacctcccgtaggacgtacgttacgttttcgcggtacctaccgtaacggtacgtacgggaaccgtacccgacccgtacccgtaccggtacccggtcacgggaccggtaacggggtaccggaaccgggtccgggggtaagtacgggaacccgggtacccgtaacgttacgttaacgttcgttacgtacggtagggttacggtagggtaacgtttaaggttacgggttacggttccggttaccgggtttacccggggttttccgggggggttacgggtttacccgggggtaaccgggggtaaacccggggttaacccgggtttaacgggggtttacccggttaacccggggttttccggggttaccgggtacccggtaaccgggtaacccccggtaacgggttcccccgttacccccggttcccccggttaccggggttccctacccgggtttccccttaccccggtttccccccctaccccgtttcccctttcccgtcccgtttcccgtacccggttacccg

SEQ ID NO: 57094 - DNA, 161 bp, Homo sapiens
  misc_feature: GYAE6OF01BR5VM.49.9.A09.1.454.CMB.1.raw
  modified_base (150)..(161): a, c, t, g, unknown or other
  misc_feature (150)..(161): n is a, c, g, or t
tcagagtcgagagacacgaccggtgctcgatttagcgagacgcgcagggcacgaccggtgctcgatttagtcgagctctctcgcgggcacgaccggtgctcgatttagtcgagctctctcgactctgagcgggctggcaaggcgcatagnnnnnnnnnnnn

SEQ ID NO: 57095 - DNA, 666 bp, Homo sapiens
  misc_feature: GYAE6OF01B74ZN.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccaccctcggtgtccgtggccccaggacagacggccaggtttccctgtgagggcaaacaacattgggtaggtaaaaggtgtgcacgtggtaccagcagaagccaggccacggcccctgtgttggtcgtccatgatgacagccgacccggccctcgagggactcccgtgagcgtattttcgtcggtcctccgaagtcgtaggggaaaccaccgggacccaccccgtcgacccgtcacggcgaacgggtacggaacggccggggtatcggacggaccgtaacgtatacttcgtgtcgtagggtcggtagggataggtagtagtcgcgttcggttccgggggtcgttcgggacgggtacgggaccgtaaggttcgtacccggttcggttacgggtccgacggtacccgaacgggtcccgtaccggtccccccgttgggtaccctacccgttccgttcccggttccccctaccccgttcccttaccctccgttcccgtccgtacccg

SEQ ID NO: 57096 - DNA, 748 bp, Homo sapiens
  misc_feature: GYAE6OF01DHQ84.49.9.A09.1.454.CMB.1.raw
  modified_base (139)..(139): a, c, t, g, unknown or other
  misc_feature (139)..(139): n is a, c, g, or t
tcagagtcgagagacacgaccggtgctcgatttagcgagacgcgcaggggctgggcctaaggaagcagcactggtggtgcctcagccatggcctggaccgttctcctcctcgcctcctctctcactgcacagctctgtnacctcctatgtgttgacgcacgcccacccgtcggtgtcccggcggccccaggacacggaccggccgtacggtttccctgtaggagggacaaacaactagttgggtagggtaaaggtgtggacacgtggaccagacaggaaacgccgaggccacggcccttggtggtcggtcgtcatgatgacgagccggacccgtcctacgacgggtctcccgagaggtccgttacttttcgcggcctacgtaacggtcgtaccgggaaaccgaccggaccctacccgtacggaccgtacacggaccggtacggggtaaccggaacggggtaccgggtagtaacggaccgggacgtaccgttaatacgtctaggtcgaaggggtggtacgggtataaggttaggtgttacgtccggttccggggtttcggggtcggttccggggacgggaacgggttaccgttaacgggttcgtaccgggtaggtttcgggaacgtaccgggacccgaaacggtccgttccccggtcccccggtacgggttacccttcccggttaccggttccccgttaccccccggttccccttcccgttaccttcccggttcccacccggtttaccg

SEQ ID NO: 57097 - DNA, 640 bp, Homo sapiens
  misc_feature: GYAE6OF01B5UL9.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcacgtggtaccagcagaagccaggccacggcccctgtgttggtcgtccatgatgacagcgaccggccctcgagggactcccgtgacgcgtacttttcgtcggtctaccgaagtcgtacggggaacaccggccacccgtcgaccgtcacgcgacgggtacgaacggccggggatcggaggccgacgtatactcgtgtcgagggtgtgggattagtagtagtggtcgttcggtttccgggggtgttcggggacgggagggtacctaagggttcggtaccggttcggttcggtccgacggacccgtaggcccgttccggtccccccgttcgggtccctaccgttcccgttcccggtttcccccgtcccccttcccgttacccttcccttccggtcccgtaccg

SEQ ID NO: 57098 - DNA, 742 bp, Homo sapiens
  misc_feature: GYAE6OF01CC1N8.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtcccgtggccccaggacacggacggccaggtttccctgtgaggacaaacaactattggtggtaaaggtgtagcacgtggtaccagcagaacgccaggccaggcccctggtgttggtcgtccatgatgacgagccgaccggccctcgagggatcccgtgacggcgtactttttcgcgtaccgtcgaagtccgtagggaaacctaccggaccaccccgtacggacccgtcgaacgccgtaaggggtaccgaaacgggtcccggggaacgttagggaacgggtaccccggtaagttaaacttaccggtttacgttcggttaaccggtaggggttaggggtttaagggggtaagttaaggggttacgggttagggtttgggttacggttccggtttaccggttcgggaacgtcggtacgggaccggtacggggtcctaaccggttccgtacggtaccacggaccccgtaacgggaacccccaacccgtacgttagtacccgttaccccgttcgttaccccgtttaccccccgtaacccctttcctcctttccccgttcgtcccgttacccgg

SEQ ID NO: 57099 - DNA, 600 bp, Homo sapiens
  misc_feature: GYAE6OF01DFEB9.49.9.A09.1.454.CMB.1.raw
  modified_base (345)..(345): a, c, t, g, unknown or other
  misc_feature (345)..(345): n is a, c, g, or t
tcagagtcgagagacacgaccggtgctcgatttagcgagacgcgcaggggctgggcctaaggaagcagcactggtggtgcctcagccatggcctggaccgttctcctcctcgcctcctctctcactgcacagactctgtgacctcctatgtgttgacgcagccaccctcggtgtccgtggccccaggacagacggcctaggtttccctgtggaggcaaacaactagttggtaggtaaaggtgtgcacgtggtaccagcaagaacgccgaggccacggcccctgttggttggtccgtccatgatgacagccgaccgccctgagggactcccgtgagcgtatttcgnggctacgagtcgtagggaacacggacccaccgtcgaccgtcagcgagggtcgaaggccgggatcggacggccgaatatactcgtgtcgtagggtggtagggtataggtagtagtcgtcgttcgggttccgggggtgttccgggcgggtacggactaaggttcgcgttcggtgcgaccgccgacggtcctacccggtccccgtcggtccctccttccgtaccccgtacccctcccttcctcttctccgtcgtaccg

SEQ ID NO: 57100 - DNA, 539 bp, Homo sapiens
  misc_feature: GYAE6OF01DMR36.49.9.A09.1.454.CMB.1.raw
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaagtgtgcactggtaccagcagaagccaggccaggcccctgtgttggcgtccatgatgacagcgaccggccctcagggatccctgagcgatttcnggctcaagtctgggaacncggccacctgaccgtcagcagggtcaagccgggatgaggccgactatatctgtcaggtgtgggatagtagtagtgctcgttccggggtgttcggcggtagggacctagttcggaccgttcggttggtcacggcccaaggcctcggccccctgggtccactctcgttcccctaccctcctctcctcgtcgtaccg

SEQ ID NO: 57101 - DNA, 591 bp, Homo sapiens
  misc_feature: GYAE6OF01A4DZP.49.9.A09.1.454.CMB.1.raw
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (562)..(562): a, c, t, g, unknown or other
  misc_feature (562)..(562): n is a, c, g, or t
  modified_base (580)..(580): a, c, t, g, unknown or other
  misc_feature (580)..(580): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacagttggtaggtaaaggtgtgcactggtaccagcagaagccaggccaggcccctgtgttggtcgtccatgatgacagccgaccggccctcgaggactccctgagcgtattttcgnggtcctccgaagtcgtacgggaaccnccggacccacccgtggaccgtcacgcgaggggtcgaacgggccggggatcggacgggcccgtaactagtacgttcgtgtacgtgggtacggtagggtattagggtagttaggtcgtcgttcgggttccggggtggtcgggacgggacgggactaaggttcgtacggttcgtgcgcggccgacggcctcgtccccgtgtcncctctccgtccctcctcnctctctcgtcg

SEQ ID NO: 57102 - DNA, 903 bp, Homo sapiens
  misc_feature: GYAE6OF01APT9U.49.9.A09.1.454.CMB.1.raw
  modified_base (223)..(223): a, c, t, g, unknown or other
  misc_feature (223)..(223): n is a, c, g, or t
tcagagtcgagagacacgaccggtgctcgatttagcgagacgcgcaggggcgtgggccgtaaggaagcagcactggtggtgcctcagccatggcctggaccgttctcctcctcggcctcctctctcactgcacagactctgtcgacctcctatcgtgttgacgcagcccacccgtcggtcgtccgtcggaccccaggaccacggaccggccacggttttcccnggtcggacgggccaaactacagtttcgggtacgggtaaaaggtcgtcgacaccgttgggtaacccaagtccaaggaacgccgacggacccgaggtcccccttggttcggttacggtccggtacctacgttcggacgttacggaccgaggtcccgggacccggcccttacggaaggggccttaccccgtaggtaacggtcgtactttttcgcggtaccctccgtaaacggttcgtacggggaaccctacccgggtaccctaccccggttagtaccccggtcgaaaccggtccgtacgggggggttaacccgaacgggaccccgggggtaaggttacggtaacccgggaccccggtttaaacggttaaccgttaggtttaccccgttagggtaacccgttacgggggtggttaaccgggggtaagtttaacgtacgggtttacggtccggtacgttttcccgggggtttccgggggtgggtttccgggacggggtaaccgggtaccgttaagggtcccgttacccgggtttcggggttacgccggttaaccggacccggtaaacggttcccggtccccgggcccctttaccgggtaacggttcccgttacccgtttcccgggtttacccccccgtaaccccgttttcccgtaccctttacccgttgggttccccggttaacc

SEQ ID NO: 57103 - DNA, 645 bp, Homo sapiens
  misc_feature: GYAE6OF01BK4R9.49.9.A09.1.454.CMB.1.raw
  modified_base (481)..(481): a, c, t, g, unknown or other
  misc_feature (481)..(481): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccacccgtcggtcgtcccgtcggccccgaggacaggacggcctacggtttccctggtgagggacaacaactagttggtagggtaaaggtgtcgctacgtggtaccagcaagaacgccgaggcccacggccctggtggttcggtcgtccatgagtgaccgacggcccggaccggtcccgtacggacgggtactcccgtgacgtcggtacttttcgcggtcctaccgtaagtcgtacgggaacaccggacccacccgtacgaccgtcgacgacggacggtaccggaacgggccggggatacgggacggaccgtactagtntcgtgtcgtagggtgtagggtatagtagtagtgtcgttcggtcggggttgtcgggacggacgggtaccgtaggtcgtcggttggtacggtcgcgtacccgagccgtccgccccgtagtcgtccgttcgtcccgtcccgtacctcccttctaccgtcgtcgtccg

SEQ ID NO: 57104 - DNA, 804 bp, Homo sapiens
  misc_feature: GYAE6OF01BUNWR.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctctatgtgttgacgcacgcccacccgtcggtcgtcccgtccggaccccgaggacgacggaccggccgtacggtttcccgtggtggaggacaacaactagttagggtaggtaaaggtgtcgcgtacgtcggtaccagacgaagaacgccgacggcccgaccgggtccccgtggttcggttcggtaccgtacctagtacggacgtcgaacgacgggacccggaccccgggtaccctacggaacggtaccgtcccgtaggacgtacgtacttccgtcgtcggtaccgtccggtacggtacggaacgggtaccgaacggtacgacgtacgttcggactacgtacggtaggtacggtaaccgtccgaagggacgtaaagggacgggacggacgtacgtaacgtaacgttaatttacgtacgtaactaaccgtaacgaaaccgtacgtaacccgtacgtttaacggttaacggttaacgttttacgttaccggttccggtttaaaccggtaacggttaccgaccggtaaccgtaccgggtaccgtacccggtttaccggtacgggtacccgaccgtaacccgggaaaccccggtacccaaccccggttcctacggtaccccttacccgttacccgttaccccggttcccccctaccgttaccccg

SEQ ID NO: 57105 - DNA, 797 bp, Homo sapiens
  misc_feature: GYAE6OF01EYZ0O.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccacccctcggtgtcccgtggccccaggacagacggccaggtttccctgtgagggcaaacaacagttgggtaggtaaaggtgtgcacgtggtaccagccagaacgccaggccacggccccgtgtgttcggtcgtccatgatgacacgcgaccggccctcgagggactcccgtgacggcgttattttacgtggacccttccgaaacgttccggtacggggaaacccgtaccgggacccctaccccgtacggacccggttcgaacgccgtaacggggtccgaaacgggcccgggggtaagtcgggaacgggtaccgtactacgttaagtccgtagtccgtagggttacggtggggtaatacgggttaagttaggttcggtccgtttaccgggtttccggggggttcgggttcccgggggacgggtacggggtaacccggttaaagggtttcgggtaaccccgggtttcggggttacggtaccggtaaccggtacccccggtaaaacgggtcccgttacccgggtcccccccgttacggggttacccctaaccggtttccccgttaccccggtttcccccccgggtacccccttttcccccgttaccctttccccgttcccgtccccggttaccccg

SEQ ID NO: 57106 - DNA, 705 bp, Homo sapiens
  misc_feature: GYAE6OF01C7S3C.49.9.A09.1.454.CMB.1.raw
  modified_base (326)..(326): a, c, t, g, unknown or other
  misc_feature (326)..(326): n is a, c, g, or t
  modified_base (686)..(686): a, c, t, g, unknown or other
  misc_feature (686)..(686): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccgtcggtgtcccggtcggccccagggacaggaccggccgtacggtttccctggtggacgggacaaacaactagttgggtaggtaaaggtgtagcacgtaggtaccagcaagaagccacgggccgacggtccccgtggttgttcggtcgtccaatggtanggacaggccgacccggccctcgacgggactcctaggcgtcgtacgttttcgtcggtcctacgaacgtcgtaacgggaaccaccggcccacccgtcggtaccgtcgacgcggacgggtacggaacgggccgggatcgggacggtaccgaacgttatacgttgtcggtacgtagggtggtagggtagtagttaggtggttcgcggtttccggttacgggggtgtaccggggacgggtacggtaccgttaggttccggtacggttcggttcggaccgtaccgtacccggaacggtccgtaccccggccccgttacggtccctacccttccgttacccggttaccccctcccgtttcccttccnccgtttcccgtcgttcccg

SEQ ID NO: 57107 - DNA, 745 bp, Homo sapiens
  misc_feature: GYAE6OF01DCARE.49.9.A09.1.454.CMB.1.raw
  modified_base (161)..(161): a, c, t, g, unknown or other
  misc_feature (161)..(161): n is a, c, g, or t
  modified_base (460)..(460): a, c, t, g, unknown or other
  misc_feature (460)..(460): n is a, c, g, or t
tcagagtcgagagacacgaccggtgctcgatttagcgagacgcgcaggggctgggcctaaggaagcatcactggtggtgcctcagccatggcctggaccgttctcctcctcggcctcctctctcactgcacagactctgtgacctctatgtgtgacgcacnccaccgtcggtcgtccggtcggcccaggacacggaccggccgtacggtttcccgtggtaggacgggacaaacaacgtagtttgggtaggtaaaggtggtgactacgtcggtaccgagacgaagaacgaccgacgggacccgaccgggtcccccgttgggttcggtttcggggttccgtccgtaagttacgaacggttacggaaccgaacggtcccggaaacccggtcccctacggacggggtaccttaccgtcggacggtcgttacttttcgcggtcctacgaacgtcggtacggaacncggccctaccgtcggaccgtacgacggacgggacggggtaccgaaacggggcggggtacgtacgggaaccggaccgtaactaacgtacgttcgttacgcggttaacggggttggagggtacggttaggtacggtagtcgtccgggtttacgggtcggggtgttccgggacgggtacgacggtaggttcgacgttggtcgtccgacaccgggacgtcgtacccggccgttggactcccgttccggttccgtcccccgtccttccgcctttctcccggtcttaccgg

SEQ ID NO: 57108 - DNA, 679 bp, Homo sapiens
  misc_feature: GYAE6OF01CPA68.49.9.A09.1.454.CMB.1.raw
tcagagtcgagagacacgaccggtgctcgatttagcgagacgcgcagggcacgaccggtgctcgatttagagagagtgtgctgggtttgggggtgggtccaggaggcagaactctgggtgtctcaccatggcctggatccctctacttcctccccctcctcactctctgcacagactctgacggcctctatgagctgacacacgcccacccgtggtgtctgtcgtcctcgaggacagacggccagtactccactgctacgtggagatgctagttcgaacctaaagctaattacgtcgtacctttacgtacggtaaccagacgaacggaacgccgaaccggcccgacggtccccttggttcctagtacttacttaaatttaaactaaaggttacgtttaggaaccggtaccggtacccgtaaccgggtaaccccgggtacccgttaggaacggttccgtactttccgtcgtccggtcctaccgacggtcgtaacggaacggaactaaccgcgttacctaccgttacggaacctacgtacgaacggtcggaccgggtacccgcgtaagggacggaaccggtgtacgttactaacgttacttacggtactaccgcggtaccacgtacgagaacgcgtaggtacggtcttacggttatgggttactcgggttcggggaacggg

SEQ ID NO: 57109 - DNA, 928 bp, Homo sapiens
  misc_feature: GYAE6OF01BR4M4.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctctatgtgtgacgcacgccacccgtcggtcgtccgtcggccccgaggacgacgaccggccgtacggtttccctggtacggagggaccaacaactagttagggtaggtaaaggtgtagctacgtcggtaaccagcgaagaacgaccgacggcccgtacggccccttgggttcggttacggtccgtacgtataggaacgtacgaccggacggccgggtaaccccggccccgtcgggaaacgggtccttaccccgtaggtaacggttcggttaacttttcgacgggtaccttaccgtaacgttcggaacgggaaccctaccggaccccgtaccccgtacgtacccggtacgacggacgggtaacggggtacggaaccggggtcggggaaggtacgggaaccgggtaccctaacgttacgtacttccggtacggttaccgggtagggttaggggtggggtttaaacgggtaggggtttcggggttaacggggtcggggtttcgtttaccgggggtttaccgggttacggggtccggggtttaaccggggtaacgggggtaacccggtttaaccggggggtacccccgttaacccggggtttcccggtaaacccgggttacccgggaaacccggttaaacccccgggaaaacccgggtaaccccccaaacccccggtttacgggtacccgttaccccgttaacgtttcccccgggtttacccctaaccccccgtttccccggtaccccctttcgtttcccccgttaaccgtcccggtttaaaaccccgg

SEQ ID NO: 57110 - DNA, 671 bp, Homo sapiens
  misc_feature: GYAE6OF01BB0CM.49.9.A09.1.454.CMB.1.raw
  modified_base (215)..(215): a, c, t, g, unknown or other
  misc_feature (215)..(215): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
tcagagtcgagagacacgaccggtgctcgatttagcgagacgcgcaggggctgggcctaaggaagcagccactggtggtgcctcagccatggcctggaccgttctcctcctccggcctcctctctcactgcacagactctgtcgacctcctatgtgttgacgcacgccacccgtcggtgtccgtcggccccaggacagacggcctaggtttcccngtggaggacaacaactagttgggtaggtaaaggtgtcgcacgtgtaccagcagacgccggcacgcctgtgtgnatgtanaagcagtgagcggcctgaggactccgagagcgtattcctcgtcggcctacgaggtcgaaggggaaccaacggtcaacgtagttcggacctagtcaggtcggacgtccgaggcgaaggacggagaggctaggacttattacttgactaatacaaacgtcgaaacctacttacgttacggtttaacttacggttacggtttccgttaacgggaaccgttcggaacccgtaaaccgtaacgggttccgaaccccggttcgggtaccgggtacctaaccgggaaccccgtaacccgggaccccctaaaaccccctcggtaaccgttacccgtaacccttacccgtttaccccgttacccccctccccgtttccccttcccg

SEQ ID NO: 57111 - DNA, 165 bp, Homo sapiens
  misc_feature: GYAE6OF01BT0C2.49.9.A09.1.454.CMB.1.raw
  modified_base (163)..(165): a, c, t, g, unknown or other
  misc_feature (163)..(165): n is a, c, g, or t
tcagagtcgagagacacgaccggtgctcgatttagcgagacgcgcagggcacgaccggtgctcgatttagtcacgcgagaaagggaaagggggctggccctgacgtgtttctgttcccaccctcctctctctcgactctgagcgggctggcaaggcgcatagnnn

SEQ ID NO: 57112 - DNA, 636 bp, Homo sapiens
  misc_feature: GYAE6OF01BQJDR.49.9.A09.1.454.CMB.1.raw
  modified_base (504)..(504): a, c, t, g, unknown or other
  misc_feature (504)..(504): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtcgtccgtcggccccaggaccagaccggccacggtttccctgtgagggcaaacaacagttggtaggtaaaggtgtgcactggtaccagcagagccaggccacggccctgtgttcggtcgtccatgatgacagcgaccggccctacgacgggtactcccgtgacgtcgttattttctggtcctaccgtaagtccgtacggggtaaccaccggcccaaccgtcgaccgtcacgcgagggtacgaaggccggggtatggacggccgtaacgtagtatcgtaggtacgtaagggttggtagggtattaggtagtgtgtcgttcggttccgggggtntaccgggcggacgggtaaccgtaaggttcgtaccggtgtcggtaccacggcccgaaggtccgtacccgtccccgtacggtactacctcgttacccgttccccgccctttctacccgtccttcctcccggtac

SEQ ID NO: 57113 - DNA, 178 bp, Homo sapiens
  misc_feature: GYAE6OF01BZVWJ.49.9.A09.1.454.CMB.1.raw
  modified_base (161)..(178): a, c, t, g, unknown or other
  misc_feature (161)..(178): n is a, c, g, or t
tcagagtcgagagacacgaccggtgctcgatttagcgagacgcgcagggcacgaccggtgctcgatttagtcacgcgagaaaggaagggggctggccctgacgtgtttctgttcccgcctcctctctctcgactctgacgcgggctggcaaggcgcatagnnnnnnnnnnnnnnnnnn

SEQ ID NO: 57114 - DNA, 854 bp, Homo sapiens
  misc_feature: GYAE6OF01C25FN.49.9.A09.1.454.CMB.1.raw
tcagagtcgagagacacgaccggtgctcgatttagcgagacgcgcagggctgggcctaaggaagcagcactggtggtgcctcagccatggcctggaccgttctcctcctcgcctcctctctcactgcacagactctgtgacctcctatgtgttgacgcagccaccctcggtgtccgtggccccaggacagacggccaggtttccctggtgagggcaaacactagttggtaggtaaaggtgtgactactggtaccagacaagaagccacggccacggcccttgtgttcggtcgtaccatgatagacctaggccgacccggcccgtacgacggggaccttccccgtaggacgccgttaacgttttcgtcgggtccttaaccgaacggtttccggttaacggggaaacccgtaccgggtacccctaaccccggtaccggtaacccgttaccggacggaaccggtaagggggttaacccggaaacggggtcccgggggtaacgtacggggaacgggtaccccggtaaacgtttaacgtacgttaccggttcggtaacggtaaggggttagggttacgggggtaagtttaacgggtaacggttacggttacggttacccggttccggggtttttacccggggggtcgggttttaccggggaacgggggtaaccggggtaaccggttaaagggtttacccgggtaaccgggtttcgggtttaccggtacggtaacccggtacccgtaacgggttccccgtaccgggtcccccccgttacggttcccgtaaccttcccgtttcccgttaccccccgttacccccttcccttacccgtttcccttcccgttcggttacccgg

SEQ ID NO: 57115 - DNA, 588 bp, Homo sapiens
  misc_feature: GYAE6OF01AJXAI.49.9.A09.1.454.CMB.1.raw
  modified_base (306)..(306): a, c, t, g, unknown or other
  misc_feature (306)..(306): n is a, c, g, or t
  modified_base (495)..(495): a, c, t, g, unknown or other
  misc_feature (495)..(495): n is a, c, g, or t
  modified_base (570)..(570): a, c, t, g, unknown or other
  misc_feature (570)..(570): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgaggcaacaacattggtggtaaaggtgtgcactggtaccagcagaagccaggccaggcccctgtgttggtcgtcatgatgacagcgacccggcccncgagggactccctggagcgtactttttcgtggtcctccgaaagtcgtacggggaacaccggcccacccgtcgacccgtcgacgccgtaggggtaccgaacggccgggggtatagggaccggccgtaacttagtttacgtggtacgtaggggtgtaggggataggttggtaggtggtgtcgttcgtcggngcgtcgggaccgtgggtccaccgtcgtacggtcacgcccgaagccccaacccgctcgtccactcgttcctccccnccctctctctctcgctcg

SEQ ID NO: 57116 - DNA, 822 bp, Homo sapiens
  misc_feature: GYAE6OF01AZ829.49.9.A09.1.454.CMB.1.raw
tcagagtcgagagacacgaccggtgctcgatttagcgagacgcgcagggggcgtgggcctaaaggaagcagcactggtggtgcctcagccatggcctggaccgttctcctcctcggcctcctctctcactgcacagactctgtgtacctcctatgtgttgacgcagccacctcggtcgtccgtcggccccaggacacggaccgggccagggttttccctggtaggacggcgaaacacattgggtaggtaaaggtgtgcacgtggtaccagcagaacgccaggccacggccctggtgttggtcgtcatgatgacgacggccggaccggcctcgaagggtctcccgtgacgtcgttacttttcgtcggtacctacggaaacgtcgtacgggaaccgacccggacccgtaccccgtcggaacccgtcggaacggaccgggaacggggtaccgaaccggggtccgggtaagtcgggaaccgggtacccgtaatacgttacgttccgttacggtacgggtaagggttcgggttaagggggtaactttaaggggttaacggtttacgggtacggttcccggtttaccgggggttccgggggggtttacggtttacgggggaccggggtaaacgggggttacccgttaaagggttccgggttaacccgggttcgggtttaccggtaccggtaacccgtaccccgggtaagggtaccccggttccccggtaacccccggttccggttaccgttacccgttcccggttaccccgttcccccgtaacccccgttcgtttacccctccggtttacccgtacccgttacccggg

SEQ ID NO: 57117 - DNA, 950 bp, Homo sapiens
  misc_feature: GYAE6OF01C9HPH.49.9.A09.1.454.CMB.1.raw
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtcgacctcctatgtgttgacgcacgccctacccgtcggtcgtccggtccggaccccgaggaccacggaccggaccgtacgggttttccccgtgggtacggacgggaccaaaaccgtaacgtaggtttaggggtaaggggttaaaagggttggtcggtacctacggttaccgggtaaccgacggacgaacggaacggcccgacgggacccgaccgggtccccgttgggttcgggtttcgggtccgtaccgtagttaggacgtacggaaccgaccggcccgggaccccgtacccgtacggacggtccctaccgaggtcgtacgtttactttccggcggtacctaccgtaacggtcggtaaccgggtaacccgcccgtaccccgtacccgtaccggtaccgtacgaacgggtcgggtaacggggtaccggggaacggggtacccggggtagttaacccggggaacccggtaccgttaaaccgtttaaggttacgttccgggttacggttaccgggttaggggttagggttaagggtaagtttaacgggtaacggttggttccgttaccgggttttccgggggttaccgggggttgggtttacccggggacggggttaaccggtaaccgggttacgggttccggttaccgggtttccgggttcggtaaccggtaacccgtacccgggtaaccgggtccccgttaccccgggtcccccggttacgggttaccccttcccgtttccccggttacccccgttaccccccgttaccccgttcccgtaacccgtttcccttaccggtacccgttccccggg

SEQ ID NO: 57118 - DNA, 947 bp, Homo sapiens
  misc_feature: GYAE6OF01EEK0P.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctctatgtgttgacgcacgccacccgtcggtcgtccgtcggccccaggacagaccggcctacggtttcccgtgtggagggacaaacaacgtagttgggtagggtaaaggtgtagcacgtggtaaccagcaagaacgccgaggccacggccctgtgttggtcgtcatgatgacaggccgacccggcctacggagggtacctcccgtagacgtacgttacgttttccgcggtaccctaccgtaacggtcggttacgggaaaccgtacccgggcccctaaacccgtccgggaaccccggttacgaacggaccgggtaaccgggggttaaccgggaaacggggtccccggggggtaagttacggggaacccggggttaaccccgggtaacgttaaaactttcgggtttaccgttacgggttaaccgggttaagggggtttacgggttacgggggttaaaggttttaagggggttacgggttttaaggggtttccggggtttaccgggtttcgggttttacccggggtttaacggggtaaccggggttccggttaacccgggggggtaaccccgggttaaccgggggtacccccggtttaaaccccggggttcccgggttaacgggttacccgggaaaccgggttaaccccccgggaaaacccggggtaaaccccccccgtaaaccccccgttcgttaaccgggttaaccccgtcccgtttaacccccggttaccccgtttaaccccccccgtaccccccgttcccgtttacccctttccccgtttccgcccccggtttaaaccccggg

SEQ ID NO: 57119 - DNA, 840 bp, Homo sapiens
  misc_feature: GYAE6OF01CQIAH.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcacgccaccctcggtgtccgtcggccccgaggacgacgacggcctacggtttcccgtgtggacgggaccgaaacaaccgtagttggtagggtaaaaggtggtgccacgtcggtaccagcgaagaaacgccgacggcccgacggccccgttggtcgttggtccgtccatgatgacacgccggaccggcccgtacgacggactcccgtagacgtcgttacttttcgtcggtcctaccgtaacgtaccggtacgggaaaccgacccgggacccctacccgttacgacccggttacgacgggtaccgtaacgggggtaccggaaacggggccggggtaacgtacgggtaccgggacccggtaacgttaagtaacgttcgttacggtacggtaaggggtttcgggttaggggaagtttaacgggttaacggttcgggttacgttcggttttcccggggttccggggggtttaacgggtttccgggggtaaccggggtacggggtaacccgtaaggggtttaccggttaacccgggtttcgggttcgggtaccgtaccggtacccggtaaaccgggtccgttaccccgggtcccccggttacgggtacccgtacccgtttcccgtttaccccggttccccccgttcccttaccccttcccgtttcccgtcccgttccggttacccgg

SEQ ID NO: 57120 - DNA, 688 bp, Homo sapiens
  misc_feature: GYAE6OF01A6NK5.49.9.A09.1.454.CMB.1.raw
  modified_base (367)..(367): a, c, t, g, unknown or other
  misc_feature (367)..(367): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgaggcaacaacattggtggtaaaggtgtgcacgtggtaccagcagaagccaggccacggcccctgtgttggtcgtccatgatgacagcgacccggccctacgaggactcccgtgacgtcgtattttcgtagggcctaccaacgtcgtaggggaaccnccggacccaccctcgaccgtcgagcgacgggtcgaaggccgggatcggacggcccgaattataactctcggtacaagggttggtacgggaataggttagtagtcgtaccgtttcgggtttccgggggtgttaccggggcggtaacggggtaccgtaagggtttccggacccggtttcggttagggtccgaccgggtccccggtaaagggcccgttccccggacccccccgttgggttcccgtaacccgtttccccgttccgggtttcccccccgtccccttaccccgtttccgttccccgttaccgtcccggttaccccgg

SEQ ID NO: 57121 - DNA, 726 bp, Homo sapiens
  misc_feature: GYAE6OF01EA5PJ.49.9.A09.1.454.CMB.1.raw
  modified_base (225)..(225): a, c, t, g, unknown or other
  misc_feature (225)..(225): n is a, c, g, or t
tcagagtcgagagacacgaccggtgctcgatttagcgagacgcgcaggggctgggcctaaggaagcagcactggtggtgcctcagccatggcctggacccgttctcctcctcggcctcctctctcactgcacagactctgtcgacctctatgtgttgacgcacgccctacccgtcgggtcgtcccgtcggccccgaggacacggaccggccgtacggttttcccnggtcggacgggacaaacaactgttgggtaggtaaaggtgtgctacgtggtaccagcaagaacgccgacggccgacggtcccctggttcggttcggtcgtccagtgagtcgacgacggccggacccggcccgtacggacgggtacctcccgtaggacgtacgttacgttttcgcggtcctaccgtacggttcggtacggaaccgaccggcctacccgtcgaaccgtcacggacggaacggggtaccggaacgggtccgggagtacgggacggtacccgtaactagtcgttacgtggtacggcgggttgggtacgtaggttagtaggtagtcggtcgttccggggttccggggtggtccgggtacgggacggtaaccggttaggttacccgtaccggttccggtacggtaccgacggtacccggaggtcccggtccggtcccgtggtaccctccgttccgttccccgtccccgtcccttccgtaccgtccttccgtcgtaccg

SEQ ID NO: 57122 - DNA, 804 bp, Homo sapiens
  misc_feature: GYAE6OF01BG3DB.49.9.A09.1.454.CMB.1.raw
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtgacctcctatgtgttgacgcagcccaccctcggtcgtccgtcggccccaggacagacggcctacggtttccctggtgacgggcaacaactagttggtaggtaaaggtgtcgctacgtcggtaccagcgagaacgccaggccacggtccctggttcggttcggtcgtccagtgagtcgacgacggccgaccggcccttacggacgggtacctcccgtagtacggtcgttaacgtttttcgcgggtactaccgtaaacggttccgtaacgggggtaaaccaccggggtaccctaccccgtacggtacccgttaccgacggtaccggtacgggggtaccggaacgggtaccggggtacgtacgggaacgggtacccgtaacgtttaacgtacgttacgtacggttacggtacgggttaggttaggggtaaggtttagggttaacggtttaggttcggtaccggtttccgggttccgggggttggttaccgggacgggtaacggggtaccgttaaggtttcgggtacccggtttcggttacgggtacccgtacggaccccgtaacggtcccgttaccgggtccccccgtttacgggtaccgttacccgttcccgttaccgggttcccccctcccgtttccctaccccgttacgtcccgttcggtacccg

SEQ ID NO: 57123 - DNA, 683 bp, Homo sapiens
  misc_feature: GYAE6OF01BT8B4.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctggtgtccgtcggccccaggacagacggcctaggtttccctgtgagggacaacaacagttggtaggtaaaggtgtgctacgtggtaccagcaagaacgccaggccacggtcccctgtgttcggtcatccatgatgacagccgaccggccctcgagggtactcccgtagagtcgtattttctcggtcctcgaacgtcgtagggaaacctacggcccaccgtacgacccgtgaacgcggtaacgggtacggaacgggtccggggtaatcggacggtaccgaacttacgtagtactacggttacgagggttcggtagggagttaagtaggttaggtagttccgttaccgggtttcgggggtcggttacggggcgggaacgggtaaccgttaagggttcgtaccgggttacggttcggtacctaccgggtacccgtaacggtccgtaccggtcccccgtcggttccaccgtacccgttcccgttaccccctacccttccctttcctccgttcctaccgg

SEQ ID NO: 57124 - DNA, 772 bp, Homo sapiens
  misc_feature: GYAE6OF01C6YQU.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcgcctcctctctcactgcacagactctgtgacctcctatgtgttcgacgcagcccacccgtcggtcgttcccgtcgggcccccaggaccgacgaccggccgtacggtttcccgtggtggacgggcaaaccaactaggtttgggtaggtaaaggtcgtagctaacgtgggtaccagacaagaacgccgacggccgaccggcccttaggtgttcggtcgtccagtgatagacgcgcccgaccggccctccgaagggtcctcccgaggcgtacgttattttccgcggtcctaccgaacgttccggtaacggtaaccgaccgggtacccctacccgtacgaccgtcgacgaccggtagggtaccgaacgggccgggtaagcggaccggtaccggaattaagtacgtacgttacggtcggtagggttgggtagggttaagttaggttaaggtacggttacggttccggttaccggggttcgggttcgggttcgggaacgggtaccggtaaccgggttacggtacgggttacccggttacggttacggggtccctaccgggtaccccgttaggggcccgttacccggtcccccggtgtaaccctccggttcccgttacccgttccccctacccgtttcccgtttccctacggttccctcccggttacg

SEQ ID NO: 57125 - DNA, 702 bp, Homo sapiens
  misc_feature: GYAE6OF01DHIN5.49.9.A09.1.454.CMB.1.raw
  modified_base (302)..(302): a, c, t, g, unknown or other
  misc_feature (302)..(302): n is a, c, g, or t
  modified_base (326)..(326): a, c, t, g, unknown or other
  misc_feature (326)..(326): n is a, c, g, or t
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtgacctcctatgtgttgacgcagccaccctcggtgtccgtcggcccaggacagacggccacggttccctgtgagggacaacaactagttggtaggtaaaggtgttagctacgtaggtaccagcaagacgccaggccacggccctggtgttgtctcatgatgacngccgaccgccctgaggtctcccgngtacgcgttatttcgtggtacctacgacgttcggtacggtaaaccgccgccctaacccgtcgtacccgtacgaggtccgaacggggtacggaacggccgggggaatacgggaccggaccgttaacttacgtacgttcgttaggtacggttacgggttggtaacggggtatttagggtaagttggtcggtaccgtttccgggtttaccgggggttgtaccggggacggggtaacggtaaccgtaaggttccggtacccgtttcgggttcggaccgtaccggtaccgacggtccgtccccgtaccccggttggtaccttacccgttccgttacccgttacccccttacccttccgttacctccgtcccgtccgtaccg

SEQ ID NO: 57126 - DNA, 813 bp, Homo sapiens
  misc_feature: GYAE6OF01B5BVZ.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccgtcggtgtccgtcggcccaggacagacggcctaggttccctggtcgagggacaaacaactagttcggtaggtaaagctgtgcacgtcggtaccagcaaggaacgccgtaggccacggtcccctggtggttcggtcgtccatgatgacagccgaccggccctacgagggtactccccgtgacgtacgtattttcgtacggtccttacgaacggtcgtacggggaacctaccgggacccctacccgtacgtacccggtacgaacggacggtacggggtaaccgaaacgggggtcccggggggtaatcgggaaccgggtacccggtaaacttacggttaccgttcggttacggtacggtacggggttagggttacggggtaattagggtaacggttaggtcgggttacgttaccccggggtttcgggggggttacggtttccgggggaccggggtaggggtaaacccgtagggtttaccggggaacccggttttcgggttaccgggtccgtaaccgggtacccccgggtaaacgggtcccgtcccccgggttaccccgttaccccggggttcctaaaccccggttcccgtttacccgttacccccttaccccggttcccctttcgtccccgtttcgttaaacccccgg

SEQ ID NO: 57127 - DNA, 609 bp, Homo sapiens
  misc_feature: GYAE6OF01A7TC8.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggcccccaggacagaccggccacggtttccctgtgagggcaacaacagttggtggtaaaggtgtgcactggtaccagcagaagccaggccacggcccctgtgttggtcgtccatgatgacagccgacccggccctcgagggactccctgagcgtattttcgtcggtcctccgaagtcgtcggggaaacaccgggcccacccgtcgacccgtcgagcgaggggtccgaaaggcccggggatggacggccgacgtatatactgtcgtagggttgtgggataggtagtagtgccgttcgttccgggggtgttcgggcggtacgggacctaaggttcgaccgttcggttaggcgacgcccgtaaggccgtcggtcccccgttggtcctccgttcctaccgttccccacccttcctccctcttccgtccgtaccg

SEQ ID NO: 57128 - DNA, 731 bp, Homo sapiens
  misc_feature: GYAE6OF01A9O92.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgttgacgcagccacccgtcggtgtccgtcggccccaggacacgacggcctacggtttccctggtggagggacaaacaactagttgggtaggtaaaggtgtgcacgtacggtaccagcaagaacgccgacggccgacggtcccctggtggttcggtccgtccatgatgacgacggccggacccggcccgtcggacggtactcccgtgacggcgttacttttcgtggtcctaccgtaagttcggtacgggaaccgtaccggaccctaccccgtacggaccgtcgacgggaccggtaacgggggtaaccggaaacgggacccgggggtaatcggggacggtacccgtaacgttacgttacgttacgtggtacggagggttcgggtaggggtacgttaagggttagttaggtccggtcgtttccggggtttccgggggttcggtcggggacgggtacgggtaccgtaacggttcggtaccggttcggtcggtaccgacgtaccggacgtcccgtccgtccccgttcggtcctccgttccgttcccgttccccgtccccttcccttcctcctccgtccgtccg

SEQ ID NO: 57129 - DNA, 772 bp, Homo sapiens
  misc_feature: GYAE6OF01CL3EZ.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcacgcccaccctcggtcgtccgtcggcccccaggacacggaccggccgtacggtttccctggtggacgggacaaacaacgtagttgggtaggtaaaggtgtgcacgtacggtaccagacagaacgccgacggccgacggtcccctggtggttcggtcactccagtgagtcgacgacggacccggacccggcccgtcgacgggtactcccgtaggacgtcgttattttcgcggtcctaccgaagttccggtaacgggaacccgaccggtacccctacccgtcggacccgtacgaacggccggtaacgggtaccgggaacgggacccgggggtagtacgggaccggtacccgtaacgttaacgtaacgttcgtacggtcggtacgggtggttaacgggtaagttaagggtacggttaggttacggtccggttttccggggttccggggggttacggtttacccgggggacgggtaaccggggtaccgttaacgggttccggtaacccgggttcgggttcggaccgtacgacccgtacggtccgtcccggtcccccgtacggtccctaccgtccgttcccgtccccgtccccttaccttcccgtccgtccgtcccg

SEQ ID NO: 57130 - DNA, 838 bp, Homo sapiens
  misc_feature: GYAE6OF01DL2DW.49.9.A09.1.454.CMB.1.raw
  modified_base (274)..(274): a, c, t, g, unknown or other
  misc_feature (274)..(274): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgttgacgcagcccaccctcggtcgtccgtcggccccaggaccagaccggcctacggtttccctgtgagggcaaacaactagttggtaggtaaaaggtgtcgctacgtggtaccagcagaanccgaggccacggtcccctggtgttggtccgtccatgatgacgcgccgaccggcccgtagacgggtacctccgtaggacgtcgttactttcgtcggtacctaccgaaaggttccgacggggtaaaccgacccggtacccgtaaccccggttccgggtaaccgtacggaacggtaccgggtaacggggtaaccgggaaaccggggtaccgggggtaagtacgggaacccggaccgttaaaccttaaggttacttaccggttacggtaccgggtaggggtttacgggtaacggggtaacgtttaagggttacggttaaggttccggttcccgggttttacccggggtttccggggggtttacgtttcccgggggaccggggtaaccgggtaaacccgttacgggttacgggttaccccggtttagggttccgggtaaccgacccgggtacccgaacggtccccgttcccgtaaccccccgggttcggttacccctccggtttcccgttccccggtaccccccgttcccttccccgtttcccgtttcccttccgtcccggttacccgg

SEQ ID NO: 57131 - DNA, 654 bp, Homo sapiens
  misc_feature: GYAE6OF01ASLTB.49.9.A09.1.454.CMB.1.raw
  modified_base (442)..(442): a, c, t, g, unknown or other
  misc_feature (442)..(442): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcctaggtttccctgtgaggcaacaacagttgggtaggtaaaggtgtgcactggtaccagcagaagccaggccaggcccctgtgttggtcgtccatgatgacaggccgacccggccctacgagggtactcccgtagacggcgtacttcgtcgtcggccttccacgcctcgaacgggtaccaaacgtacgtacctaccgttcgaccctatcgaggtcggacggtcccggaccgaggtacgggaacggngggtctacggtaacttacgttacgtcgtacgacggtccgacgaacgacgacgccgtaggtcgtacgtagttacgtggttacggttcggttacgggcggggtacggacgttaccgcgtaccggtacccggttccggttaggaccgtacccgacccggtaacggcccgttacccggtccccccgtaggtacccctacgttcccggttacccccg

SEQ ID NO: 57132 - DNA, 801 bp, Homo sapiens
  misc_feature: GYAE6OF01AQ2PV.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgttgacgcacgccacccgtcggtcgtcccgtcggccccaggacgacggtaccggccgtacggtttcccgtggtggacggacaaacctaacgtagttagggtaaggttaaaggtcgtacgactacgttacggtaaccagaccgaaggaacgccgaacggcccgtaaccgggtccccgttggttcggtttcggtaccgtaccgtaagtcggtacgtacggaccgacgggtcccggaaccccggtcccgtacggaacgggtaccttcccggtaaggtacgttccgtttaacgttttccgacggtaccttaaccggtaacggttaccgaacggggaaacccgtaccccgggtaccctaaccccggtacggtacccggtacggaaccgggacgggtaaccggggaaccgaaccggggaccgggtaagtaccgggaaccggtacctaagttacgtacgttcgtacggtaacgtgggttacggtaagtagttaacggtgtacggtcgtacggtttcgggtacgggttgtaccgggacggtacggtacgttaggtcggtcgttcggtcgacggccaccggtcggcctcccggtccgtaccgtctcccgttcggtccccctcccgtacccttccgttacttaccgtcggtcctccgg

SEQ ID NO: 57133 - DNA, 753 bp, Homo sapiens
  misc_feature: GYAE6OF01EJLB8.49.9.A09.1.454.CMB.1.raw
tcagagtcgagagacacgaccggtgctcgatttagcgagacgcgcgaggggctgggcctaaaggaagcagcactggtggtgcctcagccatggcctggaccgttctcctcctcggcctcctctctcactgcacagactctgtcgacctcctagtgtgtgacgcacgccaccgtcggtcgtccgtcggcccaggacacgaccggccgtacggtttcccgtggtggacggacaaactaacgtagttgggtaagggtaaaggtgtagcacgtaggaccagcaagacgcgacggccgacggcctgttgttcggctccgagtgagtcgacgaccggccggacccggccgtacggacggtcctaccgtagtacgtcgtttatttcgcgtacctacgacgtccgaacggaccgaccgacctaccgtcggtaccgcgacgacggtacgggtacgacgggacggggtatacgggacgtaccggtaatagttacgtcgttagggtaccggtagggttgggtacggtaagttagggtaacgttcggtcgggtccggttttcgggggttccggggttggtaccggggacggggtaacgggacccgtttaaggtccgggttaccgtttcggggttacgtacccgggtcggtaacccgggtaccggtccccgttccccggccccgggttacgtccgttaccccttcccggtttacccccgttcccccgttacccgttccttacccgttccgtcgttcccggtacccg

SEQ ID NO: 57134 - DNA, 701 bp, Homo sapiens
  misc_feature: GYAE6OF01ALEGM.49.9.A09.1.454.CMB.1.raw
  modified_base (355)..(355): a, c, t, g, unknown or other
  misc_feature (355)..(355): n is a, c, g, or t
  modified_base (390)..(390): a, c, t, g, unknown or other
  misc_feature (390)..(390): n is a, c, g, or t
  modified_base (623)..(623): a, c, t, g, unknown or other
  misc_feature (623)..(623): n is a, c, g, or t
tcagagtcgagagacacgaccggtgctcgatttagcgagacgcgcgaggggctgggcctaaggaagcagcactggtggtgcctcagccatggcctggaccgttctcctcctcggcctcctctctcactgcacagactctgtcgacctccgtatgtgttcgacgctagcccacccgtcggttgtccgtacggccccaggacaggaccggccgtacggtttcccgtgtggacgggccaaacactagttggtaggtaaaggtgtcgctacgttcggtaccaggacgtagaaacgcccgaacggcccgacgggtccccctggttcggttacgggttccgtccagttcgagttcgaacgngtccggacccggcccgtacgacggggacttcccgngtaacgtcgttacgttttcgacggtacctacgtaaacgtcggtaacgggtaaccgaccgcccacccgtacgaccgtgacgtcggagggtaccgaagccgggatggaccgcgaagtactacgttgacgtgagggtgagggtataggtagtctcggtcgttcgggttccgggtgttccgggacgggacggttacgtaggttaccggtcggtggttacggtaccgcggtaacccgnggtcccgtacccgtccccgtacggtacctcgtacccgtccgttccccggtcccttaccctcgtccttccgcggttccg

SEQ ID NO: 57135 - DNA, 784 bp, Homo sapiens
  misc_feature: GYAE6OF01C45DE.49.9.A09.1.454.CMB.1.raw
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (356)..(356): a, c, t, g, unknown or other
  misc_feature (356)..(356): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatggtgttgacgcacgcccacccgtcggtcgtccggtcggccccaggacacggaccggcctacggtttcccgtggtaggaggaccaaacgaactaggttagggtaggtaaacggtgtcgctacgtcggaccagcaaggaacgcgacggccacggccctagtcgttacggctcagngatgacnggccgaccggccctcggacggtacncccgtggacgtcttagtttccgtcggtctaccgaggttcgtacgggtaaccaccgggtacccacccgttacgggacccttaccgacgggtacgacgggggttaccggaaacggggcccggggtagtacgggtaccgggaccgtaacgttaacgtcgttcgtacggtacggtaggggttcggtaggggtaacgtttgggtaagttacggtcgggttaccggtttccggggtttccgggggggttacgttccggggaccgggggtaacgggtaccgtaagggtttcgggaccgggttacgggttcggaccgtacccgggacccggtaacggtccgtaccccgggtcccccgttacgggtaccctcccggtttcccggttcccttaccccgttacccctttcccgttctacccgttcgtaccgtacccggg

SEQ ID NO: 57136 - DNA, 835 bp, Homo sapiens
  misc_feature: GYAE6OF01C52NY.49.9.A09.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctctatgtgtcgacgcacgcccacccgtcggtcgtccgccggacccgaggacaggaccggcctaggttccngtggacggacaaactactgttaggtagggtaaagtgngcacgtcggaaccaggcaagacgccgaggccacggtccctgttcggttcgtcgtcagtgactacggacgtaccggaccggacccgtccgtacggacgggtacctacccggtagggacgttccgttaacgttttcggcggtacccgttaccggtaaacggttccggtaaccggggaaacccgtccccggtaacccctacccggttaaccggtacccggttaaccgaacgggtcccgggtaaacgggggttaccggaaaccgggggtcccggggtaaggtacccgggtaaccgggtacccggttaaccgtaacgttaccggttacggttaccgggtacgggtaaaggggtttcggggtaagggtaacggtttaggtacgggttacgttaccgggtccgggttttcgggggttaccggggttaccggggttaccgggacgggggtaaccggtaaccgttacgggttaccggtccggtttacggtcggtacccgaccggtaccgtaccggtccgtaccccggtccggttccgtactcccgttccgtcccgttaccccgtcccttccttactcccgtcgtacccgtcg

SEQ ID NO: 57137 - DNA, 570 bp, Homo sapiens
  misc_feature: GYAE6OF01B6WD9.49.9.A09.1.454.CMB.1.raw
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
tcagagtcgagagacacgaccggtgctcgatttagcgagacgcgcaggggctgggcctaaggaagcagcactggtggtgcctcagccatggcctggaccgttctcctcctcgcctcctctctcactgcacagactctgtgacctcctatgtgttgacgcagccaccctcggtgtccgtggccccaggacagacggcctaggtttccctgtgagggcaaacaacagttggtaggtaaaggtgtgcacgtggtaccagacagaagccacggccacggccctgtgtggtcgtccatgatgacagcgacccggccctcgagggactcccnggacgcgtatttcgnggctccagtcgngggaacacggacctacccgtacgaccgtcagcgagggtcgacggcgggagtggacggaccgagtatactcgtgtcgaggttggaggtataggtagtagtcgtcgttcgttccggggtgttcggcgggtaggaccgtagttcgcggtgtcggtcgagcccgaggccgtcgccccgtgtcctcgttcctccgttcccgccctcgttcctcgtctccgtc

SEQ ID NO: 57138 - DNA, 837 bp, Homo sapiens
  misc_feature: GYAE6OF01DNXPT.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcgccctcctctctcactgcacagactctgtcgacctcctatgtgttgaccgcacgcccaccctcggtgtcccgtcggccccaggacacgacggcctacggttccctgtggaggcaacactagttggtaggtaaaggtgtacgctacgtacggtaccagacgaacgaacggccgacggaccgaccgggtccccttggttggtttcggtccgtactagtgacgtcgacgacggccggaccggtccccgtggacgggtaccctaccgtcggtacgtaccgtttacgttttccgtcgggaccttaccgtaacggttaccggtaccggggaaacccgtacccgggaccccctaaccccggttaccgggtaaccccgttaccgaccgggtaccgggtaaccgggggttaaccgggaaacggggaaccccgggggtaacgttcggggaacccgggtacccggtaaaccgtttacgtaacggttcccgtagggttaccggtaaggggtttcggggtaacggggttattaaacggggttaggttacggttaccggttcccgggttttaccggggtttcgggggggtttcgggtacggggaccggggttaaccggttaccggtacgggtttcgggacccggtttggttcgacgacccgtccggaacgtccgtcccgccccgttgacccttcgtcccgttaccgtccccctccttacccgtccttccgccgtcgtccg

SEQ ID NO: 57139 - DNA, 173 bp, Homo sapiens
  misc_feature: GYAE6OF01A6JCF.49.9.A09.1.454.CMB.1.raw
  modified_base (157)..(157): a, c, t, g, unknown or other
  misc_feature (157)..(157): n is a, c, g, or t
  modified_base (163)..(173): a, c, t, g, unknown or other
  misc_feature (163)..(173): n is a, c, g, or t
tcagagtcgagagacacgaccggtgctcgatttagcgagacgcgcagggcacgaccggtgctcgatttagtcacgcgagaaagggaaagggggctggccctgacgtgttctgttcccaccctcctctctctcgactctgagcgggctaggcaaggcncatagnnnnnnnnnnn

SEQ ID NO: 57140 - DNA, 193 bp, Homo sapiens
  misc_feature: GYAE6OF01EDTAX.49.9.A09.1.454.CMB.1.raw
  modified_base (185)..(185): a, c, t, g, unknown or other
  misc_feature (185)..(185): n is a, c, g, or t
  modified_base (189)..(193): a, c, t, g, unknown or other
  misc_feature (189)..(193): n is a, c, g, or t
tcagagtcgagagacacgaccggtgctcgatttagcgagacgcgcagggcacgaccggtgctcgatttagctctacgctcagggcacgaccggtgctcgatttagcacgcgagaaagggaaggggctggcctgacgtgtttctgttcccgcctcctctctctcgactctgagcggctggcaggcnatgnnnnn

SEQ ID NO: 57141 - DNA, 788 bp, Homo sapiens
  misc_feature: GYAE6OF01ACWCQ.49.9.A09.1.454.CMB.1.raw
  modified_base (208)..(208): a, c, t, g, unknown or other
  misc_feature (208)..(208): n is a, c, g, or t
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtgacctcctatgtgttgacgcagccaccctggtgtccgtggccccaggacaggacggcctaggtttcccngtgagggcaaactaacagttgggtaggtaaaggtgtgacacgtggtaccagcgagaacgccgacggccaggccctggtgttcggtcgtccatgactgacgagccgaccggccctcgacgggtactcccgtgacgcgtattttcgcggctaccgaagtcgtacgggaacaccggccctacccgtcgaccgtcgaacgtcgtacggggtacggaacgggccgggggtatcgggacggacccgtaacgttaattacgttccggtaggttacgacggggtttaggtacggggtaatttacgggttaggttacggttccggttcccggtttcggggttttaccgggggggttacggttccgggggtaaccggggtaacggggtacccgtttaaaggggtttcccgggtaaccggtttccggggtttagggtaccctaacccggggtccccggtaaaacggggtccccgttacccccgggtcccccccggtttcggttaccctacccggtttccccgttacccggtttaccccccgtacccccgtttaccccgttcccttcccggttcccgttaccggttacccgg

SEQ ID NO: 57142 - DNA, 664 bp, Homo sapiens
  misc_feature: GYAE6OF01DK32L.49.9.A09.1.454.CMB.1.raw
  modified_base (372)..(372): a, c, t, g, unknown or other
  misc_feature (372)..(372): n is a, c, g, or t
tcagagtcgagagacacgaccggtgctcgatttagcgagacgcgcaggggctgggcctaaggaagcagcactggtggtgcctcagccatggcctggaccgttctcctcctcgcctcctctctcactgcacagactctgtgacctcctatgtgttgacgcagccaacctcggtgtccgtcggccccaggacagacgcctacggtttccctgtgaggcaacaacagttggtaggtaaaggtgtgcacgtcggtaccagcaagaagccgaggccgacggcccctgtgttggtcgtccatgatgacagccgaccggccctcgagggactcccgtgacgcgtactttcgtcggcctaccgaagtcgtacgggaaccnccggcccacccgtcgaccgtcgacgcgacgggtacgaacgggaccggggtatacggacggcccgtacgtagtacgtcgtgtacgtagggtcggtagggtattaggtagttacgtgtaccgtttccggttcgggggttcgttacgggcgggtaacggaccgttaacggttcggtaccgttcggttcggtaccgacggtaccccgtaaggtcccgtcccggtcccccgttcggtcctaccgttcccgttcccgttccccctaccccgttccctaccttcctccgtccgtacccg

SEQ ID NO: 57143 - DNA, 793 bp, Homo sapiens
  misc_feature: GYAE6OF01D22EA.49.9.A09.1.454.CMB.1.raw
  modified_base (215)..(215): a, c, t, g, unknown or other
  misc_feature (215)..(215): n is a, c, g, or t
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctctatgtgttgacgcacgcccaccgtcggtcgtccgtcggcccaggacacggaccggcgtaggtttcccgngtaggagggacaaactaacgtagttagggtaggtaaaagggttcgtgaccgacgtcggtaaccaaggccaaggaacgaccgacgggccgtaacggtccccgttgggttggtttcggtccgtaccgaagttggaaccgttaggaaccgacggcccggaccccgtcccgtaggacggggtacttcccggaggtacgccgtttacgttttccggacctaccgaaacggttccggaacggaaccnccggtccctaaccgtcgacccgganacggaggtacggtaggaacggcggggatacggaacggtacccgtaatacgtacgtcggttacgtacggtaggtggtacgggaagttaggttacgttaggttacgtacggtttccggggtttacggggtccgggtttacgggccgggtaacggggtaaaccttagggtaaccggtccggtttacggttggtaccgacgtaacccggtacggtccccgtaccggtacccccggttcggtacctccgttccgttacccccggttacccctcccccgtaccggtttccaaccccttcggtacccgtaccgttcggg

SEQ ID NO: 57144 - DNA, 770 bp, Homo sapiens
  misc_feature: GYAE6OF01C4LAU.49.9.A09.1.454.CMB.1.raw
  modified_base (228)..(228): a, c, t, g, unknown or other
  misc_feature (228)..(228): n is a, c, g, or t
  modified_base (440)..(440): a, c, t, g, unknown or other
  misc_feature (440)..(440): n is a, c, g, or t
  modified_base (544)..(544): a, c, t, g, unknown or other
  misc_feature (544)..(544): n is a, c, g, or t
tcagagtcgagagacacgaccggtgctcgatttagcgagacgcgcgaggggctgggcctaaaggaagcagcacgtggtggtgcctcagcccatggcctggaccgttctcctcctccgcctcctctctcactgcacacgtctctgtcgacctcctagtgtgttgcgcacgccctacccgtcggtcgtccgtccggccccgaggacgacgaccggccgtaggtttcccgnggtggacgggacaacctaacgtagtttgggtaggtaaaggtgtagacgtacgtcgggtaccagacgaaggaccgccgacggcccgtaccggtcccgttaggtcggtttcgggtccgtacctagtcgtagtcggacgacggtcccggaccggtcccgtacggacggtctcccgtgacgtcgttacttcgcggtctacgaacgtcgacggaacncccgtacccgacgtccgacgcgtacggccggtagggaaccggccgggacgggtagtacggaccggacgtacgttagtacgttcggtgtacggtagggttacggngtaacggttagtacggtcggtggttacccggttcgggtttccggggttacggtccggggaaggggtaaccggtaccgttaacgggtcccgggtacgggtttccggttacggtacgtacccgggcccgtacggtccccgtcccggtaccccgttggtacccgttccgttcccgttacccccgttaccccttccccgttccgttcccgtcccttccgtccgtacccgg

SEQ ID NO: 57145 - DNA, 807 bp, Homo sapiens
  misc_feature: GYAE6OF01CB9LH.49.9.A09.1.454.CMB.1.raw
  modified_base (209)..(209): a, c, t, g, unknown or other
  misc_feature (209)..(209): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccaccctcggtgtccgtggccccaggacagacggccaggtttcccngtgaggcaaacaacattggtagggtaaaggtgtgcactcgggtaccagtcaggaacgccgaggccacggcccctggttgttcggttccgtccatgatggacacggccggacccggccctcgacgggactccctggacgtcgtacttttcgcggtcctaccgtaagtcgtagggaaccacggcccacccgtcgacccgtcacgcgaacggggtaccgaaacgggccggggtatcgggaacggtcccgtaattaatcgttactggtcgtaggggtaggttaggggtaagttaggttaacggtggttacgcccggtttcggggttttacccgggggggttggtttacccggggacgggggtaaccggggtaacccgttaagggtttcccgggtaacccgggttttacgggttccggttaaccgggaacccgggtaaccccggtaaacggggtccccgtttccccggttaaacccccccggttggggtttacccccgtaaccccggttttccgtttacccccggggttttaccccccctaacccccccttttaccccggttttccccgttccccgtttcccgtttcccgggtaaacccccgg

SEQ ID NO: 57146 - DNA, 663 bp, Homo sapiens
  misc_feature: GYAE6OF01EB2BF.49.9.A09.1.454.CMB.1.raw
  modified_base (208)..(208): a, c, t, g, unknown or other
  misc_feature (208)..(208): n is a, c, g, or t
  modified_base (370)..(370): a, c, t, g, unknown or other
  misc_feature (370)..(370): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggcccaggacagacggccaggtttcccngtgaggacaacaactagttggtaggtaaaggtcgtgctactaggtaccagccaagaagaccgaggacccgaaggcccccgttgtcggtttcggtccgtaccagtgatcggaacacggccgacccggccgtcgaggggtactcccgtgacgcgtacttttcgngcctacgaacgtcgtacgggaacaccggccaccgtcgaccgtcgacgtcgacgggtacgaacggccggggtaatcggacggtaccgacttaatacgtcgtgtacgtaggtcggttagggtacgttaaggtagtaggtcgcgtttcgggttccggggttcggttcgggacggacgggtaccgtaacgttcggtaccgggttcgttacgggtactacggaccgtaaacggccttcggacccccttcggtactacgttccgtctcccccgtacctccttacctcctcctcgtaccg

SEQ ID NO: 57147 - DNA, 839 bp, Homo sapiens
  misc_feature: GYAE6OF01CG5GL.49.9.A09.1.454.CMB.1.raw
  modified_base (219)..(219): a, c, t, g, unknown or other
  misc_feature (219)..(219): n is a, c, g, or t
tcagagtcgagagacacgaccggtgctcgatttagcgagacgcgcgaggggctgggcctaaggaagcagcactggtggtgcctcagccatggcctggaccgttctcctcctcggcctcctctctcactgcacagactctgtcgacctcctatgtgttgacgcacgcccaccgtcggtcgtccgtcggccccaggacacggaccggcctacggtttcccnggtaggacggacaacaactaggttaggtaggtaaaggtcgtgcgtacgtacggtacgagacgaagacgcgacggcgaccggtccccttggttcggtttcggtccgttaccgagtagtagtacgacgaacggccggaccccggtcctacggacgggtacttcccgtaggacgtacgtttacgttttcggacgttccgtaaccgtaacggttccggtaacgggaaacccgacccgggtaccccacccggttaccgggaaccgtcggaacgtacgggtaccggggtaacggaaaccggggtaccggggtacgtaacgggaaccgggtaccggtaaacgttacgttaacgtcggttacggaccggttaggggttaggtagggtaattaccgggtaaggttacggtcggttccggttcggggttccgggggttgtccgggggtacggtaacgggtaaccgtttaagggttacccggttacgggtttacggtacggtaaccgaccgggtaccgtacggtaccccgtcccggtacccccgtacggttacccgtccttacccgggttccccgttaccccccgtttccccttaaccgttcccgttaccgttcccgtcccggttacccgg

SEQ ID NO: 57148 - DNA, 553 bp, Homo sapiens
  misc_feature: GYAE6OF01CS3ZS.49.9.A09.1.454.CMB.1.raw
  modified_base (207)..(207): a, c, t, g, unknown or other
  misc_feature (207)..(207): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (474)..(474): a, c, t, g, unknown or other
  misc_feature (474)..(474): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggcccaggacagacggccaggtttcccngtgagggcaaacaacattggtggtaaaaggtgtgcactggtaccagcagaagccaggccaggcccctgtgttggtcgtcatgatgacngcgaccggcctcgacgggntcccgtagagcgtattttcnggctccaagtcgtagggaacacggtcccaccctgaacccgtcacggcaggggtacgaaaggccggggtataggagggccgaacgtaatactctgtacgaggtgtgggagtagtagtagtgctcgttccggggtgttcggnggacgggtaccagttcgacgtcgtgtcgtagccaaggctcgcccctgccactctccgttccaccctctctctctcgtac

SEQ ID NO: 57149 - DNA, 681 bp, Homo sapiens
  misc_feature: GYAE6OF01C64V2.49.9.A09.1.454.CMB.1.raw
  modified_base (367)..(367): a, c, t, g, unknown or other
  misc_feature (367)..(367): n is a, c, g, or t
  modified_base (408)..(408): a, c, t, g, unknown or other
  misc_feature (408)..(408): n is a, c, g, or t
tcagagtcgagagacacgaccggtgctcgatttagcgagacgcgcagggggctgggcctaaggaagcagcactggtggtgcctcagccatggcctggaccgttctcctcctcggcctcctctctcactgcacagactctgtgaccttcctatgtgttcgacgcacgcctaccctcggtcgtccgtcggccccaggacacgaccggccttacggtttccctgtggacggacaaacaactagttgggtaggtaaacggtgtcgctaacgtcggtaccagacaagacgccgacggccacgggtcccttggtgttcggtacgtccagtcgatcggacacggtcccgaccggccctacggaggtacctccgngaacgtcgtattttcgcggtctaccgtagtcgacgggaccnccggcctaacccgtcggtaccctagacgtacggcgggtaacggacggtacgggagtacgggacggaccgtacgttacgtacgtcgtagtaccggtagggtacggttgggtacgttaggtacggtacgttcggtcgttcgggttccgggggttacgtccgggacgggtaccggtacgttaggtaccggtccgttaggtcgtcggaccgtcgtacgtccgcccgtccgtcgtatccgttcgtcctcccgtacctccttacctccgtctcgtaacg

SEQ ID NO: 57150 - DNA, 721 bp, Homo sapiens
  misc_feature: GYAE6OF01CA0XR.49.9.A09.1.454.CMB.1.raw
  modified_base (191)..(191): a, c, t, g, unknown or other
  misc_feature (191)..(191): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacngacggccaggttccctgtgaggcaacaacagttggtaggtaaaggtgtgcacgtggtaccagcagaacgcgacggccacggcccctggtgtggtcgtccatgatgacacgccgaccggccctcgagggactccgtgacgcgttattttcgtcgcctaccgaaggtcgtagggaacaccggccctacccgtcggaccgtcgacgacggagggtacggaacgggccggggtagtacgggacggacccgtacgttaatacgttccgtacggttcggtaagggttcgggtaggggtaagttaacgggttaaggttacggttcgggtcccgggttttccggggtttccggggggggtttacggttcccgggggtaccggggggtaaccgggtacccggttaaagggtttccggtacccggtttcggttacggtacgtaccgacccggtaacgtccggtcccgtccccccgggttgtcccttcgttccttccccggttaccccctcccgttcctcccttcctccgtcccgtaccgg

SEQ ID NO: 57151 - DNA, 812 bp, Homo sapiens
  misc_feature: GYAE6OF01EN6A5.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccacccgtcggtcgtccggtcggcccgaggaccagaccggcctacggtttccctggtcggagggacaaacaactagttggtaggtaaaggtgtgcacgttaggtaccgagcgaaggaacgccgacggccgaccggtccccgttggttcggttcgggttccgtacctagtggtacgtacggaacgacggtcccgggaccccggtcccgtacggaacggggtacctcccggtaggacggtcgtttacttttccggacgtcctaccgtaagtccggtacggaaccggacccggacccacccgtcgtaccgcgaccgtcgggtaccgggtacggaacgggccggggtaacgtacgggaccggtacccgtaagttaacgttacgttcggtcgtacgggtacgggttaggtacggggttagttaagggttacggttaggtccgggttcgtttcccggggggtttccgggggttacgggttccggggaacggggtaacggtaacccgggttaaggttcccgggttaaccggttcgggttacggaccgtaccggacccgtaacggtcccgtccccggttccccgtcggttaccctcccggttccttccccggttacccctaccccgttccgttacccttccgtaccgtccggtaccg

SEQ ID NO: 57152 - DNA, 979 bp, Homo sapiens
  misc_feature: GYAE6OF01CURZS.49.9.A09.1.454.CMB.1.raw
tcagagtcgagagacacgaccggtgctcgatttagcgagacgcgcaggggcgtgggcctaaggaagcagcactggtggtgcctcagccatggcctggaccgttctcctcctcggcctcctctctcactgcacagactctgtcgtaccttaccttatgttgttcgacgcacgcccgtacccgtcggtcgtcccgtcggacccccgagggaaccacggaccgggtacccgttacggtttaccccgtggtaggaacgggtaccaaaaccgaacgtaggtttagggtaagggttaaaacggtggttgaccgtaaccgttcggaaaccaggacgaaacggaaccgaccgaacgggacccgtaaccgggtcccccgttggttacggtttaccgggtcccgtactaacggttacgaacgttaaccggaaccgaacggaccccggtacccgggtacccctaacgggtacggtaaccgttcccgtacggaacgttaacgttcgtttttacgacggtaccgtacgttaaccggtcgttaaacgggaacccgaccggccctaacccggtagacccgtacgaccggtaacgggtaacgggtaaccggaaacggggttccgggaagttcgggaaaccgggtccgttaaacgttacgtacggttcgttaaggacgggttagggtaacggtgggttaaaacgttagggttaacggaacggtttcggtacccgggtttcccgggttttacggggggtaccggttacggggtaaccgggggtaaccggtttaaaacccgggtggggtttaccggttaccgggttaccgggttaccgttacccggtaaacccggtaacccggggaccggttaccccgtaacccccgggttccccggttaacgggaccttaaacccccggttttcccggttccccccgtttaaacccctcccccgtttaaccgttcccgtttcccgtaacggtcccccgttaaacggg

SEQ ID NO: 57153 - DNA, 931 bp, Homo sapiens
  misc_feature: GYAE6OF01AQUO2.49.9.A09.1.454.CMB.1.raw
  modified_base (221)..(221): a, c, t, g, unknown or other
  misc_feature (221)..(221): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcacgcccaccctcgggtcgtccggtcggcccccaggacacggaccggcctacggtttcccgnggtggacgggacaacaactagttggtaggtaaaggtgtgcacgtcggtaccagcaagagccgaggccacgggcccctggttgttcggtccgtaccagtgatcggaacctacggcccggaccccggcccgtacggacggggtacctcccgtaggacgtaccgttacttttcggcggtacccttaccggtaaacggttccggtaacgggaaacccgacccggtacccctaaccccggttaccggtaacccggtaccgaaccgggtacgggaaaccgggggttaccgggaaacggggtaccccggggggtaagtaccggggtaaccgggtacccgtaaccgtttaacgttaacgtcccggtttaggttaccgggtaagggttaggggtacgggttaaaggttacgggtttacgggtacggttaccgggtttcccgggtttccgggggttttacccgggggggttacgggtttcccgggggacgggggttaaccgggggttaacccgttaaggggttttaccgggtaacccgggtttcgggtttacgggtaacccggaacccgggtaccccggtaaaccggggttccccgttaccccgggtcccccggtttaccgggtacccttaccccggttacccgtttccccccggttaccccccttacccccgggtttccctttacccggtcccccgtttcggttcccggttaaccccgg

SEQ ID NO: 57154 - DNA, 865 bp, Homo sapiens
  misc_feature: GYAE6OF01BEQYS.49.9.A09.1.454.CMB.1.raw
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtgacctcctatgtgttgacgcagcccacccgtcggtcgtccggtcggcccccagggaccaggaccggcctacgggtttcccctggtacggacgggccaaacgaactagttagggtaggtaaaggtgtcgcacgttggtaccagcagaacgccgaggcccacggtcccctaggtggtttcggtccgtacccagtacgagtacgacgacgccggacccggccctacggacggtactcccgtagacgtcgttacgttttacgcggtcctaccgtaaggttcgaacgggtaaccaccgggtaccctaccccggtcgtaacccggttccgaacggtccgaacgggggttaccggaaaccggggcccggggtaagttcgggaaccgggtacccgtacgttaacgttacgttcgttacggtacggtaagggttcggtaggggtaacgttaggttaacggtacgggtccggtaccggtttccggggtttacccggggggtttcggttaccggggtacccggggtaaacggggtaccccgttaacgggggtttaccggtacccgggtttaccggggtttaccgggaccggaccgggtaacccccggttaacggggtcccggttaccccgggccccccggtttacgggtaccccttcccggttccccgttccccgggttaaccccccgtacccccggtttcccttaccgtcccgttttcccgttcccggtaccccgg

SEQ ID NO: 57155 - DNA, 990 bp, Homo sapiens
  misc_feature: GYAE6OF01EKLLK.49.9.A09.1.454.CMB.1.raw
  modified_base (221)..(221): a, c, t, g, unknown or other
  misc_feature (221)..(221): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgttcgacgcacgcccacccgtcggtcgtccgtcggccccaggacacggaccggcctacggttttcccnggtaggaggacaaacaactagttgggtaggtaaggtgtgcacgtacggtaccagacgaagaacgccgacggcccacggccccgtggttgttcggttcgtccagtgatacgacgacggccggacccggccctacgacggtcctcccgtgacgtcgttacgttttcgcggtccctaccgtaacggtacggtacgggaacccgaccggacccgtacccgtaccggtaccgtacgacggcggtaacggggtacggaaccggggaccgggtaagtaccgggacggtaacccgttaacgttacgttacggttaccgttacgggttacgggtaagggttcgggttaaggggttaagtttaacgggttaaacgggttttcgggttaccggggtttcccgggtttttcccgggggggttttacccgggggggtttacgggggtttacccggggggttaaacccgggggtaaaccggggtttaaaccccggggtttaacggggtttacccgggggttaaccccggggttttaccgggtttacccggggttacccgggaaaaccccgggtttaaccccgggggtaaacccggttaccccccgggtttaccccccggggtttacccccccccgggtttaggggtttaacccccccttcccgggtttttacccccccggtttaccccccgggttttaccccccccctttaacccccccggtttcccccgttttaaccccgttttcccccgtttccccgggttaaccccgtttaaccccgggg

SEQ ID NO: 57156 - DNA, 731 bp, Homo sapiens
  misc_feature: GYAE6OF01A3T0N.49.9.A09.1.454.CMB.1.raw
  modified_base (217)..(217): a, c, t, g, unknown or other
  misc_feature (217)..(217): n is a, c, g, or t
  modified_base (328)..(328): a, c, t, g, unknown or other
  misc_feature (328)..(328): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtagtcgacgcacgcccaccgtcggtcgtccgcggccccgagacgacgccggacctacggtttccnggtgacggacaaacactgttagggtaggtaacggtgtacgcctagtacggtaacagacgagaacgccgacggccacggtccctggtgttacggctacagtagatcgaaccncggacccgaccccggtccctaggacggtacccttccgtagacgtcgtttacttttcggacgtaccctaccgtaagggttccacggggaaaccgtcccgtacccgacccgtcggtaacccctagtaacggcgggtaacgggagtaaccgggcggggtaancgggtaactacccgtaacgttnttaacgtacgttcgtacggtagggttaggtagggtaagtttaacggtagggttacgtcgggttaccggttttacgggggttccggggttcgggacggggtacgggaacggtaccgtaaggttccggtaacgttcggtacgacgcgacccggtagcccgtacccgtccccgtgacctccttcgcccctttacccgtccttaccttcgaccttccgggactcgg

SEQ ID NO: 57157 - DNA, 640 bp, Homo sapiens
  misc_feature: GYAE6OF01CCUGU.49.9.A09.1.454.CMB.1.raw
  modified_base (158)..(158): a, c, t, g, unknown or other
  misc_feature (158)..(158): n is a, c, g, or t
  modified_base (214)..(214): a, c, t, g, unknown or other
  misc_feature (214)..(214): n is a, c, g, or t
  modified_base (446)..(446): a, c, t, g, unknown or other
  misc_feature (446)..(446): n is a, c, g, or t
  modified_base (617)..(617): a, c, t, g, unknown or other
  misc_feature (617)..(617): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctctatgtgttgacncagccaccgtcggtgtccgtcggccccaggacaggaccggccgtacggttttcccnggtggagggacaaacaacgtagttgggtaggtaaaggtgtcgacacgtaggtaccagcaagacgccgacggtccgacggccctggtgttcggtctcatgatgacgacggccgaccggcccgtcggacggctcccgagacgtgttactttcgtcggtcctacgacgtccggtaacggaaccaccggccctaccgtcgaccgtcgacgcggacgggtacgaacgggtcgggtanacgggacggacctagtacgttatcggtagacgtgggtggtaggagttagagtagtcgtcgttcgggttcggggtacgtcgggacgggtacggtacgtaggttccgtcggttggtcgtacaccggtaccgaggtccgtaccgtccccgttgactccgtcctcccgttccccnccttcgtccttcgtcgtacgtcg

SEQ ID NO: 57158 - DNA, 847 bp, Homo sapiens
  misc_feature: GYAE6OF01BTB6I.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgtgacgcacgcccaccgtcggtcgtccggtcggccccaggacgacggaccggccgtacggtttccctggtggacgggacaaacaacgtagtttgggtaaggtaaaggtggtcgctacgtcggtaaccagacaaggaacgccgacggtccgacggtcccgttggttcgttcgggttccgtccagtcggtactacggacgacggcccggacccggccctacggacggtacctcccggtgacgtcgttacgtttcgcggtacttaccgaaacgttcggaacgggaacccgtaccgggacccctacccggtcggaacccgttcggaaccggtaccggtaacgggggttaaccggacggggacggggtagtacggggaccggtaccgtaacgtacgttcgttcgtacggtcggtagggttggtacgggttagtaagggttacggttacggtcggttccggtttccggggttacgggggttcgggttaccgggggacgggtaaccggggtaacgttaacggggtttaccggttacccgggttacgggttcgggtaaccggaccggtaccccggtaaacgggtcccggttaccccggtccccggtttacccggtacccgttcccggttacccgttcccccggttacccccggtttccccgttcccgttcccgttacccgttcccggttaccggttcccggg

SEQ ID NO: 57159 - DNA, 736 bp, Homo sapiens
  misc_feature: GYAE6OF01B91FQ.49.9.A09.1.454.CMB.1.raw
  modified_base (535)..(535): a, c, t, g, unknown or other
  misc_feature (535)..(535): n is a, c, g, or t
tcagagtcgagagacacgaccggtgctcgatttagcgagacgcgcaggggctgggcctaaaggaagcagcactggtggtgcctcagccatggcctggaccgttctcctcctcgcctcctctctcactgcacagactctgtgacctcctatgtgttgacgcacgccctacccgtcggttcgtccggtaccggccccgaaggaccgacggaccggtccgttacggtttcccgtggtggaacgggaccaaacgtaacgtagttgggttaaggtaaaggtgtgacctacgtacggtaccagcaacggaacgccgacggccacgggtcccttggttacggtttcggtaccgtaccgagtcggagtacgacgaacggtcccggacccggtccgacggacgggtctacccgtggtacgtacgtttctttccggtacggacctaaccgtaacggtcgtaacgggtaaccgccgccctaacccgtcgtaccgtcgacgtccggaggtacggaacgggtcgggtagccggacggacctactagtnttacggtgtacggtaggtgggtagtagtaggtggtagtcgtcggttacgggttcgggtacggtcgggacggacggtacgtaacggttcgtacggttcggacgtccgaacgaccgtacggtccgttacccggccccgttaggtacctccgggttacccttcccggtccccctaccttcccgtacctccctcgttcccgtccg

SEQ ID NO: 57160 - DNA, 715 bp, Homo sapiens
  misc_feature: GYAE6OF01CBDAG.49.9.A09.1.454.CMB.1.raw
tcagagtcgagagacacgaccggtgctcgatttagcgagacgcgcaggggctgggcctaaaggaagcagcactggtggtgcctcagccatggcctggaccgttctcctcctcggcctcctctctcactgcacagactctgtcgacctcctatgtagttgacgcacgcccacccgtcggtcgtccggtcggaccccgaggacacggaccggccgttacggtttcccgtggtaggacggaccaaacaactagttagggtaggtaaaggtgtgacacgtgtaccagacaggaacgccgaggtcccacggtccccttggttgttcggtaccgtcagtcgagtcgacgacggcccgcccggtcccgtacggacggacctcccgtgacgtacgtttacttttccgacggtcctaaccgtagtccggtaacggggaacccaccggtacccacccgtcggaccgtcgacgtacggacggtaccgggaacggcggggaagacggaacggtccgtaacgtaagtcgttacgtacgtaggtaggttggtagggtaagttagttaggtacgttcgtcggtttcgggttcggggtttggtccggggcgggaacgggtacgtagttaccggtacggttcgtacggtacgaccggtccgacgtccgtacccgtcccgttcggcctccgtccgttcccgcccgttccctcccgttctcctccgtcgtaccg

SEQ ID NO: 57161 - DNA, 735 bp, Homo sapiens
  misc_feature: GYAE6OF01A0JV8.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagaccggccaggtttccctggtgagggcaacaacagttggtaggtaaaggtgtggcacgtggtaccagcagaacgccgaggccacggcccctggtgttggtcgtccatgatgacacgccggacccggccctacgacgggactcccgtagacgtcgttattttccgtggacctaccgaaagtcggtacgggaacaccggcccaacccgtcgacccgtgacgaccggaggggtaccgaaacgggcccggggtaagtcgggaccgggccgaacttacgttagtccgttacggaggtagggtacgggtagggtaagttaggtacggttaaggtcgaattacgtaggtttagggttgggtttacggttaccggggacgggggtaacggaaccgtaacggttccgtaccgggtaccggttccggttaacggccgtaaccggaccccggtaacgggtccccgttcccggtaacccccccggttcggttaaccccgtcccgtttcccggttaccccgtttaccccccaccccgtttcccttaacccgttcccg

SEQ ID NO: 57162 - DNA, 840 bp, Homo sapiens
  misc_feature: GYAE6OF01BK8G1.49.9.A09.1.454.CMB.1.raw
tcagagtcgagagacacgaccggtgctcgatttagcgagacgcgcaggggctggggcctaaggaagcagcactggtggtgcctcagccatggcctggaccgttctcctcctcggcctcctctctcactgcacagactctgtgacctccttatgtgttgacgcacgcccacccgtcggtcgtccggtcggaccccaggacaggacggccgtacggtttccctggtggacggcaaacaactgttgggtaggtaaaggtgtgcacgtcggtaccgagcaagacgccgacggccgaccgtccgtggttcggttcggtctacgatagagtacgacgacggcccggacccggcccgtaggacgggtccttcccggtagacgttaccgtttacgttttccggtaccggtacccttaaccggtaacggttacggaacggggaaaccccggtaccccggacccgtaacccggtacgggtacccgtacggtaccgggtaaccggggtacggggtaaccgggaaccggggtaccgggtacgtcgggaacccggtaccgttaacgttacgttacgttccggttagggtacggtagggttacgggtaagggttaagttacggttaaggtcgggttccggttaccgggtttccgggggttttccggggtcggttaccggggaccgggttaaacgggtaccggtttacgggttccggtacccgggtttacgggtacggaccgtacccggacccgtaccggcccgttaccccgggtccccgtttacggtaccgtttccgttccgttacccccggttcccccgttcccgttcctaccctttcggtcccgttcgtccg

SEQ ID NO: 57163 - DNA, 741 bp, Homo sapiens
  misc_feature: GYAE6OF01BVKRP.49.9.A09.1.454.CMB.1.raw
  modified_base (220)..(220): a, c, t, g, unknown or other
  misc_feature (220)..(220): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctctatgtgttcgacgcacgcccacccgtcggtcgtcccgtcggccccaggacacgaccggcctacggtttcccgngtaggaggcaaacaactagttagggtagggtaaaggtgtcgctacgtacggtaccagacaaggaacgccgacggacccgacggtccccttggttcggttcggttccgtcctaggtacgataggaacgtaccgggcccggaccccggtcccgtacgggaacgggtcccgttacccgtggaaccggtaccgttcgttccttacggtcggtacctacccggaggtccttaccggaacgaccaaacgtacctcggtactacccggttacgaacctagtcgagggtacggacgggtccgaggacggacggaacggaggtcgtaagtaccttagttactcgtacgacgtcgtaactcgaacgtcggtacggtacggtacgtaccgtttccggttacggttacggttcgttaacgggtccggggaacgggtaaccggaaccgtacggtaccggtaccggtacctcgggtaccgtccggaccggtacccgtacgtccgcccgttccccgtcgtacccgtccttccccgg

SEQ ID NO: 57164 - DNA, 161 bp, Homo sapiens
  misc_feature: GYAE6OF02GZVWV.49.9.A09.1.454.CMB.1.raw
  modified_base (161)..(161): a, c, t, g, unknown or other
  misc_feature (161)..(161): n is a, c, g, or t
tcagagtcgagagacacgaccggtgctcgatttagcgagacgcgcagggcacgaccggtgctcgatttagtcacgcgagaaagggaaggggctggccctgacgtgtttctgttcccaccctcctctctctcgactctgagcgggctggcaaggcgcatagn

SEQ ID NO: 57165 - DNA, 177 bp, Homo sapiens
  misc_feature: GYAE6OF02J0RJV.49.9.A09.1.454.CMB.1.raw
  modified_base (168)..(177): a, c, t, g, unknown or other
  misc_feature (168)..(177): n is a, c, g, or t
tcagagtcgagagacacgaccggtgctcgatttagcgagacgcgcagggcacgaccggtgctcgatttagagagcgtcacagagagaaggcacgaccggtgctcgatttagctagtcactctgttccgcctctctctctcgactctgagcggctggcaggcgcatagnnnnnnnnnn

SEQ ID NO: 57166 - DNA, 164 bp, Homo sapiens
  misc_feature: GYAE6OF02HRDRG.49.9.A09.1.454.CMB.1.raw
  modified_base (162)..(164): a, c, t, g, unknown or other
  misc_feature (162)..(164): n is a, c, g, or t
tcagagtcgagagacacgaccggtgctcgatttagcgagacgcgcagggcacgaccggtgctcgatttagtcacgcgagaaagggaaaggggctggccctgacgtgtttctgttcccaccctcctctctctcgactctgagcgggctggcaaggcgcatagnnn

SEQ ID NO: 57167 - DNA, 147 bp, Homo sapiens
  misc_feature: GYAE6OF02FOFHP.49.9.A09.1.454.CMB.1.raw
  modified_base (147)..(147): a, c, t, g, unknown or other
  misc_feature (147)..(147): n is a, c, g, or t
tcagagtcgagagacacgaccggtgctcgatttagcgagacgcgcagggcacgaccggtgctcgatttagctacgctctaagggaaaggggttcctgttcccaccctcctctctctcgactctgagcgggctggcaaggcgcatagn

SEQ ID NO: 57168 - DNA, 541 bp, Homo sapiens
  misc_feature: GYAE6OF02HGQ9G.49.9.A09.1.454.CMB.1.raw
  modified_base (333)..(333): a, c, t, g, unknown or other
  misc_feature (333)..(333): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagccgaccggccctcagggactccctgagcgtattttcnggcctcaagtctgggaacacggccacccgtgaccgtcagcagggtcgaagccggggatcggaggcccgaactatatctgtcagggtgtgggatagtagtagtgctcgtcgggggtgtcggcggaggaccaggttcgacgttcgttggcagcccgagccgtcgccccctggtccacgtctcgttccccgccctcctctctcctcgtacc

SEQ ID NO: 57169 - DNA, 164 bp, Homo sapiens
  misc_feature: GYAE6OF02GTJT2.49.9.A09.1.454.CMB.1.raw
  modified_base (161)..(164): a, c, t, g, unknown or other
  misc_feature (161)..(164): n is a, c, g, or t
tcagagtcgagagacacgaccggtgctcgatttagcgagacgcgcagggcacgaccggtgctcgatttagtcacgcgagaagggaaaggggctggccctgacgtgtttctgttcccaccctcctctctctcgactctgagcgggctggcaaggcgcatagnnnn

SEQ ID NO: 57170 - DNA, 529 bp, Homo sapiens
  misc_feature: GYAE6OF02HIJA3.49.9.A09.1.454.CMB.1.raw
  modified_base (330)..(330): a, c, t, g, unknown or other
  misc_feature (330)..(330): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacacggccaccctgaccgtcagcagggtcgaagccggggatggaggccgactatatctgtcaggtgtgggattagtagtagtgctcgttccgggggtgttcgggcggagggaccaaggttcgaccgttcgttggtcagcccaggctcgcccctggtcactctgtcccgcctcctctctctctc

SEQ ID NO: 57171 - DNA, 545 bp, Homo sapiens
  misc_feature: GYAE6OF02FT37G.49.9.A09.1.454.CMB.1.raw
  modified_base (331)..(331): a, c, t, g, unknown or other
  misc_feature (331)..(331): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggccccctgtgttggtcgtccatgatgacagcgaccggccctcagggatccctgagcgattttcnggctccaagtctgggaacacggccaccctgaccgtcagcagggtcaaggccgggatgaggccgatatatctgtcaggtgtgggataggtagtagtgcttcgttccgggggtgttcgggcggagggacctaaggttgaccgttcgttgggtcagcccaggcctcggccccctgggtccacgttctgttccccgcccttcctctcttcctcgtacc

SEQ ID NO: 57172 - DNA, 577 bp, Homo sapiens
  misc_feature: GYAE6OF02IARXF.49.9.A09.1.454.CMB.1.raw
  modified_base (212)..(212): a, c, t, g, unknown or other
  misc_feature (212)..(212): n is a, c, g, or t
  modified_base (301)..(301): a, c, t, g, unknown or other
  misc_feature (301)..(301): n is a, c, g, or t
tcagagtcgagagacacgaccggtgctcgatttagcgagacgcgcaggggcgtgggccgtaaggaagcagcactggtggtgcctcagccatggcctggaccgttctcctcctcggcctcctctctcactgcacagactctgtgacctcctatgtgttgacgcagccaccctcggtgtccgtggccccaggacagacggcctaggtttccccngtgagggcaaacaacattggtggtaaaggtgtggcactggtaccagcagaagccaggccaggcccctgtgttggtcgtccatgatgacngcgaccgccctcagggatcccgtgacgcgtattttcgtggccttcaagtctggggaacacggccacccgtgacccgtcagcagggtcgaaggccgggatggacggccgactatatcgtgtcgtagggtggtgggaattaggtagtagtcgacttcggtccggggggttgttccgggtcggaaggggacctaagggtggtaccgttcggttggtccgagcccgagctcggcccctggtcaccgttctcgttccccaccgttccctctcctctcgacg

SEQ ID NO: 57173 - DNA, 541 bp, Homo sapiens
  misc_feature: GYAE6OF02GJFX4.49.9.A09.1.454.CMB.1.raw
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacncggccaccctgaccgtcagcagggtcgaagccggggatggaggccgatatatctgtcaggtgtgggattaggtagtagtgctcgttccgggggtgttcgggcggagggaccaaggttcgaccgttcgttggtcagcccaggcctcggccccctggtccacttctgttcccacccttcctctctcctcgtacc

SEQ ID NO: 57174 - DNA, 161 bp, Homo sapiens
  misc_feature: GYAE6OF02FIF2S.49.9.A09.1.454.CMB.1.raw
tcagagtcgagagacacgaccggtgctcgatttagcgagacgcgcagggcacgaccggtgctcgatttagtcacgcgagaaagggaaaggggctggccctgacgtgtttctgttcccaccctcctctctctcgactctgagcgggctggcaaggcgcatag

SEQ ID NO: 57175 - DNA, 522 bp, Homo sapiens
  misc_feature: GYAE6OF02GWXVJ.49.9.A09.1.454.CMB.1.raw
  modified_base (330)..(330): a, c, t, g, unknown or other
  misc_feature (330)..(330): n is a, c, g, or t
  modified_base (519)..(519): a, c, t, g, unknown or other
  misc_feature (519)..(519): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacacggccaccctgaccgtcagcagggtcgaaggccggggatggaggccgactatatctgtcaggtgtgggatagtagtagtgctcgttccggggtgttcggcggagggaccaaggttcgacgtcgttggcagccaggctcgcccctgcactctgtcccacctcctctctctntac

SEQ ID NO: 57176 - DNA, 546 bp, Homo sapiens
  misc_feature: GYAE6OF02GTFNT.49.9.A09.1.454.CMB.1.raw
  modified_base (330)..(330): a, c, t, g, unknown or other
  misc_feature (330)..(330): n is a, c, g, or t
  modified_base (415)..(415): a, c, t, g, unknown or other
  misc_feature (415)..(415): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctagggaacacggccaccctgaccgtcagcagggtcgaaggccggggatggaggccgactatatctgtcaggtgngggatagtagtagtgcttcgttccgggggtgttcgggcgggagggaccaaggttcgaccgttcggttggtcacgcccaggcctcggccccctggtccacgtctcgttccccaccttcctctcctctcgtac

SEQ ID NO: 57177 - DNA, 551 bp, Homo sapiens
  misc_feature: GYAE6OF02IE3JQ.49.9.A09.1.454.CMB.1.raw
  modified_base (333)..(333): a, c, t, g, unknown or other
  misc_feature (333)..(333): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaaggtgtgcactggtaccagcagaagccaggccaggcccctgtgttggtcgtccatgatgacagcgaccggccctcagggactccctgagcgtattttcnggctccaagtctgggaacacggccaccctgaccgtcagcagggtcgaaggccggggatggaggccgactatatctgtcaggtgtgggataggtagtagtgctcgttccggggtgttcgggcggagggaccaaggttcgaccgttcggttggtcacgcccgaggctcggccccctggtccacgttctcgttcccgcccttcctcctcctcgtcgtaccg

SEQ ID NO: 57178 - DNA, 163 bp, Homo sapiens; identical to SEQ ID NO: 57005
  misc_feature: GYAE6OF02G466S.49.9.A09.1.454.CMB.1.raw
  modified_base (162)..(163): a, c, t, g, unknown or other
  misc_feature (162)..(163): n is a, c, g, or t

SEQ ID NO: 57179 - DNA, 577 bp, Homo sapiens
  misc_feature: GYAE6OF02HKFJ1.49.9.A09.1.454.CMB.1.raw
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
  modified_base (330)..(330): a, c, t, g, unknown or other
  misc_feature (330)..(330): n is a, c, g, or t
tcagagtcgagagacacgaccggtgctcgatttagcgagacgcgcaggggcgtgggcctaaggaagcagcactggtggtgcctcagccatggcctggaccgttctcctcctcgcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagcaggcaggcccctgngttgtcgtccatgatgacagcgaccggccctnacgggatccctgagcgaattttcgngctacaagtcgtaggacacggaccaccctgaccgtcagcgagggtcgaacgggccgggataggacggaccgacgtatactcgtgtcgaggtggtaggaattaggtagtagtgtcgttcggttccgggggtgttcgggacgggtacgggaacctaaggttcgaccgttcggttggtcgacggcccaggcctccgcccccgtcgtaccacttcgtcgttcccccgccttaccctctctaccgtcgtacc

SEQ ID NO: 57180 - DNA, 532 bp, Homo sapiens
  misc_feature: GYAE6OF02IBICG.49.9.A09.1.454.CMB.1.raw
  modified_base (330)..(330): a, c, t, g, unknown or other
  misc_feature (330)..(330): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctcaagtctgggaacacggccaccctgaccgtcagcagggtcgaagccggggatgaggccgactatatctgtcaggtgtgggatagtagtagtgctcgttccgggggtgttcgggacgggaggaccaaggttcgaccgttcgttggcagcccaggctcgcccctggtcactctcgttcccacctcctcctctcctgtacc

SEQ ID NO: 57181 - DNA, 553 bp, Homo sapiens
  misc_feature: GYAE6OF02HZ4SM.49.9.A09.1.454.CMB.1.raw
  modified_base (330)..(330): a, c, t, g, unknown or other
  misc_feature (330)..(330): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacacggccaccctgaccgtcagcagggtcgaaggcccggggatgaggccgactatatctgtcaggtgtgggatagtagtagtgtctcgttccgggggtgttcgggcgggagggaccaaggttcgaccgttcgttggtcagcccaaggcctcggcccccgtcggtccacgttctcggttccccaccctcccttcctcctctccgtacc

SEQ ID NO: 57182 - DNA, 522 bp, Homo sapiens
  misc_feature: GYAE6OF02GD2OD.49.9.A09.1.454.CMB.1.raw
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (472)..(473): a, c, t, g, unknown or other
  misc_feature (472)..(473): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccctggtgtccgtcggccccaggacagacggccaggtttccctgtgagggcaaacaacattggtaggtaaaggtgtgcactggtaccagcagaagccaggccaggcccctgtgttggtcgtccatgatgacagcgaccggccctcgagggactccctgagcgtattttcnggctcaagtcgtggaacncggccaccctgaccgtcagcgagggtcgaaggccggggatggacggcgactatatctgtcaggtgtgggatagtagtagtgctcgtcggggtgttcggcggaggacagtgacgtgtgnngccagctcgcccgngtcnctcgtcgtcccgtcctcctctctctctaccg

SEQ ID NO: 57183 - DNA, 530 bp, Homo sapiens
  misc_feature: GYAE6OF02GMBBL.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcgttcgggggtgttcgggcggagggaccaaggttgaccgttgttggtcagcccaggctcggcccctggtcactctcgttcccaccctcctctctctcgtac

SEQ ID NO: 57184 - DNA, 522 bp, Homo sapiens
  misc_feature: GYAE6OF02FNXJG.49.9.A09.1.454.CMB.1.raw
  modified_base (449)..(449): a, c, t, g, unknown or other
  misc_feature (449)..(449): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcgagggtcgaaggccggggatggaggccgactatatctgtcaggtgtgggatagtagtagtgctcgttcggggtgttcggnggaggacagtcgaccgtgtgtcacgccagctcgcccctggtccactctcgttcccgccctcctctctctcgtc

SEQ ID NO: 57185 - DNA, 597 bp, Homo sapiens
  misc_feature: GYAE6OF02JMMWJ.49.9.A09.1.454.CMB.1.raw
  modified_base (308)..(308): a, c, t, g, unknown or other
  misc_feature (308)..(308): n is a, c, g, or t
  modified_base (332)..(332): a, c, t, g, unknown or other
  misc_feature (332)..(332): n is a, c, g, or t
tcagagtcgagagacacgaccggtgctcgatttagcgagacgcgcaggggctgggcctaaggaagcagcactggtggtgcctcagccatggcctggaccgttctcctcctcgcctcctctctcactgcacagactctgtgacctcctatgtgttgacgcagccaccctcggtgtccgtcggccccaggacagacggccaggtttccctgtgagggcaacaacattggtggtaaaggtgtgcactggtaccagcagaagccaggccaggcccctgtgttggtcgtccatgatgacagcgaccggccctnagggatccctgagcgtattttcgnggctccgaaagtcgtagggaacaccgggccctaccctggaccgtcagcgaaggggtcgaaacggtcccgggggatcggacggccggactagtactctaggtcgaggtggtgggtaatagtagtagtgcttcggtccggggttgttccgggcgggagggacctagggttcgaccgttggttcggtcgagcccgagggcctccgcccccgttggtccgtacctcgttccgtccccggtcccttccgtccctccgttcctccgtaccg

SEQ ID NO: 57186 - DNA, 541 bp, Homo sapiens
  misc_feature: GYAE6OF02GSZN5.49.9.A09.1.454.CMB.1.raw
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgtattttcnggctccaagtctgggaacncggccaccctgaccgtcagcagggtcgaagccggggatggacggccgactatatctgtcgaggtcgaagacgcctaaacttgtcatacttcgggacggagggaccaaagttcgaccgtcgtgggtcacgacccgagcctcgcccctcggtccacctctcgttcccacccttcctctcctctcgtctctcgg

SEQ ID NO: 57187 - DNA, 542 bp, Homo sapiens
  misc_feature: GYAE6OF02F9HVU.49.9.A09.1.454.CMB.1.raw
  modified_base (331)..(331): a, c, t, g, unknown or other
  misc_feature (331)..(331): n is a, c, g, or t
  modified_base (503)..(503): a, c, t, g, unknown or other
  misc_feature (503)..(503): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggactccctgagcgattttcnggctccaagtctgggaacacggccaccctgaccgtcagcgagggtcgaacggccggggatggacggccgactagtatcgtgtcgagggtgtgggattaggtggtagtggtgtcgtcgttcggagtcgtgggaccagggtccaccgtcctaggtcagcccaggcccaacccgntcgtccactctcgttccccgcctcctctcctctcgtacc

SEQ ID NO: 57188 - DNA, 533 bp, Homo sapiens
  misc_feature: GYAE6OF02H96YS.49.9.A09.1.454.CMB.1.raw
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctcaagtctgggaacncggccaccctgaccgtcagcagggtcgaagccggggatggaggccgactatatctgtcaggtgtgggatagtagtagtgcgtcgttccgggggtgttcgggcgggaggactaggttcgaccgttcgtggcagccaggcctcggccccctggtcacttctcgttcccacctcctctctcctgtacc

SEQ ID NO: 57189 - DNA, 184 bp, Homo sapiens
  misc_feature: GYAE6OF02HKBIW.49.9.A09.1.454.CMB.1.raw
  modified_base (165)..(184): a, c, t, g, unknown or other
  misc_feature (165)..(184): n is a, c, g, or t
tcagagtcgagagacacgaccggtgctcgatttagcgagacgcgcaggggcacgaccggtgctcgatttagtagtcggcactaaagggaaagggggctggccctgacgtgtttctgttcccacctcctctctctcgactctgagcgggctggcaaggcgcatagnnnnnnnnnnnnnnnnnnnn

SEQ ID NO: 57190 - DNA, 801 bp, Homo sapiens
  misc_feature: GYAE6OF02I4T21.49.9.A09.1.454.CMB.1.raw
tcagagtcgagagacacgaccggtgctcgatttagcgagacgcgcagggggctcgggcctaaggaagccagcacgtggtggtgccgtcagcctatggcctggaccgttctcctcctcggcctcctctcctcactgccacagactctgttgacctcctatgtgttgacgcagccaccctcggtgtccgtggccccaggacagacggccagggtttccctggtaggacggggcaacaacattggtggtaaaggtgtgcactggtaccagcagaagccaggccaggcccctggtgttgggtcgtccatgatgacgagccggaccggcccgtcgaggggatcccgtagacgcgtatttttctgggtccttaccgaaagttccgtaggggaaacctaccggggaccctacccgttacgaacccggttccacggtccaacggggtaccggaaacgggcccgggggtatcgggaacgggtcccgaacgttaacgtaacgttccgttacggtaccgaggggttacggtacgggggtaacttaacggttaagttaccggttagggtaccgtttccgggtttacccgggggggttcgtttccgggggaccggggtacggggacccgttaaacgggtttcggaacccgggttcgtttaccgggtactacgggtaccccgtaagggtccgtaccgggtccccccttacgggttaccctaacccgtttacccggtttcgggtttcccccccgggtacccccgtttcccggtttacccggtttccccgttttacccggttcccggtttaccccgg

SEQ ID NO: 57191 - DNA, 163 bp, Homo sapiens
  misc_feature: GYAE6OF02GMMO9.49.9.A09.1.454.CMB.1.raw
  modified_base (163)..(163): a, c, t, g, unknown or other
  misc_feature (163)..(163): n is a, c, g, or t
tcagagtcgagagacacgaccggtgctcgatttagcgagacgcgcagggcacgaccggtgctcgatttagtcacgcgagaaagggaaagggggctggccctgacgtgtttctgttcccgccctcctctctctcgactctgagcgggctggcaaggcgcatagn

SEQ ID NO: 57192 - DNA, 538 bp, Homo sapiens
  misc_feature: GYAE6OF02FGPJ7.49.9.A09.1.454.CMB.1.raw
  modified_base (331)..(331): a, c, t, g, unknown or other
  misc_feature (331)..(331): n is a, c, g, or t
  modified_base (450)..(450): a, c, t, g, unknown or other
  misc_feature (450)..(450): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatcccctgagcgattttcnggctccaagtctgggaacacggccaccctgaccgtcagcagggtcgaagccggggatgaggccgactatatctgtcaggtgtgggatagtagtagtgctcgttccgggggtgttcgggnggagggaccaaggttcgaccgtcgttggtcagcccaggctgccccctggtccacttctcgttccccgccctcctcctctcctcgtacc

SEQ ID NO: 57193 - DNA, 609 bp, Homo sapiens
  misc_feature: GYAE6OF02HZ0ZB.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattgggtaggtaaaggtgtgcacgtggtaccagcagaagccaggccaggccccctgtgttggtcgtccatgatgacagcgaccggccctcagggactccctgagcgtattttctggcctccaagtctagggaacacggccaccctgaccgtcagcgagggtcgaaggccggggatggacggccgaatatatcgtgtcagggtgtgggataggtgagtacggaccagttgggtggttcgggcgggacgggaccaagggtcgaccggttccgtaaggccacggaccccgaaggccgtacggccccccgttacgggtccctaccgttccgttcccggtttacccccggtccccctttcccgtacccgttcccttcccgtccggttacccg

SEQ ID NO: 57194 - DNA, 162 bp, Homo sapiens
  misc_feature: GYAE6OF02GSJLA.49.9.A09.1.454.CMB.1.raw
  modified_base (161)..(162): a, c, t, g, unknown or other
  misc_feature (161)..(162): n is a, c, g, or t
tcagagtcgagagacacgaccggtgctcgatttagcgagacgcgcagggcacgaccggtgctcgatttagtcacgcgagaaagggaaaggggctggccctgacgtgttctgttcccaccctcctctctctcgactctgagcgggctggcaaggcgcatagnn

SEQ ID NO: 57195 - DNA, 575 bp, Homo sapiens
  misc_feature: GYAE6OF02G6905.49.9.A09.1.454.CMB.1.raw
  modified_base (337)..(337): a, c, t, g, unknown or other
  misc_feature (337)..(337): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaggtgtgcactggtaccagcagaagccaggccaggcccctgtgttggtcgtccatgatgacagcgaccggccctcgagggactccctgacgcgtatttttcgnggctccaaagtcgtaggggaacacggccacccgtgaccgtcagcagggtcgaaggccgggatggacggccgactatatctgtcgaggtgtgggataggtagtagtgcgttcgttccgggggtgttcgggcggaggggacctaaggttcgaccggttcggttggacgacgcccgaaggcctacggcccccgtggtccaccttcgtcgttccccgcccttcctcctccttccgtcgtacc

SEQ ID NO: 57196 - DNA, 544 bp, Homo sapiens
  misc_feature: GYAE6OF02HL2AE.49.9.A09.1.454.CMB.1.raw
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (523)..(523): a, c, t, g, unknown or other
  misc_feature (523)..(523): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacncggccaccctgaccgtcagcagggtcgaagccggggatggaggcccgatatatctgcagggtgtgggattaggtagtagtgcgtcgttccgggggtgttcgggcggagggacctaaggttgaccgttgttggcagcccagggctcgcccccgtggtccacgtccgtgttccccncccgttccctctctctcgtcc

SEQ ID NO: 57197 - DNA, 559 bp, Homo sapiens
  misc_feature: GYAE6OF02GOY4Z.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaaacaacattggtggtaaaggtgtgcactggtaccagcagaagccaggccaggcccctgtgttggtcgtccatgatgacagcgaccggccctcagggactccccgtgacgcgtattttcgtgggctccaagtcgtaggggaacacggcccaccctgaccgtcagcgagggtcgaaggccggggatggacggccgactatatctgtcaggtgtgggatagtagtagtgctcgttccggggtgttcggcggagggacctaaggttcgaccggttgttcggtcacggccagggcctcggcccccgtcggtccacttcgtcgttcccgccctcctctcctctcgtcc

SEQ ID NO: 57198 - DNA, 543 bp, Homo sapiens
  misc_feature: GYAE6OF02F9VHF.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctggggaacacggccaccctgaccgtcagcagggtcgaacggccggggatggaggccgatatatctgtcagggtgtgggatagtagtagtgctcgttccgggggtgttcgggcgggagggaccaaggttcgaccgttcgttggtcagcccgaggctcggccccctggtccacgtctcgttcccacctcctctctcctcgtacc

SEQ ID NO: 57199 - DNA, 545 bp, Homo sapiens
  misc_feature: GYAE6OF02J2G8S.49.9.A09.1.454.CMB.1.raw
  modified_base (342)..(342): a, c, t, g, unknown or other
  misc_feature (342)..(342): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (483)..(483): a, c, t, g, unknown or other
  misc_feature (483)..(483): n is a, c, g, or t
  modified_base (516)..(516): a, c, t, g, unknown or other
  misc_feature (516)..(516): n is a, c, g, or t
tcagagtcgagagacacgaccggtgctcgatttagcgagacgcgcagggcgtgggccgtaaggaagcagcactggtggtgcctcagccatggcctggaccgttctcctcctcgcctcctctctcactgcacagactctgtgacctcctatgtgttgacgcagccaccctcggtcgtccgtggccccaggacagacggccaggtttcccctgtcgagggcaacgaacattggtggtaaaggtgtgcactggtaccagcagaagccaggccaggcccctggtgttggtcgtccatcgatgacagccgaccggccctgagggactcccctgacgcgtattttcgnggctccaagtctagggacacgccacctgaccgtcagcagggtcaagccgggatgagccgatanatgtgtcgaggtgngggnttaggntagtgctcgttcggggtnttcggnggagggaccaaggttgaaccgtgtacggtnacggccgagctcgcccccgttggtcaccgttcngttccccaccgtcttctccttcgtcgtcc

SEQ ID NO: 57200 - DNA, 522 bp, Homo sapiens
  misc_feature: GYAE6OF02HCBPH.49.9.A09.1.454.CMB.1.raw
  modified_base (331)..(331): a, c, t, g, unknown or other
  misc_feature (331)..(331): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggactccctgagcgattttcnggctccaagtctgggaacacggccaccctgaccgtcagcagggtcgaaggccgggatgaggccgatatatctgtcaggtgtgggatagtagtagtgctcgttcgggggtnttcgggnggaggacagttgaccgttgtgcagccgagctcgccccgtggtccactctgttccccacctcctctctctcgtcc

SEQ ID NO: 57201 - DNA, 582 bp, Homo sapiens
  misc_feature: GYAE6OF02JIZAN.49.9.A09.1.454.CMB.1.raw
  modified_base (208)..(208): a, c, t, g, unknown or other
  misc_feature (208)..(208): n is a, c, g, or t
  modified_base (307)..(307): a, c, t, g, unknown or other
  misc_feature (307)..(307): n is a, c, g, or t
  modified_base (328)..(328): a, c, t, g, unknown or other
  misc_feature (328)..(328): n is a, c, g, or t
  modified_base (573)..(573): a, c, t, g, unknown or other
  misc_feature (573)..(573): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttcccngtgagggcaacaacattggtggtaaaggtgtgcactggtaccagcagaagccaggccaggcccctgtgttggtcgtccatgatgacagcgaccgccctnagggatccctgagcgatttcnggctcaagtctgggacacggccacctgaccgtcagcagggtcgaacggccggggatggacgggccgactagtactcgtgtccgagggtgtacgggagttagtgtagtcgcttcggttccggggggtgttccgggcgggtacggggacctaaagggttcgaccggttcggtttggccgaggcccagggcctcggcccccgtcggtcaccgttcgtaccgttccccacccttccgtcctccgttccnccgtacccg

SEQ ID NO: 57202 - DNA, 631 bp, Homo sapiens
  misc_feature: GYAE6OF02GCJT2.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcgagggactccctgacgcgtattttctggctcctaagtctagggaacaccggccaccctcgaccgtcacgcgacgggtcgaacggaccggggatcggacggaccgacttaacgtactccgtgtcgtagggtggtacgggtaagttagggtagggttaggttgggttcgttcgggttcgttcgggaggtcggtacggggaccgtacggggtccacccgttcgtacggtcaccggacccgacgggaccccaacccgcgttcgtaccctaccgttcccgttcgtttcccccgccctttcccgtccttcccgttccgtccgtaccccg

SEQ ID NO: 57203 - DNA, 571 bp, Homo sapiens
  misc_feature: GYAE6OF02GH1IV.49.9.A09.1.454.CMB.1.raw
  modified_base (330)..(330): a, c, t, g, unknown or other
  misc_feature (330)..(330): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacacggccaccctgaccgtcagcgagggtcgaagccggggatgacggccgactatatcgtgtcaggtgtgggatagtagtagtgctcgtcggggtattggtcggagggacggacgtagttcgtaccggttggttcgcgacgaccgaggtccgtcccggtccccgttcggtacctaccgttccgttaccggttccccctcccttcccttccttccgttcctcccgg

SEQ ID NO: 57204 - DNA, 612 bp, Homo sapiens
  misc_feature: GYAE6OF02H3MPV.49.9.A09.1.454.CMB.1.raw
  modified_base (333)..(333): a, c, t, g, unknown or other
  misc_feature (333)..(333): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggcaaggcccctgtgttggtcgtcatgatgacagcgacccgccctcgagggactcccgtgagcgtattttcnggctccgaagtcgtagggaacaccggccaccctgacccgtcagcgagggtcgaacggccgggatcggacggccgaactatactcgtgtcgagggtggtggtaagttagtagtagtgtacgttcggttccgggggtgttcgggcgggaacgggaccgtaaggttcgtaccggttcggttcggtccgacggtcccgtaaggtccgtaccggcccccgttcggtcctaccgttccgttaccggtttccccgcccttcccgtccttccgttccgtccgtaccg

SEQ ID NO: 57205 - DNA, 239 bp, Homo sapiens
  misc_feature: GYAE6OF02F2VD5.49.9.A09.1.454.CMB.1.raw
  modified_base (235)..(239): a, c, t, g, unknown or other
  misc_feature (235)..(239): n is a, c, g, or t
tcagagtcgagagacacgaccggtgctcgatttagcgagacgcgcagggcacgaccggtgctcgatttagctctacgctacagggcacgaccggtgctcgatttagcgacgacgcgcagggcacgaccggtgctcggatttagtcacgcgagaaaaggaagggggctggccctgacgtgtttctgttcccaccctcctctctctcgactctgagcgggctggcaaggcgcatagnnnnn

SEQ ID NO: 57206 - DNA, 598 bp, Homo sapiens
  misc_feature: GYAE6OF02G9IEF.49.9.A09.1.454.CMB.1.raw
  modified_base (295)..(295): a, c, t, g, unknown or other
  misc_feature (295)..(295): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacngcgaccggccctcgagggactccctggagcgtattttcgtggcctccaagtctagggacacggccaccctgaccgtcagcgagggtcgaaggccggggatggaggccgagtatatcgtgtcgaggtgtgggattaggtagttagtgtcgtcggtttccgggggtgttcgggcgggtacggggaacctaagggttcggtaccggttcgggtttcgggtcgacggccccgaagggcctaccggcccccgttcggtccaccgttccttcgttcccccacccttcccttcctccttcctccgtaccg

SEQ ID NO: 57207 - DNA, 616 bp, Homo sapiens
  misc_feature: GYAE6OF02IXG2R.49.9.A09.1.454.CMB.1.raw
  modified_base (334)..(334): a, c, t, g, unknown or other
  misc_feature (334)..(334): n is a, c, g, or t
  modified_base (475)..(475): a, c, t, g, unknown or other
  misc_feature (475)..(475): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtcatgatgacagcgaccggccctcgagggactccctgacgcgtattttcgnggctcgaagtcgtagggaaaccaccggccacccgtcgaccgtcacgcgagggtcgaacggccgggatggacggccgactatactgtcagggtgtgggataggtggtagtggttgtcgtcgttcgggagtcgtagggaccgnggggtaccaccggttcctagggtaccacggacccgtaaggcccccaaaccccgtaccgttcggtaccctaccgttccgttacccggtttacccccacccccgttcccttcccttcccggttaccttcccggaccctttccg

SEQ ID NO: 57208 - DNA, 551 bp, Homo sapiens
  misc_feature: GYAE6OF02JAS9P.49.9.A09.1.454.CMB.1.raw
  modified_base (320)..(320): a, c, t, g, unknown or other
  misc_feature (320)..(320): n is a, c, g, or t
  modified_base (535)..(535): a, c, t, g, unknown or other
  misc_feature (535)..(535): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcgagggactcccngagcgtattttctggctccaagtcgtagggaacaccggccacccgtgaccgtcagcgagggtcgaacggccggggatggacggacccgatactatctggtcgagggtgtagggatagtagtagtgcttcggttcggggtgttcggcgggagggacctaggttcgaccgttggttcggcgacgaccgaggctcggcccctgtcactcgtcgtcccncctcctctctcctgtc

SEQ ID NO: 57209 - DNA, 515 bp, Homo sapiens
  misc_feature: GYAE6OF02HFQ57.49.9.A09.1.454.CMB.1.raw
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
  modified_base (466)..(466): a, c, t, g, unknown or other
  misc_feature (466)..(466): n is a, c, g, or t
  modified_base (498)..(498): a, c, t, g, unknown or other
  misc_feature (498)..(498): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccagccaggcccctgtgttggtcgtccatgatgacagcgaccggccctnaggggatccctggagcgattttcnggctccaagtcgtgggaacacggccaccctgaccgtcagcagggtcgaagccggggatgaggccgatatatctgtcaggtgtgggatagtagtagtgctcgttcggggtgtcggcggaggaccagtgcgtgtgcngccaggctcgccctcggtcactctcgttcccncctcctctctctcgtac

SEQ ID NO: 57210 - DNA, 631 bp, Homo sapiens
  misc_feature: GYAE6OF02I19AK.49.9.A09.1.454.CMB.1.raw
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacacattggtggtaaaggtgtgcactggtaccagcagaagccaggccaggcccctgtgttgtcgtccatgatgacagcgaccggccctcgagggactcccgtgacgcgtattttcnggctccgaagtctagggaacncggccacctgaccgtcagcagggtcgaagccgggatggacggccgactagtatctagtcaggtgtggattaggtagtagtgccgttacgttccgggggtgttcgggcgggacgggtaccgtaaggttcggaaccggttggtttcggtacgacgtaccccgaagggtcctaccgggtcccccccgttacgggttaccgtaacccgttccggttacccggtttccccccggtacccctttccccgttacccgttcccgttacccgttcccggtaacccg

SEQ ID NO: 57211 - DNA, 574 bp, Homo sapiens
  misc_feature: GYAE6OF02GS6A0.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaaggtgtgcactggtaccagcagaagccaggccaggcccctgtgttggtcgtccatgatgacagcgaccggccctcagggactccctgagcgtattttcgtggctccaagtctgggaacacggccaccctgaccgtcagcagggtcgaagccggggatcggaggccgactatatctgtcgaggtgtgggatagtagtagtgcgtcgttccgggggtgttcgggcggagggaccaaggttcgaccgttcggttcggtcacggcccaagggcctcggtcccccgtcggttccaccgttccgttcgttcccctacccttcccttccgttccttcctccgtaccg

SEQ ID NO: 57212 - DNA, 764 bp, Homo sapiens
  misc_feature: GYAE6OF02JJVF8.49.9.A09.1.454.CMB.1.raw
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
tcagagtcgagagacacgaccggtgctcgatttagcgagacgcgcaggggcgtgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacgaacattggtggtaaaggtgtgcactggtaccagcagaagccaggccaggcccctgtgttggcgtccatgatgacagcgaccggcctcagggactcccgngagcgtatttttcgnggcctcgaacgttcgtacggggtaaacaccgggtaccctaacccgtacgtacccgtacgaacggccgtaacgggggtccgaaacgggtcccgggggtaattcgggaacgggacccgtaacgttaacgttactcgttacgtcgaacgggttggtacggggtaattaaggtacggttacggtacgtccggtttaccggtttccgggggggggtttacgtttcccgggggtacggggtaacgggggtaacccttaaaggggtttccgggtaaccccgggtttcggggttttacgggtacccggtaacgtacccccggtaagggttcccctacccggggttcccccccgttcggggtacccttaccgttcccggtttaccgtttacccccggttccttaccccgttcctttcccgttaccgtccgttacccgg

SEQ ID NO: 57213 - DNA, 602 bp, Homo sapiens
  misc_feature: GYAE6OF02F2GDY.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaaacaacattggtggtaaaggtgtgcactggtaccagcagaagccaggccaggcccctgtgttggtcgtccatgatgacagcgaccggccctcgagggactccctgacgcgtattttcgtggtcctaccaagtcgtagggaacacggccacccgtgaccgtcagcgagggtcgaacggccggggatcggaggccgatatatcgtgtcgaggtgtgggattaggtagtagtgtcttcggttccgggggtgttcgggcgggtacgggaccgtaaggtttcgaccggttgttcgggtcacggcccgtaagggcctccggtcccccgttcggtcctaccgttccgttccggttcccccgtcccttcccttccgtcccttccgtccgtacc

SEQ ID NO: 57214 - DNA, 580 bp, Homo sapiens
  misc_feature: GYAE6OF02GV4ST.49.9.A09.1.454.CMB.1.raw
  modified_base (333)..(333): a, c, t, g, unknown or other
  misc_feature (333)..(333): n is a, c, g, or t
  modified_base (551)..(551): a, c, t, g, unknown or other
  misc_feature (551)..(551): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctggtgttggtcgtccatgatgacagcgaccggccctcgagggatccctgagcgtattttcnggctccaagtctgggaacacggccacccgtgaccgtcagcgagggtcgaaggcccggggatggacggccgacgtaatatcgtgtcgaggtggtggtatagtagtagtgctcgttccggggtgttcgggcggacgggactaggttcgaccggttcggtcggtcgacgcccgaggtcctaccggcccccgtcggtaccaccgttccgttccgttaccccnccccttcctcccgtcctccgtccgtaccg

SEQ ID NO: 57215 - DNA, 556 bp, Homo sapiens
  misc_feature: GYAE6OF02GDDMB.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagccgaccggccctcagggactcccctgacgcgtattttcgtggcctccaagtctgggaacacggccaccctgaccgtcagcgagggtcgaagccggggatggacggccgactagtatctgtcagggtgtgggatagtagtagtgcttcgttccgggggtgttcgggcggagggaccaaggttcgaccgttgttggtcgacgccgaggcctcggccccgtcggtcaccttctcgttcccacccttcctctcctctcgtaccg

SEQ ID NO: 57216 - DNA, 537 bp, Homo sapiens
  misc_feature: GYAE6OF02G4STS.49.9.A09.1.454.CMB.1.raw
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (518)..(518): a, c, t, g, unknown or other
  misc_feature (518)..(518): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacncggccaccctgaccgtcagcagggtcgaagccgggatgaggccgatatatctgtcaggtgtgggattagtagtagtgctcgtttccgggggtgttcgggcggaggggaccaaggttcgaccgttcgttggtcagcccaggcctggccccctggtccactctcgttcccncccttcctctctctcgtac

SEQ ID NO: 57217 - DNA, 533 bp, Homo sapiens
  misc_feature: GYAE6OF02GR0KZ.49.9.A09.1.454.CMB.1.raw
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (513)..(513): a, c, t, g, unknown or other
  misc_feature (513)..(513): n is a, c, g, or t
  modified_base (527)..(527): a, c, t, g, unknown or other
  misc_feature (527)..(527): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggccccctgtgttggtcgtccatgatgacagcgaccggccctcagggatccctgagcgattttcnggctccaagtctgggaacncggccaccctgaccgtcagcagggtcgaagccggggatgaggccgactatatctgtcaggtgtgggatagtagtagtgctcttccgggggtgttcgggcggagggaccaggttgacgtcgttggtcagcccgaggctcggcccctggtcacgtctcgttcccnccctcctcctctcncgtacc

SEQ ID NO: 57218 - DNA, 646 bp, Homo sapiens
  misc_feature: GYAE6OF02IVNXH.49.9.A09.1.454.CMB.1.raw
  modified_base (295)..(295): a, c, t, g, unknown or other
  misc_feature (295)..(295): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacngcgaccgcctcagggactcccgtgagcgtattttcgtggctccaagtcgtaggggaacaccggcccacccgtcggacccgtcgaacggtccgaaggggtccgaaacgggcccgggggaatcgggaacgggcccgtaactaacgtatacgttcggtacgtagggttggtaggggaattaaggttagtagttcgccgtttcggttccgggggttgttcggggcggacggggtacctaaggttcggtaccggttcggttggtaccgacggacccgaaggtccgtccggcccccgttgggtccacgttcccgttcgttcccccgcccgttcccttccgtcccttccgtccgtacc

SEQ ID NO: 57219 - DNA, 604 bp, Homo sapiens
  misc_feature: GYAE6OF02IKVGC.49.9.A09.1.454.CMB.1.raw
tcagagtcgagagacacgaccggtgctcgatttagcgagacgcgcaagggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcgagggactcccgtgagcgtatttcgtggctccgaagtcctagggaacacggccaccctgaccgtcagcagggtcgaagcgggatgaggccgactagatctagtcgaggtgtggattagtagtagtacgtcgttacgggtcgggttggtccgggaggtaccggagtacgtaccggtcgttcggtcgtacggaccgaccggtacgtccggtcccccggtcccggtaccgtccgtaccgttcccgtttaccccgtaccccgtacccgttcccttccgtcccgttaccgtcccgttaccg

SEQ ID NO: 57220 - DNA, 579 bp, Homo sapiens
  misc_feature: GYAE6OF02IP8G5.49.9.A09.1.454.CMB.1.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
  modified_base (476)..(476): a, c, t, g, unknown or other
  misc_feature (476)..(476): n is a, c, g, or t
tcagagtcgagagacacgaccggtgctcgatttagcgagacgcgcagggcgtgggccgtaaggaagcagcactggtggtgcctcagccatggcctggaccgttctcctcctcggcctcctctctcactgcacagactctgtgacctcctatgtgttgacgcagccaccctggtgtccgtgccccaggacagacgccaggtttcccngtgacgggcaacaacctagttcggtaggtaaaggtntggcacgtggtaccagcagagcaggcagcccngtgtgcgtcatgatgacngacgaccggccctcacgggactccctgagcgtattttcgcggtctcaacgttcgtacgggaaccacggccctaaccgtcgaccggtccagcgagggtcgaaggtccgggatggaacggcacgtatacgtctgtcaggtagtggaacgttaggtagtagtgcgttcggttccggggttgtacggngggacggaccgtaagttcgaacgtcggttgcgacgccgtaggctccggcccctggtcctacgtccgtcgtttccccgcccgttcccctctccttccgtcgtcg

SEQ ID NO: 57221 - DNA, 622 bp, Homo sapiens
  misc_feature: GYAE6OF02I959C.49.9.A09.1.454.CMB.1.raw
  modified_base (334)..(334): a, c, t, g, unknown or other
  misc_feature (334)..(334): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctttcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgacccggccctcgagggactccctgagcgtattttcnggtctccaagtcgtagggaaccacggcccacccgtgaccgtcgagcgagggtcgaaggccggggatggaggccgactatactctgtcgaggtgtgggattaggtagtagtgcgttcggttccgggggtgttcgggcgggtagggacctaaggttcggaccggttcggttgggtcacggacccgtaaggggccttccggaccccccgttcggtaccctaccgttcccgttccgtttacccccctaccccgttccccttcgttccccgtccttacccggtaccttcccgg

SEQ ID NO: 57222 - DNA, 527 bp, Homo sapiens
  misc_feature: GYAE6OF02IU6OY.49.9.A09.1.454.CMB.1.raw
  modified_base (331)..(331): a, c, t, g, unknown or other
  misc_feature (331)..(331): n is a, c, g, or t
  modified_base (441)..(441): a, c, t, g, unknown or other
  misc_feature (441)..(441): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggccccctgtgttggtcgtccatgatgacagcgaccggccctcagggatccctgagcgattttcnggctccaagtctgggaacacggccaccctgaccgtcagcagggtcgaagccggggatggaggccgactatatctgtcaggtgtgggatagtagtagtgctcgtcggggtnttcgggcggaggccaagttgaccgttcggtggtcaggcccaggctcgcccctcggtcactctcgttcccgcctcctctctctcgtc

SEQ ID NO: 57223 - DNA, 530 bp, Homo sapiens
  misc_feature: GYAE6OF02I23Y6.49.9.A09.1.454.CMB.1.raw
  modified_base (492)..(492): a, c, t, g, unknown or other
  misc_feature (492)..(492): n is a, c, g, or t
tcagagtcgagagacacgaccggtgctcgatttagcgagacgcgcagggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggccccctgtgttggtcgtccatgatgacagcgaccggccctcagggatccctgagcgattttctggctccaagtctgggaacacggccaccctgaccgtcagcagggtcgaagccggggatgaggccgactattactgtcaggtgtgggataggtggtagtggtgtcgtcttcgggagcgtgggaccagggtcaccgtcctaggtcagcccaaggcccaacccnctgtccactctcgttcccgccctcctctctctcgctcg

SEQ ID NO: 57224 - DNA, 556 bp, Homo sapiens
  misc_feature: GYAE6OF02HWCOO.49.9.A09.1.454.CMB.1.raw
  modified_base (337)..(337): a, c, t, g, unknown or other
  misc_feature (337)..(337): n is a, c, g, or t
  modified_base (519)..(519): a, c, t, g, unknown or other
  misc_feature (519)..(519): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcggaccggccctcaggggactcccctgacgcgtattttcgnggctccaagtctgggaacacggccaccctgaccgtcagcagggtcgaagggccgggatggacggccgactatatcgtgtcagggtgtgggatagtagtagtgctcgtcggggttgttcgggcggagggaccaaggttgaccgttcggttgtcgagcccagggcctccggccccttcggtccncctcgtcgttcccgcccttccctcctctcctcgtacc

SEQ ID NO: 57225 - DNA, 539 bp, Homo sapiens
  misc_feature: GYAE6OF02HDNOF.49.9.A09.1.454.CMB.1.raw
  modified_base (351)..(351): a, c, t, g, unknown or other
  misc_feature (351)..(351): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggactccctgagcgtattttctggctccaagtctgggaacncggccaccctgaccgtcagcagggtcgaaggcgggatggagccgatattactgtcaggtgtgggataggtggtagtggtgttcgtcgttcggagcgtgggaccaggggtccaccgttcctaggtcacgcccaaggcccaacccgctcgtccactctcgttccccgcccttcctcctctcctcgactcg

SEQ ID NO: 57226 - DNA, 534 bp, Homo sapiens
  misc_feature: GYAE6OF02GFTV6.49.9.A09.1.454.CMB.1.raw
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (448)..(448): a, c, t, g, unknown or other
  misc_feature (448)..(448): n is a, c, g, or t
  modified_base (518)..(518): a, c, t, g, unknown or other
  misc_feature (518)..(518): n is a, c, g, or t
tcagagtcgagagacacgaccggtgctcgatttagcgagacgcgcgaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacncggccacctgaccgtcagcagggtcgaagccggggatggaggccgacgtatatctgtcagggtgtgggaataggtagtagtgctcgtttccgggggtnttcgggcggagggaccaagttgaccgtgttggtcagccaggctacggcccctggtccacttctgttcccncctcctctctctcgtc

SEQ ID NO: 57227 - DNA, 680 bp, Homo sapiens
  misc_feature: GYAE6OF02IMQ7G.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctggtgtccgtggccccaggacagacggccaggtttccctgtgagggcaacaacattggtggtaaaggtgtgcactggtaccagcagaagccaggccaggcccctgtgtggtcgtccatgatgacagcgaccggccctcgagggactcccgtgacgcgtattttcgtggcctccgaaagttcgtacggggaaaccaccggccctaccccgtggaacccggttcaacggcaaggggtccgaaacgggcccgggggaatggacgggcccgaacgttaatacgtctgtacgagggtggtgggaacttaggtagtagtagtcgttaccgttccggggggttgttcgggcgggagggaccctaaaggttcgaacccggttcggtttcggtaccgtacggaccccgaagggtcccgtaccggtcccccccgttcggggtccctaaccgttcccgtttacggtttcccccccggtacccctttccccgtacccgtttcccttcccgtaccggtaaccccg

SEQ ID NO: 57228 - DNA, 556 bp, Homo sapiens
  misc_feature: GYAE6OF02FNWEP.49.9.A09.1.454.CMB.1.raw
  modified_base (413)..(413): a, c, t, g, unknown or other
  misc_feature (413)..(413): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggccccctgtgttggtcgtccatgatgacagcgaccggccctcagggatccctgagcgattttctggctccaagtctgggaacacggccaccctgaccgtcagcagggtcgaagccggggatggaggccgatatatctgtcaggtgnggatagtagtagtgcttcgttccgggggtgttcgggcgggagggaccaaggttcgaccgttcggttggtccgagcccgaaggcctcggcccccctcgggtccaccgttctcgttccccacccttcctcctcctcctccgtacc

SEQ ID NO: 57229 - DNA, 720 bp, Homo sapiens
  misc_feature: GYAE6OF02I1AHB.49.9.A09.1.454.CMB.1.raw
  modified_base (440)..(440): a, c, t, g, unknown or other
  misc_feature (440)..(440): n is a, c, g, or t
tcagagtcgagagacacgaccggtgctcgatttagcgagacgcgcagggggctgggcctaaggaacgcagcactggtggtgcctcagccatcggcctggaccgttctcctcctcgcctcctctctcactgcacagactctgtgacctcctatgtcgtgacgcacgcccacccgtcggtcgtccgtcggccccaggacacggaccggtcctagggtttcccgtggtcggaaggggaccaaaccgaacctaggtttcggtaggtaaaagggtggtacggcctacgtcggtacccagccgaaggaaacgccaacggcctaacggcccccgtggtcggtttggtccggtaccattggatcggacaacggccggaccggcctacgagggtactccctagacggtcggtagtttacgcggactaccgaacgtcgtacgggaaaccncgggtacctaccgtcgaaccgttcgaacgtccgtaagggtccggaaacgcccggggagtacggaacgaccgacgtaacgtaacgtcgccgtacgtacggtggtaggtagtagtacggtacgacgtcgtcgtacgggtcgttcggacggacggacgtacggtacgaacgttcggtacggtcgaccggtaccgtacggtcgtccggtcccgtcgtaccggggggtacctaccgttaccgttcccgtacccgtacccgtaccgtaccgttccgtccgtaccgg

SEQ ID NO: 57230 - DNA, 809 bp, Homo sapiens
  misc_feature: GYAE6OF02JZ192.49.9.A09.1.454.CMB.1.raw
  modified_base (213)..(213): a, c, t, g, unknown or other
  misc_feature (213)..(213): n is a, c, g, or t
tcagagtcgagagacacgaccggtgctcgatttagcgagacgcgcaggggctggggcctaaggaagcagcactgggtggtgcctcagccatggcctggacccgttctcctcctcggcctcctctctcactgcacagactctgtgacctcctatgtgttgacgcagccaccctcggtgtccgtggccccaggacagaccggccagggtttcccngtgagggcaaacaacattggtaggtaaaggtgtgctacgtggtaccagcaagaagccaaggccaggcccctagtgtggtcgtccatgatgacagccgaccggccctcgacggactccccgtggacgccgtactttttcgcgggtacctcccgaaagttccgtaggggtaaccaccggggcccaccccgtcggaacccgttcgaacgccgtaaggggtccggaaacgggcccggggtagtcgggacgggacccgtaacgtaacgtacgtacgttggtaccgaagggttcgggtaggggtaacgttaagggttacggtaagggttccggtcggtttccggttttcccggggggggtttaggtttaccgggggtacggggtaaaccgggggtaaacccgttaaacggggttttaccgggtaacccgggttttcgggttttaccggggtaccgtaacgggtacccccggtaaacgggtcccggttaccgggtcccccccggttaccggttacccggtaaccgtttcccgtttaacccgggtttcccccttaacccccggttcccgttaccctttccgtttacccgttacccggttacccg

SEQ ID NO: 57231 - DNA, 599 bp, Homo sapiens
  misc_feature: GYAE6OF02JT9BL.49.9.A09.1.454.CMB.1.raw
  modified_base (311)..(311): a, c, t, g, unknown or other
  misc_feature (311)..(311): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (536)..(536): a, c, t, g, unknown or other
  misc_feature (536)..(536): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggccccaggacagacggccaggtttccctgtgagggcaacaacagttggtaggtaaaggtgtgcacgtggtaccagcagaagccaggccaggcccctgtcgttcggtcgtccatgatgacagcgaccgccncgaggactccgtgacgcgtactttcgnggctccgaagtcgtcgggaacncggccaccgtgaccgtcagcagggtcgaaggccgggatggacgccgatagtactcgtgtacgagggttggtagggtattaggtagtacggttgtccgttaccgggttcggggttgttccggggcggtaacgggtactaacggttcgaccgttggtcggtacgacgtccgaggtccnccggtcccgtaggtcgtacctcgttccgtccccgtcctccgttactcccgttcgtcccgtccg

SEQ ID NO: 57232 - DNA, 579 bp, Homo sapiens
  misc_feature: GYAE6OF02FQ4A1.49.9.A09.1.454.CMB.1.raw
  modified_base (212)..(212): a, c, t, g, unknown or other
  misc_feature (212)..(212): n is a, c, g, or t
  modified_base (342)..(342): a, c, t, g, unknown or other
  misc_feature (342)..(342): n is a, c, g, or t
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
  modified_base (545)..(545): a, c, t, g, unknown or other
  misc_feature (545)..(545): n is a, c, g, or t
tcagagtcgagagacacgaccggtgctcgatttagcgagacgcgcaggggctgggcctaaggaagcagcactggtgggtgcctcagccatggcctggaccgttctcctcctcggcctcctctctccactgcacagactctgtgacctcctatgtgttgaccgcagccaccctcggtgtccgtggccccaggacagaccggccaggtttcccngtgagggcaacaacattggtaggtaaaaggtgtgcactggtaccagcagaagccaggccaggcccctgtgttggtcgtccatgatgacagcgacccggccctcgagggactccctgagtcgtattttcgnggcctccgaagttctaggggaaacaccggccacccctaggacccgtacgagccgtacggggtaccggaacgggcccgggggatggacggcccgaacgtataactcgtgtcgaggtggtagggataggtgtagtgcttcgttccgggggtgttcggnggagggacctaagtcgaccgtgtgtcngccagctcgcccctggtccncgtcctcgtccccgtcctcctcctctcgcctacg

SEQ ID NO: 57233 - DNA, 538 bp, Homo sapiens
  misc_feature: GYAE6OF02IESDJ.49.9.A09.1.454.CMB.1.raw
  modified_base (333)..(333): a, c, t, g, unknown or other
  misc_feature (333)..(333): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcgagggactccctgagcgtattttcnggctccaagtctgggaacacggccaccctgaccgtcagcagggtcgaagccggggatggaggccgactatatctgtcaggtgtgggattagtagtagtgctcgttccgggggtgttcgggcgggagggaccaaggttgaccgttgtggcagcccgaggcctcgccccgtggtcactctcgttcccaccctcctctctctcgtacc

SEQ ID NO: 57234 - DNA, 536 bp, Homo sapiens
  misc_feature: GYAE6OF02GO3WD.49.9.A09.1.454.CMB.1.raw
  modified_base (465)..(465): a, c, t, g, unknown or other
  misc_feature (465)..(465): n is a, c, g, or t
  modified_base (510)..(510): a, c, t, g, unknown or other
  misc_feature (510)..(510): n is a, c, g, or t
  modified_base (521)..(521): a, c, t, g, unknown or other
  misc_feature (521)..(521): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaaacaacattggtggtaaaggtgtgcactggtaccagcagaagccaggccaggcccctgtgttggtcgtccatgatgacagcgaccggccctcgagggactcccgtgacgcgtattttcgtggctccgaagtcgtagggaaccacggccaccctcgacccgtcacgcgaggggtcgaaggccggggatggacggccgatatatctgtcagggtgtgggagtagtagtagtgctcgtcggggtgtcgggnggaggactaggtgacgtgtggcagccgaggctcgccccgtggtcnctctcgtcccncctcctctctctctc

SEQ ID NO: 57235 - DNA, 561 bp, Homo sapiens
  misc_feature: GYAE6OF02FLCIH.49.9.A09.1.454.CMB.1.raw
  modified_base (426)..(426): a, c, t, g, unknown or other
  misc_feature (426)..(426): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcgagggatcccctgagcgtattttctggctccaagtcgtggggaaccacggcccaccctcgacccgtcagccaggggtcgaaggccggggagtggaggccgatatatctgtcgaggtgngggattaggtggtagtggtgtcgtcgttcggagcgtgggaccgagggtcaccggttctaggtccacgccgacggcccaaccccgactcgtcaccgtcttcgttccccacccttccctcctccttcctccgtaccg

SEQ ID NO: 57236 - DNA, 640 bp, Homo sapiens
  misc_feature: GYAE6OF02HQ0FY.49.9.A09.1.454.CMB.1.raw
  modified_base (331)..(331): a, c, t, g, unknown or other
  misc_feature (331)..(331): n is a, c, g, or t
  modified_base (427)..(427): a, c, t, g, unknown or other
  misc_feature (427)..(427): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccacggcccctgtgttggtcgtccatgatgacagcgaccgcctcgagggactcctgagcgtattttcnggctcgaagtcgtggaactaccggccaccctgacccgtcacgcgagggtacgaaggtcccggggaatcggaggcccgaactatatcgtgttaccgngggtggtggaagttagttagtaggtgccgttcggttccgggggttgttccggggacggtacggggacctaaagggttccgaccgggtttcggttcggacgtaaccggacccgtaagggcctttacccgggccccccgttaccgggttacacccgtttcccgtcgtttaccccccgacccctttcccgttaccttcccttccgttcccggtacc

SEQ ID NO: 57237 - DNA, 623 bp, Homo sapiens
  misc_feature: GYAE6OF02IW69A.49.9.A09.1.454.CMB.1.raw
  modified_base (335)..(335): a, c, t, g, unknown or other
  misc_feature (335)..(335): n is a, c, g, or t
  modified_base (427)..(427): a, c, t, g, unknown or other
  misc_feature (427)..(427): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcacgtggtaccagcagaagccaggccaggcccctgtgttggtcgtccatgatgacagcgaccggccctcagggactcccgtgacgcgtattttcnggtctccaagtcgtagggaaccacggcccaccctgaccgtcagcagggtcgaaggccgggatcggaggaccgactatatctgtacagggtgngggtatagtagtagtcgcgttccggttcgggggtgttccgggcgggtacgggacctaaggttcgaccgggttcggtttcgggtacgtacgacccggaaggtccgtcccggtacccccggttccggtaccgtaccgttaccggttccggtttacccccgcccctttccccgtccttcccttccgtacccgttacccg

SEQ ID NO: 57238 - DNA, 637 bp, Homo sapiens
  misc_feature: GYAE6OF02HP580.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaaacaacattggtaggtaaaaggtgtgcacgtggtaccagcagaagcaggccaggccctgtgttggtcgtccatgatgacagcgaccggccctgagggactccctgacgcgtacttttccggctccaagtcgtagggaaccaccggcccacccgtcgaccgtcgacgaccgaggggtacggaacgggaccggggagtacgggacggacccgtaacgtaatactcgtgtcgtagggtggtagggataggtagtagtgtcgtcggttcgggggtgttcgggcgggacgggacgtaaggttcggtaccggttcggttcggtaccacggacccgaggccttccggtcccccgtcgggttccaaccgttcgttcccggttacccctaccccgttcctcctttaccctccgttaccggtacctacgg

SEQ ID NO: 57239 - DNA, 524 bp, Homo sapiens
  misc_feature: GYAE6OF02ILL3W.49.9.A09.1.454.CMB.1.raw
  modified_base (333)..(333): a, c, t, g, unknown or other
  misc_feature (333)..(333): n is a, c, g, or t
  modified_base (520)..(520): a, c, t, g, unknown or other
  misc_feature (520)..(520): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggccccctgtgttggtcgtccatgatgacagcgaccggccctcgagggactccctgagcgattttcnggctccaagtctgggaacacggccaccctgaccgtcagcagggtcgaagccggggatggaggccgactatatctgtcgaggtgtgggatagtagtagtgcttcgtcggggtgtcggcggaggaccagttgaccgttgtggtcagccaggctcgccctcggtcactctcgttcccgcctcctctctcncgtc

SEQ ID NO: 57240 - DNA, 833 bp, Homo sapiens
  misc_feature: GYAE6OF02HS7I0.49.9.A09.1.454.CMB.1.raw
  modified_base (208)..(208): a, c, t, g, unknown or other
  misc_feature (208)..(208): n is a, c, g, or t
tcagagtcgagagacacgaccggtgctcgatttagcgagacgcgcaggggctgggcctaaggaagcagcactggtggtgcctcagccatggcctggaccgttctcctctcggcctcctctctcactgcacagactctgtgacctcctatgtgttgacgcagccaccctcggtgtccgtggccccaggacagacggcctaggtttcccnggtgagggcaacaacattggtaggtaaaggtgtgcacgtcggtacaggcagaacgccgaaggccgaacggtcccctgttcgggtttcggtaccggttccagttacgattacgaaccacggccggaaccggtcccctggaacggggaccttcccgtggaacgtcgttattttcgtcggccttaccgaaacggtcgtacgggggaaacccaccgggcccctaaaccccgcgtaacccggtacgacggaaccggtaacggggtaccggaaacgggcccgggggggtaaagttggggaaacgggtcccgtaaaccgttaagtaacgttacgttcggtaccggttaggggtagggtaacggggtagttaagggttaagggttaaggttccggtaccggtttaccgggtttcccgggggggtttacggttaccgggggtacgggtaaccgggggtaaacccgtaaggtttacgggtaccgggtttacgggttacggaccgttaccggaacccgtaagggtccccggtaccggtccccccgttacgggttacccaacccggtttaccctttccggttaccccccgtaacccgtttccccgtttaccgtttcccttacccgtccgtaacccgg

SEQ ID NO: 57241 - DNA, 809 bp, Homo sapiens
  misc_feature: GYAE6OF02FP2EU.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgaggcaacaacattggtggtaaaggtgtgcactggtaccagcagaagccaggccaggcccctgtgttgtcgtccatgatgacaggccgaccggcccctagacgggactccccgtaggacgtcggtaactttttcgtcggccttccgaaagtttccgtagggggaaacctaccgggaccctaccccgtcggaaccgtcacgcggtaaggggtccggaaacgggtcccggggggaagttacgggaaacggggtccccggtaaacgttacgttacttccgttaggttccgtaacggggttgggtacggggttaagttaacgggtaaggtttacggtacggccgttttcccgggtttacccgggggggtttcgggtttccggggaccggggtacggggtaaacccgttaagggtttacccggtaacccgggtttaccggtttacggggttaaccgtaccgggaccccgtaacgggtcccgtttacccgggtacccccccgttacgggttaacccttaaccgttacccggtttacccgtttaccccccgttaaccccctttccccggttcccgtttccccgtttaccgtacccggttcccccgg

SEQ ID NO: 57242 - DNA, 681 bp, Homo sapiens
  misc_feature: GYAE6OF02JWEGB.49.9.A09.1.454.CMB.1.raw
  modified_base (339)..(339): a, c, t, g, unknown or other
  misc_feature (339)..(339): n is a, c, g, or t
tcagagtcgagagacacgaccggtgctcgatttagcgagacgcgcagggcgtgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtggcacgtggtaccagcagaagccaggccaggcccctgtgttggtcgtccagtgagtgacagcgaccggccctcgagggatcccctggagcgtacttttcncggacttccgaaagtccgtggggaaaccacgggccaacccgttcggacccgttacacgcgaggggtccgaaggccgggggtaatcggtacgggaccgtactagttactgtcgttcgaaggtcgggtagggaacgttggttacgagggttcgccgtttcgggtttcccgggggtggtttccgggcgggtacgggtaccgtaaacggtttcgaccgggtttcgtgggttaccgcgaccccggagggtccgtccgtacccccgggtcggttcctacccgtttccggttaccggtttcccccggtccctttccccgttccgtacccgtttccgtcccgttacccgg

SEQ ID NO: 57243 - DNA, 695 bp, Homo sapiens
  misc_feature: GYAE6OF02IDIC4.49.9.A09.1.454.CMB.1.raw
  modified_base (210)..(210): a, c, t, g, unknown or other
  misc_feature (210)..(210): n is a, c, g, or t
  modified_base (314)..(314): a, c, t, g, unknown or other
  misc_feature (314)..(314): n is a, c, g, or t
  modified_base (392)..(392): a, c, t, g, unknown or other
  misc_feature (392)..(392): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtcgtccgtcggccccaggacagacggccaggtttcccnggtggacgggacaacaactagttggtaggtaaaggtgtgcacgtggtaccagcagaacgccgacggccgacgccccgtgtcgttcggtcgtccagtgatgacgnggccggacccggccctcgacggactcccgtggacgtcgttactttcgcggtcctaccgaacgtccggtacgggaaccnccggacccctaccgtacggacccgtcgacggtcggaacgggtcggaacgggccggggtatcgggacggaccgtacgtacgtacgttcgttggtcgtagggttcggtagggtacgttaagggttgtacggtccgtcggttccggggttcgggggttcggtcggggaccggtacgggtaccgtaggttccgtaccggttggttcggacgtaccgaccgtacggtcgtacccggtccccgttcggtcctaccgttccgtcccggttccccgtcccgttacccgttccgtccgttcccgtcgtaccg

SEQ ID NO: 57244 - DNA, 526 bp, Homo sapiens
  misc_feature: GYAE6OF02HNQ4M.49.9.A09.1.454.CMB.1.raw
  modified_base (500)..(500): a, c, t, g, unknown or other
  misc_feature (500)..(500): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccgccctcagggactccctgagcgtattttctggctcaagtctgggaacacggccaccctcgaccgtcagcgagggtcgaaggccggggatggacggccgactatatctgtcgaggtgtgggatagtagtagtgcgtcgttccgggggtgttcgggcggagggacagttgaccgtgtgcagccaggctcggcccctcgtcnctctcgtcccgcctcctctctctctc

SEQ ID NO: 57245 - DNA, 741 bp, Homo sapiens
  misc_feature: GYAE6OF02H8ZYI.49.9.A09.1.454.CMB.1.raw
  modified_base (305)..(305): a, c, t, g, unknown or other
  misc_feature (305)..(305): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggcccaggacagacggccaggtttccctgtgagggcaaacaacagttggtggtaaaaggtgtgcactggtaccagcagaacgccaggccacggcccctgtcggttggtcgtccagtgatcggacncggtccggacccggcccgtcgacgggactcccgtagacgtcgttacttttcgtcggtcctaccgtaacgtcggtacgggaaccgtacccgggaccctaccccgtacggacccgtacgacgtaccggtacggggttaccggaacgggggtaccggggaagtacgggtaacgggacccggtaaattacgttaacgttcgttaggtacggtaagggttcgggttaagggtaacgtttaaggtttaacgggtacggttgtaccggtttccgggtttccgggggtttgggttccggggacggggacgggtaccgttaaagggttccgggaccggttcggttcggtacgacggaccgtacggtcccgtacccggtcccccgtggtccctaccgttcgttcccgtccccggtacccttccctacctccgttaccgtcgtaccg

SEQ ID NO: 57246 - DNA, 711 bp, Homo sapiens
  misc_feature: GYAE6OF02JNSYS.49.9.A09.1.454.CMB.1.raw
  modified_base (298)..(298): a, c, t, g, unknown or other
  misc_feature (298)..(298): n is a, c, g, or t
  modified_base (377)..(377): a, c, t, g, unknown or other
  misc_feature (377)..(377): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccgaggacaggaccggccaggtttccctgtggacgggcaacaacagttggtaggtaaaggtgtgcactggtaccagcagagccaggccaggcccctggtgtggtcgtccgatgtntgacagccggacccggcccgtcgagggactcccgtaggacgtcgtattttcgtggctccgtaagtcgtaggggtaaccnccggacccacccgtggacccgttcgacggtccgtaggggtaccgaagggccggggtatacggggacggtcccgaacgttacgtaatcgttcggtcgtagggttggtaggggtagttaaggttagggtagtcggtccggtttaccgggttccgggggtttgtcccggggtaggggaccgggtaaccggtaaggttccgggaaccggtttcgggttacggccgtaaccggtcccgacgggtcctcccggtcccccgttacgggtccctaccgtttcccggttcccgtttacccccggccccctttcccgtccgtccccttccggtcccgtacccgg

SEQ ID NO: 57247 - DNA, 428 bp, Homo sapiens
  misc_feature: GYAE6OF02HSDS9.49.9.A09.1.454.CMB.1.raw
  modified_base (207)..(207): a, c, t, g, unknown or other
  misc_feature (207)..(207): n is a, c, g, or t
  modified_base (422)..(428): a, c, t, g, unknown or other
  misc_feature (422)..(428): n is a, c, g, or t
tcagagtcgagagacacgaccggtgctcgatttagcgagacgcgcagggggaagaccgatgggcccttggtggaggccgagttacagtgaccacgcggactctgtgaagggccgattcaccgtctccagagaaaacgccaagaacacggtgtatctgcaaatgactggcctgaaagccgaggacacggcagtttatactgtgcaagnggcttgtgtcgactgtcgacctggactggtacttcgatctggtggggcctggcaccctggtcactgtctcctcggcctccaccaagggcccatcggtccttcccccctggccacccctcctccaagagccacctctgggggcacagcggccctgggctgcctggtcaaggactacttcctctctcgactctgagcgggctggcaaggcgcatagnnnnnnn

SEQ ID NO: 57248 - DNA, 559 bp, Homo sapiens
  misc_feature: GYAE6OF02IYMNN.49.9.A09.1.454.CMB.1.raw
  modified_base (467)..(467): a, c, t, g, unknown or other
  misc_feature (467)..(467): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgatttttcgcggtctcccgaagtctaggggaaacaccggccaccctgaccgtcagcagggtacgaaggccggggatcggacggccgactatagtctgtcagggtgtgggtattaggtagtagtgcttcgttcgggggtgtcgggnggaggaccgtagttgaccgttgttggtcacgccgaggcctcgccccgttcggtcacttcgtcgttccccacccttcctctcctctcgtaccg

SEQ ID NO: 57249 - DNA, 568 bp, Homo sapiens
  misc_feature: GYAE6OF02F3TAC.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggccccctgtgttggtcgtccatgatgacagccgaccggccctcgagggactccctgagcgtattttcgtggcctccgaagtcgtgggaacaccggccacccgtcgaccgtcacgcgagggtcgaacggccggggatcggacggccgaactatactcgtgtcgagggtgtgggataggtagtagtgctcgttcggggtgttcgggcggagggacagttgaccgtctaggtcacgccgagtcgcggtccccgtcggtcctcgtccgtcgttccccgcccttcctccttcctccgtccgtaccg

SEQ ID NO: 57250 - DNA, 642 bp, Homo sapiens
  misc_feature: GYAE6OF02GYFKA.49.9.A09.1.454.CMB.1.raw
  modified_base (333)..(333): a, c, t, g, unknown or other
  misc_feature (333)..(333): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccaccctcggtgtccgtcggccccaggacagacggcctaggtttccctggtgagggcaaacaacagttggtaggtaaaggtgtgcacgtggtaccagcagaacgccaggccacggcccctgtgttggtccgtccatgatgacaggccgaccggccctcgagggctcccgngacgcgtacgtttcgcggtcctccgaacgtcgacgggaacaccggccctacccgtcgaccgtcgacgcgagggtccgaacgggccggggagtcggacgggccgaagtactacgtcgtgtcgagggtggtaggagttaggttaggtagttcggtcgttcgggttcgggggttcgttccgggcgggtacgggactaggttcgaccggttcggttcggtacgacgaccgtacggtcctccggtcccccgttcggtcctccgttccgttcccgttacccctccccgttccgtaccttccgtccgtccgttccg

SEQ ID NO: 57251 - DNA, 784 bp, Homo sapiens
  misc_feature: GYAE6OF02HKV82.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaagtgtgcactggtaccagcagaagcaggccaggcccctgtgttggtcgtccatgatgacagcgaccggccctcgagggactcccgtgacggcgtatttttccgtgggtcctccgaaaggttcctacggggaaacctaccggcccgtaaccccgtcggtaacccgtccaaggccgtaacgggggttaccggaaaacgggccccgggggggtaagttacggaaccggggcccgggtaaacgttaacgttacgttaccgttcggttaccggtagggttagggttacggggtaagttaacgggttaaggttaacggttcggtacgtttcccggttttcccggggggggttgtttaccgggggtacgggtaccgggggtaaaccgtaacgggttttccgggtaacccgggtttcgggttttcgggttcgaaccggtcccggaacgggtcgtcccgggtcccccccgttagggttacccgtaaccgttccccgtttaccggttcccccctaaccccgtttcccttacccgttccgttacccgttccggttaccccg

SEQ ID NO: 57252 - DNA, 575 bp, Homo sapiens
  misc_feature: GYAE6OF02H1FQD.49.9.A09.1.454.CMB.1.raw
  modified_base (337)..(337): a, c, t, g, unknown or other
  misc_feature (337)..(337): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgccggaaaccctcgagggactccctgacgcgtattttcgnggtctccaagtctagggaacacggccaccctgaccgtcagcagggtcgaaggccggggatcgaggcccgagttatactcgtgtcgaggtgtgggaatagtagtagtgtcgtcgttccggggtgttcggcggaggaccgtaaggtcgtaccgttcggttcggcaggcccaggtcgtacgcccccgtcggtcctacgttccgtcgttccccgccttccctcctaccttcgtaccgtaccg

SEQ ID NO: 57253 - DNA, 621 bp, Homo sapiens
  misc_feature: GYAE6OF02HVGFU.49.9.A09.1.454.CMB.1.raw
  modified_base (208)..(208): a, c, t, g, unknown or other
  misc_feature (208)..(208): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttcccngtgagggcaacaacagttggtggtaaaggtgtgcactggtaccagcagaagccagccgacggcccctgtgttggtcgtccatgatgacgagccggaccggccctcgagggactcccgtgagcgtattttcgcggtctccgaagtcgtcgggaaccgaccggcccacccgtcgacccgtacgacgccgaaggggtccgaacgggccggggagtcggacggccgtatatactcgtgtcgaggtggtaggagttaggtagtgtgtcgttcgggttcggggtggttcgggacggtacgggaccgtaggttcgtaccggttggttcgtcgaccgaccgacggtccgtcccggtccccgtccgggtactaccgttccgttccgttccccgtcccttcccgtccttccgtcgtccgtccg

SEQ ID NO: 57254 - DNA, 735 bp, Homo sapiens
  misc_feature: GYAE6OF02FLXZA.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcctaggtttccctggtgagggcaacaacagttggtaggtaaaggtgtgcactggtaccagcagaagccaggccacggcccctgtgttggtcgtccatgatgacagccggaccggccccgtcgacgggactcccgtggacggcgtactttttcgtggtcttcccaaaggttcgtacggggaaaccgaccggacccaccccgtcgaccgtcgacgcgacgggtacggaacgggccggggatcggacggacccgtaacgttagtactcgtgtacgtagggttcggtaggggtaagttaacggttagggttacgttacggtccgtttccggggttttccggggggttcggttccgggggacggggtacggggtaaccgttaagggttaccgggtacccggtttggttcgggttaccgacgggtaccccgtaacggcccggttacccggtcccccggttccggttaccctacccgtttccgttacccggtttcccccggtcccgtttccccgttcccttcccggttacccttcccggttacccg

SEQ ID NO: 57255 - DNA, 683 bp, Homo sapiens
  misc_feature: GYAE6OF02GAIZH.49.9.A09.1.454.CMB.1.raw
  modified_base (322)..(322): a, c, t, g, unknown or other
  misc_feature (322)..(322): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggcagacggccaggtttccctgtgagggcaaacaactattggtaggtaaaggtgtgcacgtggtaccagcagagccaggccaggcccctgtgttggtcgtccatgatgacagcgaccggccctcgagggactcccngagcgtattttcgtcggctaccgaagttcgtagggaaccacgggcccaccctcggaccgtcagccgagggtccgaacggccgggagtcggaaggccgaactagttactcgttgacgngggttgngggtattaggtagtaggtcggtcttccgggttttccgggggtggttccgggacggggtacggggtaaccgtaagggtttccggaacccgggtttcggttcggttacccggaacggtccccggtaaggggtcccttccccgggtccccccggttacggttcccgtaaccctttccgttaccccggtttaccccctacccccgtttccttcccgtttccgttcccgttacccggttacc

SEQ ID NO: 57256 - DNA, 549 bp, Homo sapiens
  misc_feature: GYAE6OF02HPCKP.49.9.A09.1.454.CMB.1.raw
  modified_base (310)..(310): a, c, t, g, unknown or other
  misc_feature (310)..(310): n is a, c, g, or t
  modified_base (332)..(332): a, c, t, g, unknown or other
  misc_feature (332)..(332): n is a, c, g, or t
  modified_base (419)..(419): a, c, t, g, unknown or other
  misc_feature (419)..(419): n is a, c, g, or t
  modified_base (452)..(452): a, c, t, g, unknown or other
  misc_feature (452)..(452): n is a, c, g, or t
  modified_base (461)..(461): a, c, t, g, unknown or other
  misc_feature (461)..(461): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (495)..(495): a, c, t, g, unknown or other
  misc_feature (495)..(495): n is a, c, g, or t
tcagagtcgagagacacgaccggtgctcgatttagcgagacgcgcagggcgtgggcctaaggaagcgagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacgattggtgtaaaaggtgtagcgactggtaaccagcagaagccaggccacggcccctgtgttgtcgtcatgatgacagcgaccgcctnaggactcctgacgcgtatttcnggcttcaaacgtcgtaggggaacaggccctaaccctagaccggtcacgcagggtaccgaaagccgggagtgacggcgatagatcgtntcgagtgtggacgtagtagtatgctgttcgggnttcggaggnggactaagtgacgttcgngtntacgctaacgggnttacggccccacgtccactcgtcgtacccgtcccgtccgtcttcgtctcggtac

SEQ ID NO: 57257 - DNA, 580 bp, Homo sapiens
  misc_feature: GYAE6OF02FU4YD.49.9.A09.1.454.CMB.1.raw
  modified_base (470)..(470): a, c, t, g, unknown or other
  misc_feature (470)..(470): n is a, c, g, or t
tcagagtcgagagacacgaccggtgctcgatttagcgagacgcgcgaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggtccctcgagggactcccgtgagcgtatttttcgtggctcccaagtctggggaaccaccggcccacccgtgaacccgtcagcgaggggtccgaaaggtcccggggatggacggccgactagtatcgtgtcgagggtgtgggattagtagtagtgctcggttcggggntcgtggcgggaggaccaggttggaccgtggttcgtcagcccgaaggcctccggcccccgttcggtcctacgtccgttcgttccccgccccttccgtcttccgtctacccg

SEQ ID NO: 57258 - DNA, 941 bp, Homo sapiens
  misc_feature: GYAE6OF02HPCJ9.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccaccctcggtcgtccgtcggccccaggacagacggccaggttccctgtgagggcaacaacattggtaggtaaaggtgtgcacgtggtaccagcagaagccaggccacggcccctgtggttggtcgtccatgatgacagccgaccggcctcgagggactcccgtagacgtacgtacttttcgcgggtacctccgtaaacgttcggttaacgggggaaaccgacccgggtcccctaaccccgttcgggtaaccccgttacgtaacggaccggtaacggggggtaccggaaacgggtccccggggggtaagtacgggaacgggtacccggtaaaccgtttaagtacgttaccgttacgggttaccggtaacggggttacgggttacgggggtaagtttaaacgggtttaagggtttaacgggttccgggttaccccgggttttaccggggttttcccgggggggggtttacgggttttacccgggggggaacccgggggttaaccgggggtaaaccccgggtttaaacgggtttacccggggttaaaccccggggttttccggggtttacgggttaacccggaacccgggtaacccccgggtaaaccggggttacccgggtttacccccgggtccccccccccggggtttacgggttaacccccgttacccggttttaacccccggtttcccccgggttttaaccccccccgttaacccccggttttccccctttaccccggttttcccgttacccccgtttacccgggtttaaccccgg

SEQ ID NO: 57259 - DNA, 831 bp, Homo sapiens
  misc_feature: GYAE6OF02JJP6D.49.9.A09.1.454.CMB.1.raw
tcagagtcgagagacacgaccggtgctcgatttagcgagacgcgcaggggcgtgggcctaaggaagcagcactggtggtgcctcagccatggcctggaccgttctcctcctcggcctcctctctcactgcacagactctgtcgacctcctatgtgtgacgcagcccacccgtcggtcgtcccggtggaccccaggaccaggaccggtcccgtacgggtttccccgtggtacggacgggaccaaaccgaaccgtaggtttacgggtagggttaaaagggtggttcgaccgtaacgttcggtaaccagacgagaaacgccgacggaccaacgggtccccctggtagttcggtccgtaccgtagtcgtacgtcggaaccgaggtacccggaccggaccccgtacgaacggggtactacccgtggaaccgtcggttaccttttcgacgggtcctaccgtaacggttcggtacgggaaccgtacggtacccgtacccggtacggacccggtacgtacggtaccggtaacgggtacgggtaacgggacccggggtagtaccgggaacggtacccgtaacttacggttaactccggtacggtacggtaacgggtcgggttacgggtaagttacggttaaggtacggttcgtaccggttcggggtttccggggttaggtcggggacggtacgggtaccgtaaggttccgggtacgtttaccgggtcggtaccgaccggggtaccgtaccggtcgtcccggtacccccggttaggtcccgtaacctccggtttccgtacccccgtcccttccgtcccgtaccgtttcccgacgttcccgg

SEQ ID NO: 57260 - DNA, 606 bp, Homo sapiens
  misc_feature: GYAE6OF02FMIU4.49.9.A09.1.454.CMB.1.raw
  modified_base (213)..(213): a, c, t, g, unknown or other
  misc_feature (213)..(213): n is a, c, g, or t
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
tcagagtcgagagacacgaccggtgctcgatttagcgagacgcgcagggggctgggcctaaggaagcagcactggtggtcgcctcagccatggcctggaccgttctcctcctcggcctcctctcctcactgcacagactctgtcgacctcctatgtgttgaccgcagccaccctcggtgtccgtggccccaggacagacggccaggtttcccngtgagggcaacgaacattggtggtaaaggtgtgcactggtaccagcagaacgccaggccaggcccctgtgttggtcgtccatgatgacaggccgaccggccctcgacgggacttcccgtgacgtccgtacgttttcnggtcctccaagtcgtagggaaccnccggccaccctgaccgtcacgcagggtcgaagggccgggagtggacgccgactagtacgtctgtcgaggtcggtagggacttaggtacgtagtcgcgttcggttccggggtgttcgggagggtacggacgtaggtcgtaccggttcgtggtcgacgcccgaggccgtccggcccccgtcggtcctaccttccgtccgttcccctacccttccctcctcctccgtccgtaccg

SEQ ID NO: 57261 - DNA, 735 bp, Homo sapiens
  misc_feature: GYAE6OF02F14U8.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattgggtggtaaaggtgtgcactggtaccagcagaagccaggccaggcccctgtgttggtcgtccatgattgacagccgaccggcccctacgaggggactccccgtgacgtcgtatttttcgtggccttaccgaagttcctacggggaaccaccgggccccaacccgttcgaccgtcgacgccgaggggtaccgaacgggcccggggatcgggaacgggaccggtaactaattacgttcgtcgttaccggtaagggttggtacggggtaattaagggtagttacggtcggtccggtttaccgggttccggggggttgtttaccggggacggggtaacggggtacccgttaaggggtttccggtacccgggtttaggttccgggtaccgtaccgacccgggtacggtccgtacccggttcccccgttccgggtcccgtaaccgttcccgtttacccggtttccccctacccccgtttcccgttccctttccgttaccccgttccggttaacccg

SEQ ID NO: 57262 - DNA, 530 bp, Homo sapiens
  misc_feature: GYAE6OF02I3IWK.49.9.A09.1.454.CMB.1.raw
  modified_base (397)..(397): a, c, t, g, unknown or other
  misc_feature (397)..(397): n is a, c, g, or t
  modified_base (460)..(460): a, c, t, g, unknown or other
  misc_feature (460)..(460): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggaccagcagaagccaggccaggcccctgtgttggtcgtccatgatgacagcgaccggccctgacgggatccctgacgcgtattttctggcctcgaagtcgtgggaacaccggccaccctgacccgtcagccgagggtcgaacgccggggganggacggccgaactatatcgtgtcaggtgtggtatagtagtagtgctcgttcggggtgttcggnggaggacaagttgccgtgtgtgngaccagcacgccccgtgcnctctcgtcccacctcctctctcgctacg

SEQ ID NO: 57263 - DNA, 576 bp, Homo sapiens
  misc_feature: GYAE6OF02I8C9P.49.9.A09.1.454.CMB.1.raw
  modified_base (335)..(335): a, c, t, g, unknown or other
  misc_feature (335)..(335): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaaggtgtgcactggtaccagcaagaagccaggccaggcccctgtgttggtcgtccatgatgacagcgaccggccctcgagggatccctgagcgtattttcnggctaccaagtctgggaaacaccggaccacccctgaaccgtcagcgagggtacgaacggcggggatggaaggccgactatatctgtcagggtgtgggattagtagtagtgctcgttccggggtgttcgggcggagggacctaaggttcgaccgttcgttcggtcgacgcccgaagccgtcggtcccccgtcgggtccaaccgtcgtccgttccccgcccttcctcctccttcctccgtacc

SEQ ID NO: 57264 - DNA, 869 bp, Homo sapiens
  misc_feature: GYAE6OF02I8169.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccacccgtcgggtcgtccggtcggccccagggacagaccggccgtacggtttccctggtggacgggacaaacaacagttcgggtaggtaaaggtgtacgctagtcggtaccagcaagaacgccgacggacctaacggccccttggtgttacggtcgtaccagtgtatcgacgtacgaccggaacccggcctacgaacgggtactccccgtggaacggttacggttaacttttcgtacggaccgttaccgaaacgggtttccggttaaccgggggaaaccacccgggtaacccgtaaccccgttacgggaaccccttacggaacggtaccgggtaacgggtaccgggaaacgggtacccgggggtatacgggaaccgggacccgttaaacggttaaactcggttaccgttacgggtacggtaaagggtttcgggttaggggtaaactttagggggttacgggttacgggttaagggtttcgttcccgggtttacggtttaccggggaaacggttccgggtaaccgggtaacccgggttaaccgggttaccgtaacccgttttccgggtaaaggtccccgttaaccgggaaccccgtaaccggacccccgtaaaccccgtacggtttaccggtaccctaaccgtttccgttaaccccgttaccccgttaacccgttccgccttttacccgttacccgccggttaaccc

SEQ ID NO: 57265 - DNA, 619 bp, Homo sapiens
  misc_feature: GYAE6OF02HEPAZ.49.9.A09.1.454.CMB.1.raw
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacaggacggccaggtttccctgtggagggcaacaacagttggtaggtaaaggtgtgcacgtggtaccagcaagaacgcaggccacggcccctgtgttggtcgtccatgatgacncgcgaccggccctcgacgggctccgtgagcgtattttcgnggcctcgaagtcgtagggaacaccggaccacccgtcgaccgtcaggcgagggtacggaaggccggggatggacggccgtaactatactcgtagtcggtaggttgggtagggtaagttaacggtagttaggtcgttacgttccgggttccgggggttgtccgggacgggacgggtaacgtaggttcgtaccggttggttacgacgacgacccgaggccgtccgtccccgtggtcctcgtccgttccgttccccacctccttctcctacgtccgtaccg

SEQ ID NO: 57266 - DNA, 697 bp, Homo sapiens
  misc_feature: GYAE6OF02H333B.49.9.A09.1.454.CMB.1.raw
  modified_base (642)..(642): a, c, t, g, unknown or other
  misc_feature (642)..(642): n is a, c, g, or t
tcagagtcgagagacacgaccggtgctcgatttagcgagacgcgcaggggctgggcctaaggaagcagcactggtggtgcctcagccatggcctggacccgttctcctcctcggcctcctctctcactgcacagactctgtgacctcctatgtgttgacgcagcccaccctcggtcgtccgtcggccccaggacagaccggccaggtttccctgtgagggcaacaacagttggtaggtaaaggtgtgcacgtggtaccagacagaagccaggccaggcccctgtgttggtcgtccatgatgacagccgacccggccctcgacggactccccgtgacggcgttacttttcgtggccttaccgaacgttccggtaggggaaccaccggtaccctaccccgtacggaacccgtcgaacgtaccggaggggtaccggaacgggaccggggtagtacggacgggcccgtaaacgttaacttaacgtcgttgtacggaagggttgggtagggagttaggtagtaggttacgtccgttacgggtttccggggtagttccgggacggggtacggtaaccgtaaggttcggtaccggttcggttcggccgtacgacccgacggtccctacccggtcccccgtaccggtccnccgtttacctccggttccccaccctttccccgtctacccgttccctacgtacccg

SEQ ID NO: 57267 - DNA, 634 bp, Homo sapiens
  misc_feature: GYAE6OF02F104J.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcctaggtttccctgtgagggcaacaacattggtggtaaaggtgtgcacgtggtaccagcagaagccaggccacggcccctgtgttggtcgtccatgatgacgagccgacccggccctcgaggactcccgtgaggtcgtattttcgtggtcctaccgaagtcgtacgggaaccgaccggaccctacccgtcggaaccgtcgacgcggaacgggtcggaacgggccgggggatacggacgggaccgtactagttacgtctggtcgtagggtggtgggaattagtagtgtgtcgttcggttcggggtgttcgggcgggtacggaccgtaggttcgtccgttcggttcggcgtacgaccgaggtccgtccggccccgtcggttacctccgttccgttccgttccctacccgttccctcgtttcccgttaccgttccgtaccg

SEQ ID NO: 57268 - DNA, 788 bp, Homo sapiens
  misc_feature: GYAE6OF02IZRN4.49.9.A09.1.454.CMB.1.raw
  modified_base (217)..(217): a, c, t, g, unknown or other
  misc_feature (217)..(217): n is a, c, g, or t
  modified_base (313)..(313): a, c, t, g, unknown or other
  misc_feature (313)..(313): n is a, c, g, or t
  modified_base (353)..(353): a, c, t, g, unknown or other
  misc_feature (353)..(353): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccgtcggtcgtccggtcggccccaggaccaggacggcctacggttttcccnggtgagggccaaacgaacagttggtaggtaaagggtgtggccacgtcggtaccagcagaacgccaggccacggcccctggtgtcggtcgtccatgntagacgacggccggacccggccctacgaggtacctcccgnggacgcgttatttcgtcggtcctaccgtaacgttccggtacgggtaacccgaccggtacccctaacccgtcggtaacccgtccaacgggtacggaacgggttacggaacgggaccggggtagtacggaccggtaacccggtaacttaacgtacggttacgtcggttaccggaggggttacggtacgggtaagttacggttaacgggttagttccgggtaccgttttcccggggtttcgggggttacggtcggggtaccggggaagggtacccgtaagggtttcgacccgggtttgggttcggtaacgaccggacccggtacggtccggttcccggtacccccggtacggttcccgtaaccgtttccggttacccgtttaaccccccgccccgttaccccgtttaccgccccggttttaccgtccccgttaaccgg

SEQ ID NO: 57269 - DNA, 617 bp, Homo sapiens
  misc_feature: GYAE6OF02HL8E5.49.9.A09.1.454.CMB.1.raw
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
tcagagtcgagagacacgaccggtgctcgatttagcgagacgcgcagggggctgggcctaaggaagcagcactggtggtgcctcagccatggcctggaccgttctcctcctcggcctcctctctcactgcacagactctgtgacctcctatgtgttgacgcagcccaccctcggtcgtccgtcggccccaggacagacggccaggttccctgtggagggcaaacaacagttggtaggtaaaggtgtgctacgtggtaaccagcagaacgccaggccgacggcccctggttgttggtcgtccatgatgacngccgacccggccctcgagggtcctcccgtggacgtcgtattttcgnggcctccaagtccgtaggggaacnccgccaccctgaccgtcgaagcgacgggtcgaacgggccgggatggacggtccagtatactcgtggtacgtagggtggtagggtaattaggttagtaggttcgcgttcggttccgggggtgttcgggacgggtaggaccgtgccgttacgccgttccgagtcgacgtcccgaggtccgtccgccccttggtccctacgtcgttccgtcccccgtccttacctcccttctccgtaccg

SEQ ID NO: 57270 - DNA, 727 bp, Homo sapiens
  misc_feature: GYAE6OF02HSOFJ.49.9.A09.1.454.CMB.1.raw
  modified_base (287)..(287): a, c, t, g, unknown or other
  misc_feature (287)..(287): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccacccgtcggtgtccgtcggccccaggacagaccggccaggtttccctggtggagggacaacaactagttaggtagggtaaaggtgtgcactgggtaccagcagaagccgaggccaggccccngtgttcggtcgtccaagtgatcgacaggccgaccggccctcgacggggctacccgtggagtcgtattttcgtcggccttaccgtaaggtcgtacgggaccgacggcccaaccccgtggacccgtacaggaccgtacggggcgaaacgggccgggggtagtagggacggacggactaatagtcgtgtacgtacggtggtaggtagtaagtagtagtacggttccgttacgggttcgggggttacggttcgggtacggggtacgggtaaccgtaacggttacgggttacccggttacgggttcggtaccggtaccgtacccgggtaacggtcccggtacccggtccccccggtaaccggttccgtaacccggtttcccgttaccccggttacccccgtacccccgttcccttacccttcccgttacccgtccgttaccccgg

SEQ ID NO: 57271 - DNA, 165 bp, Homo sapiens
  misc_feature: GYAE6OF02FVT21.49.9.A09.1.454.CMB.1.raw
  modified_base (162)..(165): a, c, t, g, unknown or other
  misc_feature (162)..(165): n is a, c, g, or t
tcagagtcgagagacacgaccggtgctcgatttagcgagacgcgcagggcacgaccggtgctcgatttagtcacgcagaaagggaaagggggctggccctgacgtgtttctgttcccaccctcctctctctcgactctgagcgggctggcaaggcgcatagnnnn

SEQ ID NO: 57272 - DNA, 621 bp, Homo sapiens
  misc_feature: GYAE6OF02FSAAT.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacgagccgacccggccctcgagggactcccctgacgcgtattttcgtggtctaccgaagtcgtagggaaccacggcccacccgtcgaccgtacagacgaggggtcgaacggccggggatggacggccgtaacgtaattactcgttcgtacgtagggtcggtagggtagttaggtagtagtcgtcttcgggtttccgggggtgttcgggcgggtacgggaccgtaaggttcggaccggttcggttggtccgacggcccgaaggcctccggccccgttggtcccaccgttcgtccgttccccgcccgttcctccgtccttccgtgtacccg

SEQ ID NO: 57273 - DNA, 711 bp, Homo sapiens
  misc_feature: GYAE6OF02I9ERZ.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaaggtgtgcactggtaccagcagaagccaggccaggcccctgtgtggtcgtccatgatgacagcgaccggcccgtcacgggacctccgagacgcgttactttcgtcggtcctaccgtaagtcgtacgggaaccgaccggaccctacccgtcggtaccgtaccgacgtaccggacgggtaccggaacgggaccggggtagtacgggaacggacccgtaattactacgttcgtacggtacggtggtaggtaggtaacgttaggttaaggtagttcgtccgttccgggggttacccggggttggttaccggggagggtaaccggggaacgtttaacgggttccgggtacccgggtttaggttcggtaccgtaacccgggacgacggttccgtaccccgtccccggttccgtcgtacccttccggtttcccggttcccccgtaccccgtttcctcccgttacccggtttcctaccgttcccg

SEQ ID NO: 57274 - DNA, 722 bp, Homo sapiens
  misc_feature: GYAE6OF02GKE94.49.9.A09.1.454.CMB.1.raw
  modified_base (346)..(346): a, c, t, g, unknown or other
  misc_feature (346)..(346): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaactagttggtaggtaaaggtgtgcacgtggtaccagcagaagccaggccaggcccctgtgttggtcgtccatgatgacagccgaccggcccctacgacgggactcccgtgacgtcgtatttttcgnggtcctccgaagtcgtacgggaaccgaccggcccacccgtcgacccgtcgtaacgcgacggggtacggaacggtccggggactagggaccgggcccgtaacgttataacgtcgttacggtacgtaacgggtggtacggggtagttaaggttacggttacggttaggtcccgtttccgggttcccggggggttgggtttccgggggtacggggtaacggggtacccgtaaagggtttccggtaccgggtttccgggtttcggtaccaccggtacccgacggtcccgtcccgtccccccggttcggttacccgtaccgtttcccgtccggttaccccctcccccgtttccctcccgttccgttccgtaccgtaccccg

SEQ ID NO: 57275 - DNA, 632 bp, Homo sapiens
  misc_feature: GYAE6OF02IPFNM.49.9.A09.1.454.CMB.1.raw
  modified_base (220)..(220): a, c, t, g, unknown or other
  misc_feature (220)..(220): n is a, c, g, or t
  modified_base (352)..(352): a, c, t, g, unknown or other
  misc_feature (352)..(352): n is a, c, g, or t
  modified_base (624)..(624): a, c, t, g, unknown or other
  misc_feature (624)..(624): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagctctgtgacctcctatgtgttgacgcagccaccctcggtgtccggtcggccccaggacacggaccggcctacgggttttcccctggnggacgggcaaacaactattgggtaggtaaaggtgtcgcacgtggtaccagcagaagccaggccaggcccctgtgttggccgtcatgatcgacagccgaccggcctcgaagggctccgtgacgcgtattttcnggctacagtcgtacgggaacacggccaacccgtcgaccgtagacgcggacgggtacgaacgggtccgggatacgggacgaccgtaactcgtaagtccgttagaccgtagggtcggtagggaagttaggtagttacggtcgtcgtcggtttccgggggtctcgggacggggagtacgtaacggttcgtaccgttcggtttacggcacgacccgtagtccgaccgtccccgttcgcctacctcgtaccgttccccgccgtccttccacgttccncgtacccg

SEQ ID NO: 57276 - DNA, 254 bp, Homo sapiens
  misc_feature: GYAE6OF02IRU0R.49.9.A09.1.454.CMB.1.raw
  modified_base (249)..(254): a, c, t, g, unknown or other
  misc_feature (249)..(254): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggccccaggacagcggccacggtttccctgtgagggcaaacaacattgggtagggttaaaagggtgtcnnnnnn

SEQ ID NO: 57277 - DNA, 815 bp, Homo sapiens
  misc_feature: GYAE6OF02JSSGT.49.9.A09.1.454.CMB.1.raw
  modified_base (306)..(306): a, c, t, g, unknown or other
  misc_feature (306)..(306): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgttgacgcagccaccctcggtgtccgtcggccccaggacagacggcctaggtttccctgtgaggcaacaactagttgggtaggtaaaggtgtgctacgtcggtaccagcagaagccgaggccacggccctagtgtcggtctcatcgatcgacngtaccgaccggtccctacgaagggtcctacccgtggaactcggttacttttcgacggtccttacctaaggttcccgtagggggaaacctaccgggtaccccgtaaccccgttacgggaaccccgttacggaacgtcccgggtaaaacgggggttccggaaaacggggtcccggggggtaaacgtcggggaaaccgggtacccggtaacgtaaagttaaccggttccgttacggttacgtaacggggttacgggtacgggtaagttaggttaacggtacggtacggtcccgtttcggggttacccgggggtttacgggttaccggggtacgggtaaaccgggggaccgtttaaacggggttcggtaacccggtttcgggttacgggtaccggaccggtaacccggtacgggccgttacccgggtcccccggttacggtacctaccggtttaccgttcccgttacccccgtaccgttccccgttaccttcccgttcgttaccccgtaccgg

SEQ ID NO: 57278 - DNA, 866 bp, Homo sapiens
  misc_feature: GYAE6OF02GJHIE.49.9.A09.1.454.CMB.1.raw
  modified_base (329)..(329): a, c, t, g, unknown or other
  misc_feature (329)..(329): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagacgtctgtcgaaccgtcctatgtagtgacgcagccacctcggtgtccgtcgccccaggacacgacggaccaggtttccctgtgagggacaaacaacagttaggtaggtaaaaggtgtgctaacgtcggtaaccaggacaaggaacgccgaaggccaacgggccccttggtaggtttcggcgtccaagttgaacgtnaacgagacggaaccccgccgtacgagggactcccgtagacgacggttactttttcggaggaccttaccgaaacgtttcggtaacgggggaaaccctaaccggggaccctaaacccccggttggaaccccggttaacgaccgaccgtacggggttacgaaaacggggcccggggggtaaatgggaaccgggtaccgtaacgtaacgttaaacgttccgttacggttaaccgtaagggtacgggtaggtaacgttaggtaacgtttagtaccgttaccgttaccggttaccggggggttacggtttaccgggacggggtaaccgggtaacccgtaaacgggtttacgggaacccgggtttacggtttaccggttacgaacccggtaacccgttaaaccggggtaccgtttaacccggtacccccccggttaacgggttaccccgtaaacccgtttaccggtttccccggttttaacccccgggcccccttttacccggttaccctttaccggtttaccccgttacccgggtttaacccg

SEQ ID NO: 57279 - DNA, 744 bp, Homo sapiens
  misc_feature: GYAE6OF02JE693.49.9.A09.1.454.CMB.1.raw
  modified_base (210)..(210): a, c, t, g, unknown or other
  misc_feature (210)..(210): n is a, c, g, or t
  modified_base (304)..(304): a, c, t, g, unknown or other
  misc_feature (304)..(304): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggccccaggacagaccggccaggtttcccngtgagggcaacaacagttggtaggtaaaggtgtgctacgtcggtaccagcagaagccgaggccaggccccctgtgttggtcgtccatgatgacngcgaccggccctcgagggactccccgtgagcgtaattttccgnggtcctaccgaagttcgtcggggtaaacnccggacccacccgtcgacccgttcacgcgacggggtacgaacgggccggggagttacgggaacgggcccgtaactacgtaacgttccgttaggtcgtagggttgggtacgggtagttaaggttaggttaaggttcggtccgtttccgggtttacccgggggggttggtttccggggccggggtaacggggtaaccgttaaggttccggtaaccgggtttcggtttacggtacgtaccggtaccccgtaacgggtccgttacccggtccccccggttcgggtaccctacccgttacccggttcccggttttccccccggtccccctttcccgttccccttacccgttcccgttccccggttaaccccgg

SEQ ID NO: 57280 - DNA, 703 bp, Homo sapiens
  misc_feature: GYAE6OF02G3E3Z.49.9.A09.1.454.CMB.1.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggccccaggacagaccggcctaggtttccctgtggagggcaaacaacagttggtaggtaaaggtgtgcactggtaccagcagaagccaggccacggcccctgtgttggtcgtccatgatgacngcgaccggccctcgaggactcccgtgagcgtattttcgnggtcctccgtaagttcgtacggggaacaccggcccacccgtcggaccgtcaagcgagggtcggaacgggccggggtagtaggacgggaccgacttaagtacttcgtggtacgtagggtggtagggtattaggttaggtaggttgtaccgtttccgggtttccggggggttgttccggggaccgggtaacggggtacccgtaaagggtttccggtaccgggtttccgggtttagggtaccgaccgggtacccgtaaggggtcccgttacccggtccccccgttcgggtcccgttacccgttcccgttcccggtttcccccgtcccccttcccgttcccgttccgttacccctccggtacccg

SEQ ID NO: 57281 - DNA, 162 bp, Homo sapiens
  misc_feature: GYAE6OF02F71FD.49.9.A09.1.454.CMB.1.raw
  modified_base (162)..(162): a, c, t, g, unknown or other
  misc_feature (162)..(162): n is a, c, g, or t
tcagagtcgagagacacgaccggtgctcgatttagcgagacgcgcagggcacgaccggtgctcgatttagtcacgcgagaaagggaaaggggctggccctgacgtgtttctgttcccgccctcctctctctcgactctgagcgggctggcaaggcgcatagn

SEQ ID NO: 57282 - DNA, 651 bp, Homo sapiens
  misc_feature: GYAE6OF02IFJ1H.49.9.A09.1.454.CMB.1.raw
  modified_base (206)..(206): a, c, t, g, unknown or other
  misc_feature (206)..(206): n is a, c, g, or t
  modified_base (352)..(352): a, c, t, g, unknown or other
  misc_feature (352)..(352): n is a, c, g, or t
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcaggtttcccngtgagggcaacaacagttggtacggtaaaggtgtgcgactggtaccagccagtaagccgaggccacggcccctgtcgttggtcgtccagttgattgacagcggacccggcctacgacgggtactcccgtggacgcgttattttcgngtcctccgaacggtcgtagggaacctacgggccctaccccgttggacccgttcgacgtacgtaggggttaccgaacgggcccggggatacgggtaccggaccgtaacgttagtaacgttcgttcgtacgtagggtcgttcgggaagtttggtaacgtagtcggtacctttcgggtaccggggttgttcgggtacgggacggtaccgtagttacgggaccgtttggtacggtcgacgaccgtacgtcgtaccctccgtacggtctacgtctcgtccaccgtcctacgtctccgtgtaccg

SEQ ID NO: 57283 - DNA, 842 bp, Homo sapiens
  misc_feature: GYAE6OF02JN4WL.49.9.A09.1.454.CMB.1.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (288)..(288): a, c, t, g, unknown or other
  misc_feature (288)..(288): n is a, c, g, or t
tcagagtcgagagacacgaccggtgctcgatttagcgagacgcgcaggggcgtgggcctaaggaagcagcactggtggtgcctcagccatggcctggaccgttctcctcctcggcctcctctctcactgcacagactctgtgacctcctatgtgttgacgcagccaccctcggtgtccgtcggccccaggacagacggccaggtttccctgtgagggcaanaacattggtggtaaaggtgngcactggtaccngcagaagccaggccaggcccctgtgttggtcgtcngtgactagacgaggccgacccgtcccgtcagggactcccgtggacgcgtattttcgtcggtcttcccgaagtcctggggaaaccaccggacccgtaccctcgaaccggtcaggtcgaggggtaccgaaacggtccgggggaacgttcgggacgggtacctacgttaaacgtacgttaccgtacggttccggagggttcggggtaacggggtacgtttaaagggtttaacggttaacgggttcgggttaaccgtttccggggttttcccggggggttaggggttttcccggggtaccgggggtaaccggggtaacccggttaaacgggtttaccggggtaacccggtttacccggggtttagggttaccccggtaacgggttaacccccggtaaggggtttccccggttaacccggggttccccccccggttcgggttacccggttaaaccccgtttccccgggtttacccgggttttacccccccgggtaccccctttacccccggggttaccccgtttccccggttttaaccccggtcccggtttaacccggg

SEQ ID NO: 57284 - DNA, 577 bp, Homo sapiens
  misc_feature: GYAE6OF02G9V7I.49.9.A09.1.454.CMB.1.raw
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
  modified_base (572)..(572): a, c, t, g, unknown or other
  misc_feature (572)..(572): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtggagggcaacacattggtggtaaaggtgtgcactggtaccagcagaagccaggccaggcccctgtgttggtcgtccagtgatcgacacgcgaccggccctcgagggactccctgacgcgtattttccgnggtctccgaagtcgtcgggaacnccggcccacccgtcgaccgtnacgcgacgggtcgaacgggccggggatcggacggccgaactatactcgtgtcgtagggtggtagggattagtaggtagtgtcgtcggttccggggtgtcggcgggacggacaggttcgcggttcgttggtcgacgacccgaggcctcggccccgtcggtcaccttcgtccgttcccgcctcctctctcnccgtc

SEQ ID NO: 57285 - DNA, 774 bp, Homo sapiens
  misc_feature: GYAE6OF02G5TSA.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgtgacgcagccaccctcggtgtccgtcggccccaggacagaccggcctacggtttccctggtgagggacaacaacagtttggtaggtaaaggtgtgcactcggtaccagcagaagccgaggccaggcccctgtgttcggtcgtccatgatgacagccgacccggccctcgagggtactccctggacgcgttacttttcgtcgggtactaccgtaacgtcggtacggggtaaccgaccgggaccctaccccgtagggaccccgttacacggtaccgacggggttacggaacgggtaccggggggatcgggacgggaccgtaacgtacgtacgttcgtacggtacgaggggttcgggtagggtaattaagggttaggttaggttcggtaccgtttccggggtttccggggggttacggttccgggggaccggggtacggggtaaccggttaacggttaccgggttaacccggtttccgggttgggttaccgacggtacccggtagggtcccggttaccccggtccccccggttcgggtacccttaccgttacccggtttccccggttaccccccgttacccccgtttccttacccccggttccctttaccgtaccccggttccg

SEQ ID NO: 57286 - DNA, 813 bp, Homo sapiens
  misc_feature: GYAE6OF02IO7TD.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccaccctcggttcgtccgtcggccccgaggacagaccggccgtacggtttccctgtgagggacaaacaactagttggtaggtaaaggtgtgacacgtggtaccagcagaacgccgacggccacggcccctggttcgttcggtccgtccgatgtatacggacgtacggccggtacccggcccctacggacgggtacctaccgtgacgtcgttacgttttcgtcggtcctaccgtaagtaccggtacgggaaccgaccggaccctacccgtcggtaccgtacgacggtacggacggggtaccgaacgggccgggggtaatacgggaccgggtacccgtaacgttacgtacgttcgttacggtacggtaggggttcggtagggtagttaaggtaacggttacggttcggtaccggtttcccgggtttaccgggggggttcggttccgggggtaccggggtaacgggttaaccgtaacgggtttacccgggtaacccgggttttccgggttcgggtaaccgtaccggacccggttaccggtaccggtttaccccggtacccccggttaccggtacccgtaacccgtttcccgtacccgtttacccccgacccctttccccgtacccttacccgttcccgttaacccgtacccgg

SEQ ID NO: 57287 - DNA, 724 bp, Homo sapiens
  misc_feature: GYAE6OF02INI0F.49.9.A09.1.454.CMB.1.raw
  modified_base (419)..(419): a, c, t, g, unknown or other
  misc_feature (419)..(419): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccgtcggtcgtccgtcggccccgaggacacgaccggcctacggtttccctggtggacgggacaaacaacagttggtaggtaaaggtgtgacacgtaggtaccagacgaagaacgccgaaggccaacggccccctggtagttggtccgtccatgatgaacagaccggaccggccctcgacggctcccgtgacgcgttatttccgtggtcctaccgaagtcgtagggaaaccaccggaccctaccgtggaccgtnaacgacgacgggtacgaacggcccggggatacggacggacccgacgttaatacgttcgtagtcgtaagggtgggtaggggaattaacgggtaagttacggtacgtccgttaccgggttcgggggttacggttccgggaccggggtaacgggaacccgtaaaggttcggaccccggtttcgggtttcggtaccaaccgggtacccgtaacgggtccgtcccgggtaccccccttacgggtacccaccgtttccgtaccgtttccccgtacccgttcccgttccgttacccgtccgttaccgtaccg

SEQ ID NO: 57288 - DNA, 697 bp, Homo sapiens
  misc_feature: GYAE6OF02H965B.49.9.A09.1.454.CMB.1.raw
  modified_base (359)..(359): a, c, t, g, unknown or other
  misc_feature (359)..(359): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggccccaggacacggaccggcctacgggtttccctggtcgagggacaaacaactagttgggtaggtaaaggtgtgcacgtggtaccagcaggaagccaggccaggcccctgtcggttggtcgtccagtgatcggacacgccgacccggcctcgacgggactcccgtgacgcgtacttcncgtggcctccgacggtcgacgggacaacgggtcaacgtattcggacctagtccgtaggtaggacgtaccgaggtacgaacgggtaagggacggagggtccgttagaaccgttaatttaggttacgtaacctaaacgtacaaaacgacgtaaccaacctaagttacggttaactttaagttcgttacgtttaccggaacttcggacccgaacgaacgggttaccacccggttcggtacgggttaccgaccggaaccccggtaacggacccccctaaaccccgtccttaccggtaccctacccgtttccgtaccgtttaccccccacccgtttacccccg

SEQ ID NO: 57289 - DNA, 686 bp, Homo sapiens
  misc_feature: GYAE6OF02IMH18.49.9.A09.1.454.CMB.1.raw
  modified_base (397)..(397): a, c, t, g, unknown or other
  misc_feature (397)..(397): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtcgtccgtcggccccaggaccagaccggcctaggtttccctgtcggacgggacaaccaactagttggtacggtaaaggtcgtgcacgtggtaccagacaagaagccgaggacccgacggcccctggtcggttggtccgtccatgtactgacaggaccgaccggccctcgacgggtactccgtgacgtcgttacttttcgcggtctaccgaagtcgtagggaaccnccggaccactacgtcgaaccgtactacgaactccggaccggggtaccacggggacgacggagtacgggacggcgtagtacctaacgttacgtacggtacgtaacggttacggaaacgaccgtaaccttaaacgtttcggtacctaagttacgttaccggggacggtaaacggtaacctaaagttcgtaaccggtcggtacggtacaccgtaccgaggtccgtccgtcccggtcggtccaccgtccgttacccgtccccgttaccctcccgttaccttcctacgtacccg

SEQ ID NO: 57290 - DNA, 788 bp, Homo sapiens
  misc_feature: GYAE6OF02ICFN7.49.9.A09.1.454.CMB.1.raw
  modified_base (132)..(132): a, c, t, g, unknown or other
  misc_feature (132)..(132): n is a, c, g, or t
  modified_base (322)..(322): a, c, t, g, unknown or other
  misc_feature (322)..(322): n is a, c, g, or t
  modified_base (560)..(560): a, c, t, g, unknown or other
  misc_feature (560)..(560): n is a, c, g, or t
tcagagtcgagagacacgaccggtgctcgatttagcgagacgcgcaggggctgggcctaaggaagcagcactggtggtgcctcagccatggcctggaccgttctcctcctcggccctcctctctcactgcanagactctgtgacctcctatgtgttgacgcacgccaccctcggtgtcccgtcggcccccagggaccaggaccggtcctacgggtttccctggtggagggcaaaccaactgttagggtagggtaaaggtcgtgcctacgtacggtacagcgagaacgccaggtcccacggccctagtggtggtcgtccagtnacgtgaacacggcgtaccccggaccgtacggtaccgggtctaccccgtggacgttcggtacgttttcgccggtacttcccgtaaaggtccgtacggggtaaccacccgggtaccaaccccggtacggaaccgttacgacgggaccggttaaacggggcccgggtaaacgggtcggggggaacttaccggggacgacccgtaaccgggttaactacggttaccgtagggtttaccgggngggttacgggttaggggttattaaggttaaccgggttagtaccgggttcgtaccggggtttcggggtcggttcccggggtacggtaccgggtactacgggttacggtcgggttacggttcggtaccgaacggtacccgtacgtcccgtcccggtacccgtcggttacctaccgtttcccgtaccgtttacccctcccgttcctccgttaccgtccgtaccgttcccgg

SEQ ID NO: 57291 - DNA, 826 bp, Homo sapiens
  misc_feature: GYAE6OF02GTO5Z.49.9.A09.1.454.CMB.1.raw
  modified_base (386)..(386): a, c, t, g, unknown or other
  misc_feature (386)..(386): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtcgtccgtcggccccaggacagacggcctacggtttccctggtgagggcaacaacagttggtaggtaaaggtgtgcacgtggtaccagcagaacgccgaggccgacggccctgtgttggtcgtccatgatagacgacgccggacccggccctcgacgggactcccgtagacgcgttacttttcgcggtcctaccgtaacgtcgtacgggaaccnccggaccctacccgtacggacccgtacgacggtaccggtacggggtaccggaaccgggaccgggggtaggtacgggaccgggaccccggtaaacgttaacgttacgttccggtttacgggtacggtacggggttacggggttacggggtaacggttaaaggggtttaagggtttacgggttcgggttacccggtttcccggggtttaccgggggggttcggggtttccgggggaacgggggttaacccgggggtaacccggtttaaacgggttaccgggttacccgggttttccgggttacgggttaccggaaccgggtaaccccggtaacgggttcccgtacccgggtaccccccggttcggttacccgttaacccgttccggtttcccggttcccccgtccccgttcccgttccttcccgttacccgtccggtacccg

SEQ ID NO: 57292 - DNA, 804 bp, Homo sapiens
  misc_feature: GYAE6OF02JPH4R.49.9.A09.1.454.CMB.1.raw
  modified_base (313)..(313): a, c, t, g, unknown or other
  misc_feature (313)..(313): n is a, c, g, or t
tcagagtcgagagacacgaccggtgctcgatttagcgagacgcgcagggctgggcctaaggaagcagcactggtggtgcctcagccatggcctggaccgttctcctcctcgcctcctctctcactgcacagactctgtgacctcctatcgtgttgacgcagccacccgtcggtcgtccgtggccccaggaccagaccggccacggtttccctcgtgagggcaacaacagttggtggtaaaggtgtgcgactggtaccaggcagaacgccaggccgacggccccctggttacggtttcggtcggttccacgttntacgtgactagccggacccggccctcgaacgggtactccccgttgcgtacgtacgttttcgcggtcctaccgtaacggttccgttacggggaaacccgtacccggtaccccttaccccggtacggtaacccggttccgaacggtacccggtaacgggggtacccgggtaaacgggaccccgggggtacggtacgggacgggtacccggtaaccttacgtaacgttcgttcggtacgtacgggttcgggtacgggtaagttaacgggttacggttacggtacgtccggtttccgggtttaccggggggtttcggttccggggtacgggtaacggggtaacccggttaaacggttaccggttaccggttcgggtttacggtccgtaacgccccggtaacgtccggttacccgccccccggttagttcccgtaccgttccgtttcccggttcccttccccgttcccgttccgtccgttaccgttcccgttaccg

SEQ ID NO: 57293 - DNA, 170 bp, Homo sapiens
  misc_feature: GYAE6OF02H6JC4.49.9.A09.1.454.CMB.1.raw
  modified_base (161)..(170): a, c, t, g, unknown or other
  misc_feature (161)..(170): n is a, c, g, or t
tcagagtcgagagacacgaccggtgctcgatttagcgagacgcgcagggcacgaccggtgctcgatttagtcacgcgagaaagggaagggggctggccctgacgtgtttctgttcccacctcctctctctcgactctgagcgggctggcaaggcgcatagnnnnnnnnnn

SEQ ID NO: 57294 - DNA, 796 bp, Homo sapiens
  misc_feature: GYAE6OF02FQPBF.49.9.A09.1.454.CMB.1.raw
  modified_base (161)..(161): a, c, t, g, unknown or other
  misc_feature (161)..(161): n is a, c, g, or t
  modified_base (189)..(189): a, c, t, g, unknown or other
  misc_feature (189)..(189): n is a, c, g, or t
  modified_base (305)..(305): a, c, t, g, unknown or other
  misc_feature (305)..(305): n is a, c, g, or t
tcagagtcgagagacacgaccggtgctcgatttagcgagacgcgcaggggctgggcctaaggaagcagcactggtggtgcctcagccatggcctggaccttctcctcctcgcctcctctctcactgcacagactctgtcgacctcctatgtgttggacgcngcccaccctcgggtgtccgtcggcccgnggacaggacggcctacggttccgtgtgagggacaacactagttgggtaggtaaaggtgtgcactcggtaccagcacgaagccaggccgacgcccgtcgtggtggtccggtccatgntgacacggccgacccggcccgtacgacgggacgtcccgtcgggtcgttacgtttcgttcggccgtactaccggtgttaccgggaacgccggccaacccgtcgaccgtcgagtccgaggggtacggaacgggccgggaaggtgaccgggacctacggttaattacgtaccgtggttacgacgggttagggtaggtaacggtaggttaacggtgggtacgttccggttccggggtttccgggggttacgggttccggggtaccggggtaacgggtacccggtaacgggtttccgggttaccgggttaaccgggtttcgggtaaccggtaccggggttaacccccggacggtacccggttccccggtaccccccggggtttcccgggtaccgtttaccccggttccccgtttaacccggtttcccccccggtaccccttttcccccggtttcccgttccccgttaaccgttcccccggttaacccgtttcccgg

SEQ ID NO: 57295 - DNA, 621 bp, Homo sapiens
  misc_feature: GYAE6OF02HABXX.49.9.A09.1.454.CMB.1.raw
  modified_base (337)..(337): a, c, t, g, unknown or other
  misc_feature (337)..(337): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaaacaacattggtggtaaaggtgtgcacgtggtaccagcagaacgccaggccaggcccctgtgttggtcgtccatgatgacaggcgaccggccctcgagggactccgtgagcgtattttcnggctccaagtctagggaacacggccctaccgtcgaccgtcacgacgaggggtcgaacggccgggatcggacggccgtaactagtacttcgtgtcgagggtgtgggagttaggttagtaggttcgcttcggtttaccggggtggttccgggacgggacgggtaccgaaggttcggaccggttcgttcggcgtacgacccgaggtccgtccgcccccggttcggtaccctacgttcccgttcgttccccgtccccgttccttacccgttcctcccgttccgtaccg

SEQ ID NO: 57296 - DNA, 657 bp, Homo sapiens
  misc_feature: GYAE6OF02G8A35.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcctacggtttccctgtgagggcaacaacagttggtaggtaaaggtgtgcacgtggtaccagcaggaagccaggccaggcccctgtgttggtcgtcatgatgacagcgaccggccctcgagggactcccgtggagcgtattttcgtggcctccgtaagtcgtacggggaacaccggcccacccgtcggaccgtcgacgcgaggggtcgaacgggcccggggatagggacgggccgtacgttaagtacgtcgtggtcgtagggtcggtgggtagttaaggtagttaggtgcgttcggtttccgggggttgttccgggacgggtacgggaccgtaagggttcggtaccgttcgggttggtcgacggtcccgagggtcctacggtcccccgtacggttcctaccgttccgttccggtttccccctacccctttccctacccgttcccttccgttacccgtacccg

SEQ ID NO: 57297 - DNA, 676 bp, Homo sapiens
  misc_feature: GYAE6OF02H06VP.49.9.A09.1.454.CMB.1.raw
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggccccgaggacacgaccgggcctacggttttcccctggtgacgggaccaaaccgaacgtagttgggtaggtaaaggtgtgcacgtgtaccagcagagccaggccacggcctgtgttggtcgtcatgatcgacacgccggacccggccctacgacggacgtcccngacgtcgttattttcgnggccttaccgaacgttccggtaggaaccgaccgggtacccaaccccgttcggaaccgttaccgacggacggagggtaccggaaacggggccgggggtaagacgggaccgggtaccggtaacttaacgtaacgttcgtagtccggtagggtcggtagggtagttaaggtagtagtcgtcgttcgggttcggggttcggtcgggtcggaggtaccgaggttcgtaccgttggtcgtcgcgaccgagtccgtcggccccttcggtacctcgttacgtcccgttccccgttccgtaccttccgtccgtcctcgtaccg

SEQ ID NO: 57298 - DNA, 959 bp, Homo sapiens
  misc_feature: GYAE6OF02J25BI.49.9.A09.1.454.CMB.1.raw
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtgacctcctatgtgttgacgcacgccacccgtcggtgtccgtcggaccccaggacagaccggcctacgggtttcccctggtcggagggaccaaactaactagttcgggtagggttaaaagggtcgtcgcctaccgtcgggtaacccaggaccgaaggaaacggccaacgggtaccccgacgggtcccccgttggttcggtttcggggtaccttcccaagttcgaagtcgaccgacggccgaacccggtcccgtacgacggtaccttccgtaggtacgtaccgttattttccggcggtaccgtaccgtaacgttcggtaacggggaaccgtacccgggtccctacccgttacggaacccgtacgacgggtaccgtaacggggttaccgaaaccggggtccgggtacgtacgggacccggtaacccgttaacgtttacaccggttacgttcggtaccgggtcgggttaccgggttagggtacgttaacggttaacggttacggacccggtttccgggtttaccggggtttccccggggggtttagttaacccggggtacccggggtaaacggggttaaccccggttaagggttttaacccggggtcccgggtttaccggggttttacgggaaccccgtttacccgggtaacccccgggtaacgggttccccggtttaaccccccgggttccccccgggtttacggtaaccccgttttaaccccggtttccccggtttacccccgggtttacccccccggttcccctttcccggtttaccccttttccccgggtttaacccgtacccggttttaacccccgggg

SEQ ID NO: 57299 - DNA, 770 bp, Homo sapiens
  misc_feature: GYAE6OF02FNRRI.49.9.A09.1.454.CMB.1.raw
  modified_base (330)..(330): a, c, t, g, unknown or other
  misc_feature (330)..(330): n is a, c, g, or t
tcagagtcgagagacacgaccggtgctcgatttagcgagacgcgcagggggctgggcctaaggaagcagcactggtggtgcctcagccatggcctggaccgttctcctcctcggcctcctctctcactgcacagactctgtgacctcctatgtgttgacgcagccaccctcggtgtccgtcggccccaggacaggaccggccgacggtttccctggtgagggcaacaacagttggtaggtaaaggtgtgcacgtaggtaccagacagaacgccgaggccgacggtcccctgttgttggtcgtccagtgatgacgacgccgacccggcccncgacgggtactcccgtggacgtacgttacttttcgtcggccgttaccgtaaggttcggtacggggaaccgaccggacccgtacccgtacggtaccgtacgaacggtacggtacggggtacggaacgggtccggggagtacggacgggaccgtaacgttacgtacgttcgtacgtacggtagggttgggtagggtagttaaggtaggttacggttgtaccggtttccgggtttaccgggggttcgggttaccggggacggggtaacgggtaaccgttaacggttacggtacccggttcggttacggtacggaccgtacccgtaacgggtcccgttacccggtacccccggttccggttacccgtaaccgttcccggttacccgtttaccccccgtaccccgtttcccttacccgttacccttacccgttaccggttacccg

SEQ ID NO: 57300 - DNA, 762 bp, Homo sapiens
  misc_feature: GYAE6OF02F0LZW.49.9.A09.1.454.CMB.1.raw
tcagagtcgagagacacgaccggtgctcgatttagcgagacgcgcagggggctgggcctaaggaagcagcactggtggtgcctcagccatggcctggaccgttctcctcctcggcctcctctctcactgcacagactctgtcgacctcctatgtgttgacgcacgccacccgtcggtcgtccggtcggccccgaggaccacggaccggccgtacggtttcccctggtggacgggaccaaacaacgtagtttagggtacgggtaaaggtcgtacgacctacgtacggtaaccaggaccgaacggaaccggacccgacgggccccgaccggtcccccgttggttcggtttccggtccgtaccgtagtacggtacgtacggaccgtacgggcccggtaccccggccctacggaacggggtacctcccgtacggacggttccgttacgtttccggcggtccgttaccgtaacggttcggtacgggaaccgtacccggaccctaccggtaccggaccgtacgacgaccgggtacgggtaccggaacgggccgggtagtacgggacggtaccgtaacgtcgtacgtcggtcggtacggtaggtggtaggtagttagtggttacgtcgtcgttcgggttcggggtgtccgggaggacggtacgtggtacgtcggttcgtcggtacacggcctaggccctccggtcccgtcgttctccggttacctcccggttacccctccttcccgtaccgtcccgtactccgttccgg

SEQ ID NO: 57301 - DNA, 168 bp, Homo sapiens
  misc_feature: GYAE6OF02F2WD3.49.9.A09.1.454.CMB.1.raw
  modified_base (163)..(168): a, c, t, g, unknown or other
  misc_feature (163)..(168): n is a, c, g, or t
tcagagtcgagagacacgaccggtgctcgatttagcgagacgcgcagggcacgaccggtgctcgatttagtcacgcgagaaagggaaagggggctggccctgacgtgtttctgttcccaccctcctctctctcgactctgagcgggctggcaaggcgcatagnnnnnn

SEQ ID NO: 57302 - DNA, 770 bp, Homo sapiens
  misc_feature: GYAE6OF02JS23U.49.9.A09.1.454.CMB.1.raw
  modified_base (393)..(393): a, c, t, g, unknown or other
  misc_feature (393)..(393): n is a, c, g, or t
  modified_base (519)..(519): a, c, t, g, unknown or other
  misc_feature (519)..(519): n is a, c, g, or t
tcagagtcgagagacacgaccggtgctcgatttagcgagacgcgcagggggctgggcctaaggaagcagcactggtggtgcctcagccatggcctggaccgttctcctcctcggcctcctctctcactgcacagactctgtgacctcctatgtgttgacgcagcccacccgtcggtcgtccgtcggccccaggacacggaccggccgtacggtttccctggtaggacggacaaactactagtttcgggtagggtaaggtcgtagaccgtacgttcggtaccagaccgaagaaccgccgaacggaccgaccggtccccgttggttcggttcggtccgtaccagtacgatacggaccacggcccggacccggtcccgaggaacggtaccttccgnggacgtcgtttacggtttcgaccggtctaccggacgtcggtaaacggaccgtacccggacccgtacccgtacgggtaaccctgaaccggtacgggtaacggggtacggaaccggggtaccgggtanaccggggtaacccgtacggtaaacttaacgttcggttacgtacgggtacggttacggggttagggtacgttaaggttaacggtaacggttcggttaccggttcggttaccgggttcggggtacgggttcgggacgggaacgttacggttacgtcggtaccgttggtaccgtgaccgtccgaggtcccgtacccgtcccggtgtacgtcgttcccgtacctccccgtcttccgtcttacccgtcgtactccg

SEQ ID NO: 57303 - DNA, 946 bp, Homo sapiens
  misc_feature: GYAE6OF02HZ1Y1.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctctatgtgttgacgcagcccacccgtcggtcgtccgtcggccccaggacacgaccggccgtacggtttccctggtggacggacaaacaactagtttacgggtagggttaaagggtgtacggactacgttacggtaccagctaaggaacgaccgacggcccgacggtccccttaggttcggttcggtccgtaccgtagtggaattacggaaccgacgggacccggtaaccccgggtccccgtacggaacggggtccttaccccgtaggaaccggtacgtttaactttttcggtccggtaaccttacccggtaaacgttccgggtaacggggaaaccgtacccgggtaccctaaccccggttacggtaaccccgtcgaaacggtaccgggtaacgggggttaaccggaaaccggggtacccggggggtaagttaccggggaacccgggtacccgttaaaccgttaaggttaaccgtttaccgggttacggtacccgggttaaggggttacggggttaacggggtaagtttaaacggggtttaggttacgggttaccgggttcccggggtttccgggggtttttacccgggggggttacgggtttaccggggggaaccggggtaacggggtaacccggttaaagggttccggttaacccggtttcgggttacggaccgtaccggacccggtaacgggtcccgttaccccggtccccggtttacggtacccttaccggttccggttaacccgtttcccccgtaaccccttccctttaccggtacccgtttcccgtaacgttcccgg

SEQ ID NO: 57304 - DNA, 708 bp, Homo sapiens
  misc_feature: GYAE6OF02HC6NU.49.9.A09.1.454.CMB.1.raw
  modified_base (406)..(406): a, c, t, g, unknown or other
  misc_feature (406)..(406): n is a, c, g, or t
  modified_base (493)..(493): a, c, t, g, unknown or other
  misc_feature (493)..(493): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccacccgtcggtcgtccgtcggccccaggacaggacggcccgtacggtttccctggtcgagggactaaacacgtagttggtaggtaaaggtgtgacgtactgggtaccagctaggaacgtcgacggaccgacggcccctggttacgttcggtacgtaccgattacggacttcggacgtaccggccgggtaccccggaccgttacgaacggggtacctcccgtaggtacgtccttagttttcgnggtcctaccgtaaagtcggtaacggaaaccgccggacctacccgtaggaccttgacgtcggacgggttacggaaccgggcgggtacnggacggcgtacgtagtacgtacgtgtaccggtaggtcgggtagtaagttacggtaaggtacggttacgtccgttcgggttacgggggttcttaccgggcgggtaccgtacggtacggttacgtaccgttggtacggtacgaccgccgtacggctcccggtacccgtctacggtacctcgtaccgtcccgaccgtcctccggtctacgtccgtacg

SEQ ID NO: 57305 - DNA, 886 bp, Homo sapiens
  misc_feature: GYAE6OF02FR53G.49.9.A09.1.454.CMB.1.raw
tcagagtcgagagacacgaccggtgctcgatttagcgagacgcgcaggggcgtgggcctaaggaagcagcactggtggtgcctcagccatggcctggaccgttctcctcctcggcctcctctctcactgcacagactctgtgacctctatgtgttgacgcagccaccctggtgtccgtaggccccaggacacggaccggctacggttttcccgtcgttggaggggaccaaacgaaccgtagtttacggtaggggttaaaacggtggttgacgtacgtacgggttaaccgaggcgaaggaaacggtacccaacggccgaacgggacccccgttggtttcggtttacgggttccgttacccgtacgttacggtacgttaggaaccgtacggtacccggaaccccggtacccgtcccggtaaggggtaaccgttcccgtacggacggttacggttaacgtttttccgtacggttccgttaccctaaggtttcggtaacgggaaaccgtaccggggaccctaaccccggtacggtaacccggtaccaccggtaggaacggggttacggaaacgggtccggggtaacggtcggaacgggtaccggaacttaaagttccgttaacgtcggtaccgtagggttacggtagggtacttaacgggtagttacgggtaagttccggttccgggttttaccggggttcgggtttacggggacggggtaacgggtacggtaagggtttaccgtaccgggtttacggttacgggtaccgtaaccgtaccggtaccgggtaccccttccccggttaccggtaccgttaacccgtcggttacccggtttaccctaccccggttcccttccgtttacccgtccgttaccggtaccctttcgg

SEQ ID NO: 57306 - DNA, 644 bp, Homo sapiens
  misc_feature: GYAE6OF02JCKZ0.49.9.A09.1.454.CMB.1.raw
  modified_base (174)..(174): a, c, t, g, unknown or other
  misc_feature (174)..(174): n is a, c, g, or t
  modified_base (191)..(191): a, c, t, g, unknown or other
  misc_feature (191)..(191): n is a, c, g, or t
  modified_base (209)..(209): a, c, t, g, unknown or other
  misc_feature (209)..(209): n is a, c, g, or t
  modified_base (342)..(342): a, c, t, g, unknown or other
  misc_feature (342)..(342): n is a, c, g, or t
  modified_base (618)..(618): a, c, t, g, unknown or other
  misc_feature (618)..(618): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtntccgtggccccaggacngaccggccaggtttcccngtgagggcaacacattggtggtaaaggtgtgccatggtaccagcagaacgccaggccaggcccccagttgttcggtacgtccatgatgactagccgaccggccctcgagggactccctgacgccgtattttcnggtcctaccgagttcgtcggggaactccggccacccgtgaccgttccaagcgagggtacgagccgggatcgggaacgccgaactagtctcgtagtctagggtgtggattgtcgtagcgtactttcgggtaccggggttgttacgggacggtacgggaccctaagggtttccggtaacccggttgggtttacgttacgacgtacccgacggttcgtccccggtccccgttacggtaccctacgtcccgttaccggtttccccccaccgtttcccccncgttacccgtcccgtaccgttcccgg

SEQ ID NO: 57307 - DNA, 787 bp, Homo sapiens
  misc_feature: GYAE6OF02ITISV.49.9.A09.1.454.CMB.1.raw
  modified_base (254)..(254): a, c, t, g, unknown or other
  misc_feature (254)..(254): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccgtcggtgtctgtgtcctcagacaggacgccaggatcactgctctgcgatgcagttcgaccaaaactatatgtcttacgtcgtaccngcagacgccaggccacggtccccttgttccgttagggtgtaagtttaagtaaaacggtacgtttaggaacggtccggcccttacggacgggtaccccgtgacggcgtatttccgtcgttcggacctccgacgtccgtacgaaacgggaaccaaacgtaccgtccgtaacccttcggaacctacgtaacccggtaggttaaccggggtacgggttaccccgggaaccgaacgggtaaccggggaccgggtaacgggtccgttaaggttaaacccgtttaacgtttaccgttacgggttaccgtaacgggttcccggacgtaaacgacgtacggaccggtagggttccgggtacgttaacgggtttaacgttcgggtttaaacgggttaccgggtttccggggacggggttaaaccgggtaccggttaacccgggttacggttaaccggttaacccccgggttaaccgttaacggtacccggtaacccggtccccggaacgggttcccggtaccccgggtcccccggtttacggg

SEQ ID NO: 57308 - DNA, 1049 bp, Homo sapiens
  misc_feature: GYAE6OF02J1SEB.49.9.A09.1.454.CMB.1.raw
  modified_base (220)..(220): a, c, t, g, unknown or other
  misc_feature (220)..(220): n is a, c, g, or t
tcagagtcgagagacacgaccggtgctcgatttagcgagacgcgcagggctgggcctaaggaagcagcactggtggtgcctcagccatggcctggaccgttctcctccgtcggcctcctctctcactgcacagactcgtgtcgacctctagttgtcgtagacgcgacgccgtaccgtcggtcgtccgccggcccgaggacacggacgccgtacggttccnggtaggacggaccaaacacgtagttgggtaggttaacggtgtacgtacgtacgtacgtaccgaggacgaagaccgaccgacggacccggtccgtcccgttggttcggttcggtcctcgtagtcgaaagtccggaacgtccggacccggtaccgtaccgtagggtaccgtaccgtcccgtaggtacccgtttacgttacgtttcccggtacggttaaccccgtacggtaaaaccggtttccggtaaaccccggggtaaacccgtaccccggggtacccccttaaaccccggttccggaaacccggttaccgggtaaccggggtttaaccccgggggggaaaccgggttaaaccggggtaacccgggggttacccgggggttaactaaccgggggtaccccgggtaaactttaaccggttaaccgggttaccgttcgggttaccggggtaagggtttaaccgggagggttaacgggttaaacgtttacggggttaaccgggttccggtttacccgggtttcccgggggtttacggggggtttaccccgggggttaacgggttaaccccgggggttaacggggaacccggttttaaaccggtaacccggggtttcccggggtttaccgggttcccgggtttaaacgggccccgtaacccgggttaacccggggtcccgtaacccccgggttttacccccggtaccccggttaaccggttccctttaacccccggggttttcccccgttcccccgggttcccccggttttaacccttacccccggttttcccgtttaacccggttacccccgggttagtttaacccccccggg

SEQ ID NO: 57309 - DNA, 804 bp, Homo sapiens
  misc_feature: GYAE6OF02JVT5M.49.9.A09.1.454.CMB.1.raw
  modified_base (596)..(596): a, c, t, g, unknown or other
  misc_feature (596)..(596): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccaccctcggtcgtccgtcggccccaggacagacggccgacggttttccctggtggagggcaaaccaactagttcgggtaggtaaaggtgtcgcaccgtgggtaccagcaaggaacgaccgtacggaccgaccggtacccccgtggttcggttcgggttccgttcccgaagttcgagttacgaaccggacggtacccggtaccccggccccgtaccggtaaccggggtaccttccccggtaagggtaccgtacggttaccgttttttccggtacggtaccgtaacccgtaacggttaccggtaaaccgggggtaccgaccccggtacccgtaccccgtacgggtacccgtacgtacgcggtaacgggtaccgggaacgggtccgggaggtcgacgggaccgacttaacgtgttcgtcggtcggtaggttgggnggtaaggttggtacggttagtcgtccggttacgggtttccggggtgggttcgggaccgggtacgggtaccggttaaggttccgggttacggttccggttacggtcgaccgtaccggtaacggccggtacccgtccccgggttccgtaccgtaccgttcccgttccgttccccgtcccttccctcccgttccgttccgtcccgtaccgg

SEQ ID NO: 57310 - DNA, 719 bp, Homo sapiens
  misc_feature: GYAE6OF02HAYI4.49.9.A09.1.454.CMB.1.raw
  modified_base (355)..(355): a, c, t, g, unknown or other
  misc_feature (355)..(355): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccgtcggtgtccgtggccccaggacaggacggccaggtttccctgtgagggcaaacaactgttggtaggtaaaggtgtgcacgtggtaccagcagaacgccgaggccaggccctgtgttcggtcgtcagtgatagacgacggccgaccggccctagaacggacctcccgtggaagtcgttattttccgnggtccttaccaacggtcgttacgggaaccaccgggtacccacccgtcgaacccggtgaacggccgtaaggggtaccggaacgggcccgggtagtcggacgggacccgtaaacgtactacgtcgttcggtaccgagggttcggtagggtaagttaaggtaggttaacgtcgtcgttccggttcgggggttcggttccgggacgggtacgggtaaacctagggttaccgaccgggtttcgtcggtaccgacgtacccggtacggtccgtccggttccccccggtacggttcccgtacgtttccccgtttacccggtttcccccgaccccgtttcccctacggtttcccttaccgtacccgttaccg

SEQ ID NO: 57311 - DNA, 682 bp, Homo sapiens
  misc_feature: GYAE6OF02FMWOV.49.9.A09.1.454.CMB.1.raw
  modified_base (488)..(488): a, c, t, g, unknown or other
  misc_feature (488)..(488): n is a, c, g, or t
  modified_base (649)..(649): a, c, t, g, unknown or other
  misc_feature (649)..(649): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgttgttgacgcagcccacccgtcggtgtccgtcggccccaggacaggaccggccgtacggtttccccgtggtggagggaccaaacaactagttggtaggtaaaggtgtgacacgtacggtaccagcaagaagccaggccacggcccctgtgttggtcgtcatgactgacagccggacccggccctacgaggactcccgtgacgtcgttactttcgcgcctaccgagtcggtaggtaaccgaccggaccctacccgtacgacccgtcacggtacgacggggtacgaaccgggaccgggatcgggacggtaccgaacgttattacttcgtaggttacggngggttgggagggtattaaggtagtaggtcgcgttccgggtttcggggtcggttcgggtacgggacgggtaaccgtaaggttcgggaacgttcggttgtaccggacgtacccggagtccgtcccgtcccgttcggtacctccgtttccgtccgttacccccncccgttcccgtccttccgttacctcgttaccgg

SEQ ID NO: 57312 - DNA, 800 bp, Homo sapiens
  misc_feature: GYAE6OF02INDCQ.49.9.A09.1.454.CMB.1.raw
  modified_base (271)..(271): a, c, t, g, unknown or other
  misc_feature (271)..(271): n is a, c, g, or t
  modified_base (312)..(312): a, c, t, g, unknown or other
  misc_feature (312)..(312): n is a, c, g, or t
tcagagtcgagagacacgaccggtgctcgatttagcgagacgcgcaggggctgggcctaaggaagcagcactggtggtgcctcagccatgcctggaccgttctcctcctcggcctcctctctcactgcacagactctgtgacctcctatgtgttgacgcagcccacccgtcggtcgtccgtcggccccaggacagacggccgacggtttccctgtggagggcaaacaactagttaggtaggtaaaggtgtagctacgtgtaccagcagganccacggccgacggccctgtcgttggtcgtccatgatcgacncggccgaccggccctacgacgggtacctcccgtagacgtcgttaacgttttcgcggtcctaccgtaacggttaccgtacgggaaaccgtaccggcccctaccgtcggaaccggttacgaacgaccggtaacggggtaccgggaaaacggggtcccggggtaagtcggggaaaccggtacccgtaaacgtttaaacgttacttaccggttacggtaccgggtagggttagggttacgggtaaatttacgggttaaggtcggtttaggttacccggtttcggggtttccgggggttgggtaccggggacgggtaaccggggttaacgtaaccgggtttacgcccgggttttacggggtacggtacccgacccgggtaccaccggggttccctcccggtcccccgttcgggtaacccttccgttaccggtttccccgttacccgtcccccgtttcccgttacccggtcccgttaccggttcccgtaaccgg

SEQ ID NO: 57313 - DNA, 754 bp, Homo sapiens
  misc_feature: GYAE6OF02IB7QW.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgttgacgcacgcccaccgtcggtcgtccggtacggcccaggacacggaccggccgtaggtttcccgtggtcggacgggacaacaacgtagtttacgggtagggtaaaggtgtcgactacgtaggtaccagtacaagacgccgacggccgtaccgggcccgttggttacggttcgggtccgtaccgtagtacgtagtacgaacgacggaccggacccggtcctacggacgggtacctcccgtaggacggtacgttacgtttccgacggtcctaccgtaacggttcgtaacgggtaaccgccggtaccctaccgtacggaccgtcgacgtacggacgggtacggacgggcgggtagtacgggacggtaccgtatagtctcggttgacggtgggtaggtacggtattacggtagtacgcgttcgggttcgggtaccggggttgggtacgggacgggtacgaccgttaaggtcggttaccggttcggttacgcgtacccgaccgtacgggtccctacccgggtccccgtaacggtccttcccgttaccgttccccggttacccctccccgttaccgttcccttaccgttaccccgtgttacccgg

SEQ ID NO: 57314 - DNA, 704 bp, Homo sapiens
  misc_feature: GYAE6OF02F4HOF.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcctaggtttccctgtgagggcaacacagttggtaggtaaaggtgtgcactggtaccagcaagaagccgaggccgacggcccctggtgttggtcgtccatgatgacagccgaccggccctcgagggactccctgacgtcgtaattttcgtgtcctaccgagtcgtacgggaactaccgccacccgtagacccgtacgcgtaccgacggggtaccggaacgggccggggtatcgggaacgggacccgtaacgtacttaacgtccgttacggtcgtaaggggttggtaggggtaagtttagggtcggggtttagtacggggttcgtttacgggtttccggttcgggtaacgtccgggtacggggacccgtaggggtcccttacccgggttccgtacggtcaaccgtaccccgacggtaccccaaaccccgtcgttcgtaccctacccgttaccgttccggttccccccggtccctttacccgtcctttacccgttcccgtacccgtacccg

SEQ ID NO: 57315 - DNA, 632 bp, Homo sapiens
  misc_feature: GYAE6OF02GK7AJ.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtaggtaaaggtgtgcactggtaccagcagaagccaggccaggcccctgtgttggtcgtccatgatgacagccgacccggcctcgagggactcccgtggacgcgtacttttcgtcggccttaccgaaagttcgtacgggaaccaccgggaccctaccccgtcgacccgtcacggcgaaggggtacgaacgggccggggataggacggccaatagtactctgtctagggtgtaggatagtagtagtcgtcgttcgggttcggggttgtcgggacgggacgggaacgtaggttcggtaccggttacggttcggacgaccgaccgtacggccgtccggtccccgttacggtcctaccgttccgttcccggttccccgccccgttccttccgtaccttccgtaccgtccg

SEQ ID NO: 57316 - DNA, 932 bp, Homo sapiens
  misc_feature: GYAE6OF02FY76H.49.9.A09.1.454.CMB.1.raw
  modified_base (211)..(211): a, c, t, g, unknown or other
  misc_feature (211)..(211): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccgtcgtgtccgtcggccccaggacagacggcctacggtttcccngtggagggcaaacaacagtttgggtaggtaaaggtgtcgactacgtggtaaccaggacgaggaagcccgaggccgaacgggcccccttaggttcggttcgggttccggtacccaagttaggaagtggtaaccacgggtcccggaaccccggtccccgtacggaacgggaccttaccccggtggtacgtacggttactttttcgagggtccctacccgtaacggttaccgtacggggaaaccgtaaccgggtcccctaaacccggtccggaacccgggttacgacgggtaccggtacggggttaccggaaaccggggtacccgggggtaagttaccgggaacgggtacccggtaaaccgttacgttactccgggttacgtaacggtacggggttacggtagggggttaaggttaacgggttaagggttaagggttaccggtcgggtttccggggttttaccgggggggttcggttacgggggaccggggttaaccggggaaaccgttaacggggtttacccgtacccgggttttcggttcgggttaccggtaacgggtcccccgaaacgggggttcccgtaccccggggttacccccgggttccgggttaaccccgttaacccccggtttaaccggtttcccccggttttacccccgggttccccccgttacccccggttttacccgttaccccggtttacccgtcccccggtttaacccgg

SEQ ID NO: 57317 - DNA, 695 bp, Homo sapiens
  misc_feature: GYAE6OF02FJQN7.49.9.A09.1.454.CMB.1.raw
  modified_base (127)..(127): a, c, t, g, unknown or other
  misc_feature (127)..(127): n is a, c, g, or t
  modified_base (129)..(129): a, c, t, g, unknown or other
  misc_feature (129)..(129): n is a, c, g, or t
  modified_base (138)..(138): a, c, t, g, unknown or other
  misc_feature (138)..(138): n is a, c, g, or t
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
  modified_base (500)..(500): a, c, t, g, unknown or other
  misc_feature (500)..(500): n is a, c, g, or t
  modified_base (519)..(519): a, c, t, g, unknown or other
  misc_feature (519)..(519): n is a, c, g, or t
  modified_base (588)..(588): a, c, t, g, unknown or other
  misc_feature (588)..(588): n is a, c, g, or t
tcagagtcgagagacacgaccggtgctcgatttagcgagacgcgcaggggcgtgggcctaaggaagcagcactgtggtgcctcagccatggcctggaccgttctcctcctcgcctcctctctcactncncagactctntgacctccatgtgttgacgcagccacccctcggtgtccgtggcccccaggacngacgccaggtttcccngtgaggcaacacattggtggtaaacgngtgacactcgggtaccagcaagagccaggccaaggcccccttggtgttggtccgttccagtgatgaccngccggacccggccctcgagggtactccccgttgaacggtcgtaccgttttttccggctacctaacggtccgttcgggaaccgacggcccctaccccgtgtaaccccggcaggtacccgagggggttccgaagggcccggggagtaccggtaacgggcccgaaaccttacgtaactaccgttcgacgacgtttacggngggagtcgttaagtacggngttactcgggtttccgggggttgtttcgggcggtacgggaccgaacggtttacggtaccggttccgttntacggacgcccgtaacgggctccggaccccccgtccgggtccaccggttcccttcggttaccccaccccttcccgttaccgtcctttacccgccgttaccgttaccg

SEQ ID NO: 57318 - DNA, 587 bp, Homo sapiens
  misc_feature: GYAE6OF02GZ43C.49.9.A09.1.454.CMB.1.raw
  modified_base (536)..(536): a, c, t, g, unknown or other
  misc_feature (536)..(536): n is a, c, g, or t
  modified_base (577)..(577): a, c, t, g, unknown or other
  misc_feature (577)..(577): n is a, c, g, or t
tcagagtcgagagacacgaccggtgctcgatttagcgagacgcgcagggggctgggcctaaggaagcagcactggtggtgcctcagccatggcctggaccgttctcctcctcggcctcctctctcactgcacagactctgtgacctcctatgtggttgacgcagccaccctcggtgtccgtggccccaggacagacggccaggtttccctgtgagggcaacaacattggtaggtaaaggtgtgcactggtaccagcagaagccaggccacggcccctgtgttggtcgtccatgatgacagccgacccggccctcgagggactcccctggacgtcgtacttttcgcggtacctacccgtaaggttccgtacggggaaaccgaccggaccctaccccgtcgacccgtcacgcgagggtcgaacgggcggggtatggacggccgacgtatactcgtgtacgagggtggtagggtattaggtagtagtcgtacgttcggttcggggtgtcgggcggacggactaggtcgacgttgtcgcncgaccagctcgtcccgtgtcctcgtctccgtcccgcctccnctctcgtctc

SEQ ID NO: 57319 - DNA, 701 bp, Homo sapiens
  misc_feature: GYAE6OF02HS301.49.9.A09.1.454.CMB.1.raw
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
tcagagtcgagagacacgaccggtgctcgatttagcgagacgcgcaggggctgggcctaaggaagcagcactggtggtgcctcagccatggcctggaccgttctcctcctcgcctcctctctcactgcacagctctgtgacctcctatgtgttgacgcagccaccctcggtgtccgtggccccaggacagacggccaggtttccctgtgagggacaaacaacattgggtaggtaaaaggtgtgcacgtggtaccagcagaacgtccaaggacacgccctgtgttcggcgttccgatggatcgacacgtccgaccggcctcgagggactcccgtgacgcgtntttcncggtctaccaagtcgtacgggaactacggcctacccacgaccgtacacgacggacgggtacgaacgggaccgggagtaggaacggtcccgaattaacgtaacgttctaggtacggtaagggtgggttagggtacgtaaacggttagtacggttaggtccttcgggttcccgggggtttacgggtttacggggaccgggtacgggtaaaccgtaaacggttacggtaaccggttcgggttcggttaacgtaccggacccgtaacggaccgtcccggtcccccgttacggttccgtaaccgttaccgttcccgtttacccgtccccgtaccttccgttaccttccgttcccgtaccg

SEQ ID NO: 57320 - DNA, 944 bp, Homo sapiens
  misc_feature: GYAE6OF02J21XS.49.9.A09.1.454.CMB.1.raw
tcagagtcgagagacacgaccggtgctcgatttagcgagacgcgcaggggctgggcctaaggaagcagcactggtggtgcctcagccatggcctggaccgttctccgtcctcggcctcctctctcactgcacagactctgtgacctcctatgtgttgacgcacgccaccctcggtcgtccgtcggccccaggaccgacgtaccggccgacggttttcccctggtggacgggccaaaccgaaccgtagtttcgggttagggttaaaacgggttgtcggtacctaccgttacgggttaaccccaaggtaccgaaggaaaccggcccgaacgggtcccgaaccgggccccccgttaggttcggtttcgggttcccgtaccgtagttacggtaacgttcggaccgaacggtcccggtaaccccgggccccgtttacgggaaacggggtcctttacccccgggttagggaaaccggttccggtttaaccgtttttttccggaccggggttaccctttaacccggaaacgggtttcccggttaaaccgggggaaaaccccgtcccggggtaccccgtaacccccggttacggtacccggttaccgaaaccggtccgggtaaaccgggggtacccggtaaaacggggtcccgggggttaaacgtcgggtaaccgggtaccccggtaaacgtttaacgtaaccgttccggttacggttaccggtaaggggttacggttacggggtaaacgtttaggtttaaccggttaggttccggttacggtttccgggttacgggggttcgttacgggacgggtacggtaccgtaggttccgtaccggttcggttacggcgtaccgaccgtacggtccttcccggtacccggtgtaccgtacgttcccgtccgttaaccccgtccgttacccttccggttaccttccgtaccgttaccgg

SEQ ID NO: 57321 - DNA, 770 bp, Homo sapiens
  misc_feature: GYAE6OF02H8DJY.49.9.A09.1.454.CMB.1.raw
  modified_base (225)..(225): a, c, t, g, unknown or other
  misc_feature (225)..(225): n is a, c, g, or t
tcagagtcgagagacacgaccggtgctcgatttagcgagacgcgcaggggctgggcctaaggaagcagcactggtggtgcctcagccatgggcctggaccgttctcctcctccggcctcctctctcactgcacgagactctgtgacctcctatgtgttagacgcacgtcccacccgtcggtcgtccggtcggccccgaggacgacgaccggcctacggtttcccnggtcgagggaccaacaactagttgggtaggtaaaggtgtcgactacgtcggtaccaggacgagaacgccgacggtccgaccggccccgtggttcggttggtaccgtctagtcgatagtaacgaggccggtaccggcccgtagaaggtacctccgagtacgtcgttacgtttcgtcgctacctaacgtcggtacgggtaccgaccgggacccaaccgttcgacccgtgacgaccggaggggtaaccggagggcccggggaatacgggacggtaccgtacgtaagtacgtcgttgtacggtgggtcggttgggaacttaagggtagtcggtaggttcggtttaccgggttccggggtttcggttaccggggtacggggacggtaaccggttacgggtttcgggtaacccgttgggttaccggcgacccggtaccgaccgggtccgtacccgggtcccctaacgggttccctaccggttttccccttcccggtttaccccgtccccttttacccgtcccggtttacccttcccgggtacgttccccgg

SEQ ID NO: 57322 - DNA, 685 bp, Homo sapiens
  misc_feature: GYAE6OF02F96QI.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtggagggcaacaacattggtaggtaaaggtgtgcactggtaccagcaagaagccaggccaggcccctgtgttggtcgtccatggatgacaggcgacccgggccctacgaggggtactccccgtggacgcgtaactttttcgtggtcctccgtaaagtcgtacggggaaacctaccggccctaaccccgtcggacccgttcgaacgcgaacggggtaccggaaacgggcccgggggagtacgggaacgggtacccggtaacgttagtacttccgttgtaccgtagggtggtcggggtattaggtagttaggtcggtcgttcgggttccgggggttaggttcgggacggggagggtaccgtaggttcggaccggttcgtggtcgacgacccgaggtccgtccggtccccgtcggtacctaccgttccgttaccgttaccccgtaccccttcccgtaccgtccgttcccgccgttaccg

SEQ ID NO: 57323 - DNA, 776 bp, Homo sapiens
  misc_feature: GYAE6OF02HQZQG.49.9.A09.1.454.CMB.1.raw
  modified_base (408)..(408): a, c, t, g, unknown or other
  misc_feature (408)..(408): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagcccaccctcggtgtccgtcggaccccaggacaggaccggacctacggtttccctggtaggacgggacaaacaacctagttggtaggtaaagggtgtcgactacgtggtaccagcaagaacgccaggccacggcccgtagtgttcgtcgtcatgatgacagccggaccggccgtacgacgggtacctcccgtagacgtcgttacgttttcgtacggtctaccgtaaggtccggtacggggtaaaccncccggaccctaacccgtacggaacccgtcgacggaccggtaacgggtaccggaacgggtccggggtaagtcgggaccggtaccgtaacgtaatacgtacgtacggtacggttagggttacggtaggggttacgtaaggttacggtacggttcgggtaccggtttccggggtttaccggggggtttcgggttaccgggggtacgggtaccggggtaaccggttaacgggttacgggttacccgggtttcggttacggtacccggtacggacccgggttacggccgtaaccccggtccccgttaccggtccaccgtttcccgtcccgttccccgttaccctccgttacccttccttaccgtccttaccgg

SEQ ID NO: 57324 - DNA, 731 bp, Homo sapiens
  misc_feature: GYAE6OF02JY2LO.49.9.A09.1.454.CMB.1.raw
  modified_base (138)..(138): a, c, t, g, unknown or other
  misc_feature (138)..(138): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (356)..(356): a, c, t, g, unknown or other
  misc_feature (356)..(356): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactcngtgacctccgtatgtgttgacgcagcccacccgtggtgtccgtcggccccaggacagccggccacggtttccctggtacggagggtccaaactaacgtagtttggtacggtaaacggtgtgactacgtggtaccagcgagaacgccgaacgcgacgtcccgtgtgttacggtcgtcagtgtanacgacnggtccgaccgccgtagacggtctccgagngtcgtagttcgaggcctacgtagtcgtacggaccaccgtcctactcgacgtacgtacgcggtacggtacgaacgggttcggagtacggacggtccctaagttacgtacgtcgttcgtaggtacgggttaggtacggtacgttaggtaacgttcgtacggttcgtttaccgggtcggggttacgttaccggggacgggaacccgggttaactaagggttcccggtaaccggtttacggtacgacggtacccgtaacccgggagttacccggttacccggacccccggtttacgtaaccggtcccggtttccctaacccgggtttccccctaccccgttccgtttacccggttccgttacccgtacccgtttcccgg

SEQ ID NO: 57325 - DNA, 792 bp, Homo sapiens
  misc_feature: GYAE6OF02FV9AO.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccacccgtcggtgtcccgtcggccccaggacagaccggcctacggtttccctggtcggagggtacaaacctaactagttacgggtaggtaaaaggttggtagactacgttacggtaaccagcgaacgacgccgaggaccgacggtcccgttggttcggttcggtccgtactagtacgtagtacgaacgcggaccggacccggtacccgtacggacggtacctaccgtaggtacgtacgtttacgtttacggtcgtaccgtaccgtaacggttcggtacggaaccgacccggtacccgtacgtaccggtaccgtacggaacgtacgggtaacggggtacggaccggggtacgggtacggtacggaccggtaacgtaacgttagttaccgtacgttcggtacggtagggttacggtaggttaacggtaggttaaggtacgttaccggttacgggttccggggtttacgggttcgggtaccggggacgggtacggtacggttacggttccgggttacggttcggtaccggtacggaccgtacggtacggtcccgtacccggtcccgtacgttacccgtccgttccgttcccgtacccctcccgttcccgttccgttacgttcccgtacgtccg

SEQ ID NO: 57326 - DNA, 714 bp, Homo sapiens
  misc_feature: GYAE6OF02FXHLY.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgttgacgcagccaccctcggtgtccgtcggcccaggacagcggctacggtttcctgtgacgggcaaacaactagttgggtacggttaaaggtgtcgactacgtacggtaccagacgaaggacgccgacggaccgaccggtcccgttggttcggttcggtcgtaccagtagatacgacgcggtaccggacccggtcctacggacggtacctccgtagacggtcttacgtttcgcgtacctaccgacgtcggtacggaaccaccggaccctaccgtacggaccgtacgacgacggacgggtacggacgggtacgggagtacggaccggtaccgtatacgttgtacgtcgtacggtaggtcggtagggtaacgtaggttacgtgtcgtcggttcgggttcgggtcggtcgggacggtacggacgttaggttaccggtacggttcggtacggtaccgaccggtcccgtacgggtcccgtaccggtccccggttacgtacccttccgttcccgttacccgttaccccgttacccgttcccgttcgtacccgttccgttaccgtccg

SEQ ID NO: 57327 - DNA, 782 bp, Homo sapiens
  misc_feature: GYAE6OF02IMYOW.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcacgccacccgtcggtcgtccgtcggccccgaggacacggaccggccgtacggtttccctggtggacgggaccaaacaacgtagttgggtagggttaaagggttgtacgcctacgtcggtaaccgagaccgaaggaacgccgaacggcccgaccggtccccctggttcggttcgggtccgtcctagtgagtacgacgacggccggtaccccggcccgtacggacgggtacctcccgtgacgtcgttacttttcgcggtcctaccgacgtcggtaacggaaccgaccgacccacccgtcggtacccgtcgacgcggtaagggtaccggaacgggtacgggtacgacgggaaccggtaccgtaacgtattacgtacgtggtacggtagggttcgggtacggtaagttaaggtacgttaggtccgtacggtttcccggggttacggggttcggttccgggacgggtacggtacgttacgggtaccggttacggttacgttccggtacgtacccggtaccggtacggtcccgttaccccggaccccggtttaccggtaccctttaccgtccgttccccgttacccccgtcccgtttccctcccggttccttacccgtaccgttcccg

SEQ ID NO: 57328 - DNA, 738 bp, Homo sapiens
  misc_feature: GYAE6OF02HE530.49.9.A09.1.454.CMB.1.raw
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
  modified_base (365)..(365): a, c, t, g, unknown or other
  misc_feature (365)..(365): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcacgcccacccgtcggtcgtcccgtcggaccccaggacagaccggccgtacggtttcccgtggtggacgggacaaacaactagttgggtaggtaaaggtgngcacgtgtaccagacagacgcaggccacggtccctgtcgttggtcgtccatgagtnacgacggccggaccgccctgtacggactccgtgacggtcgttatttcgnggtctaccgagtcgacggacgaccgccaccgtcgaccgcgacgcgtacgggtacgacggtccggggatcggacggaccgtaagttacgtactcgtgtacggtacgggtagggtacggtaggttaacggtaggttacgtcgtaccggtttcgggttccggggggttcggttaccggggtaccgggaacggggtaccggtaaggttaccgggtaccgggtttcgggttacggggtacgtaccggtaacccggtaccgggttccgggttacccccggtcccccggtttaccggtacccgttacccggtttcccgtttaccccggttccccctacctttcccccgttacctttcccgtacccgtttcgttaccccgg

SEQ ID NO: 57329 - DNA, 860 bp, Homo sapiens
  misc_feature: GYAE6OF02HC5ZY.49.9.A09.1.454.CMB.1.raw
  modified_base (212)..(212): a, c, t, g, unknown or other
  misc_feature (212)..(212): n is a, c, g, or t
tcagagtcgagagacacgaccggtgctcgatttagcgagacgcgcaggggcgtgggcctaaggaagcagcactggtggtgcctcagccatggcctggaccgttctcctcctcggcctcctctctcactgcacagactctgtgacctctatgtgttgacgcagccacccgtcggtgtccgtggccccaggaccagacggcctacggtttcccnggtacggacgggtaccaaaccaactagttacgggtaggttaaaagggttggtacgtccgtaccgttagggttaacccaggaccgaacgaaacggccctaacgggacccaacgggccccccttaggttacggtttacgggtccggttccctaagtcgggtaactttcggaaccgtacgggcccggtaaccccgggtccccgttaccggaaccgggggtaccttacccccggttagggaccggtacccgttaaacgttttttaccgttcggggtaccccttacccggtaaacggtttaccgttacggggaaacccgtaccggggtacccctaaccccgtcggaacccgtacgttacccgaacgggtacccggggtaacggaacggggaacgggggtacgttacggggaccggtacccggtaactttacgttacgtacggtacggttacgggtcggttaggggtacgttagggttacgggttacggtacgggttcggttcgttacggtacgggtacggtcggttaccgggaccgtacggggtcctaccgggttaccgtacgggtacaccgtacccgacgacccgtaaccacgtcgtacctacgtccgttccgtcccctacccttccgtaccttccgtactccgtaccgtcg

SEQ ID NO: 57330 - DNA, 586 bp, Homo sapiens
  misc_feature: GYAE6OF02IO5IT.49.9.A09.1.454.CMB.1.raw
  modified_base (526)..(526): a, c, t, g, unknown or other
  misc_feature (526)..(526): n is a, c, g, or t
  modified_base (537)..(537): a, c, t, g, unknown or other
  misc_feature (537)..(537): n is a, c, g, or t
  modified_base (564)..(564): a, c, t, g, unknown or other
  misc_feature (564)..(564): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggcctaggtttccctggtgagggcaacgaaacattggtaggtaaaaggtgtgcacgtggtaccagcagaagccgaggccaggcccctagtgttggtcgtaccatgatgacagcgacccggcctacgagggactcctgacgcgtattttcgtggctccaagtcgtagggaaccaccggccctaacccgtcgtaaccgtcaagcgaagggtaccgaaacggcccggggaatacggaacgggccgaactaatagtactgtacagggttgtcgggaattaggtagttagtgcttcgttcggggtgttcggcggaggacgtagttcgacgtgttggnacgaccaggcncgcccctcggctacgtctacgttcccncctccgtcctcgtctcgtaccg

SEQ ID NO: 57331 - DNA, 920 bp, Homo sapiens
  misc_feature: GYAE6OF02IDCWY.49.9.A09.1.454.CMB.1.raw
tcagagtcgagagacacgaccggtgctcgatttagcgagacgcgcaggggctggcctaaggaagcagcactggtggtgcctcagccatggcctggaccgttctcctcctcggcctcctctctcactgcacagactctgtgacctcctatgtgttgacgcagccaccctggtcgtccgtcggccccaggacacgaccggcctaggtttcccctgtggagggacaaacgaactagtttgggaggttaaaaggtgtcgactacgtaggtaccagacagtaacgccaggccgacggcccctggtgttggtccgtacacgtagagtcgaaccacggtaccggacccggtccctcgacgggtactcccgtagacgtacgttacttttcgtcggtacctaccgtaacggttacgtacggggaaacctaccgggaccctaccccggttacggaacccgttacgaacgaccggtaacggggttaaccggaacgggtcccgggggtaagtacgggaccgggtaacccgtaaacgtaagtacgtacgttacggtaccggttaagggttacggggttagggtaaactttaacggggtaaggttaacggtcggttacccggtttcgggggttaacccgggggtttcggttaaccgggggaccggggggttaaaccgggtaaccccgggtttaaaggggttttacccgggtacccgggttttaccggggtttacggtaacccgggtaacccggttaaccccggggtaccgggtaccgtttacccccggggtccccccggttaaccgggtttaacccgtaacccccggtttttaacccggttcccccgggttttaaacccccccccgtttccccggtttacccccgttacccgggtttaccccttttacccccggtaacccggtttaaccccggg

SEQ ID NO: 57332 - DNA, 824 bp, Homo sapiens
  misc_feature: GYAE6OF02J0CLO.49.9.A09.1.454.CMB.1.raw
  modified_base (212)..(212): a, c, t, g, unknown or other
  misc_feature (212)..(212): n is a, c, g, or t
  modified_base (809)..(809): a, c, t, g, unknown or other
  misc_feature (809)..(809): n is a, c, g, or t
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgttagacgcacgccaccgtcggtgtccgtcggccccaggacaggccgcctaggtttccngtgacgggacaacaactagttggtacggtaaggtgtcgactacggtacggtaccagtacgaacggaacgaccgacggtaacccgtaacgggcccccgttagggttacgggtttaccggtaccggtaccctaaggttacggtaacgttacggaaccgtagggacccggtaccccgggtacccgttacggaacggggtacctccccggtaggacggtaccgtttactttcggtcggtaccgttaactacgggtaccgtacggggtaaaccgacccggtacccgacccgttaggaccccggttagaaccgggtacggtaacgggggtaacccgacgggggtacggggtaacctaggggtacccggtaacccggattaacgttacggtacggttacgtacggtaacggggttggaacggtaggtttaaggtacgtacgtcgtaccggttacgggttacgggttcgggtagtacgggacggttaaccgagtttacgggtccggtagttcggaccgtacgtacccggacgttccggtccccggtaaccggttcggtaccgtacgtttcccgtccgggtaccccttcgtcccgttcgttacccncggtttacctaccgg

SEQ ID NO: 57333 - DNA, 696 bp, Homo sapiens
  misc_feature: GYAE6OF02JYANB.49.9.A09.1.454.CMB.1.raw
  modified_base (354)..(354): a, c, t, g, unknown or other
  misc_feature (354)..(354): n is a, c, g, or t
tcagagtcgagagacacgaccggtgctcgatttagcgagacgcgcagggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccacggtttccctggtgagggcctaaacgaactagttgggtaggtaaaggtgtgcacgtggtaccagcagaagccaggccaggcccctgtgttggtcgtccatgatgacagccggacccgcccgtcgacggggtctcccgtggacgcgttattttccgnggtcctaccgtaggtcgtacgggaccaaccggcccgtaccccgtacggaccggtccgaacggtcggtaacgggggtccggaaacgggggcccgggggtaactacggggacccggggtaccctaacggttaattaccgttccggtacgtccggtaagggttggtacgggttagtagggttagtaggttcgtccggttcgggtttccggggtacgggttcgggcgggtacgggtaccgtaggttccggacgttgggtcggtacgacgtacccgaggtcctccggccccgttcggactcgttccgtcgttcccccgtacccttccgtcttccgtaccgcttaccg

SEQ ID NO: 57334 - DNA, 780 bp, Homo sapiens
  misc_feature: GYAE6OF02FXEGM.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtcgacctcctatgtgttgacgcacgccaccctcggtcgtccgtcggccccgaggacgacggaccggcctaacggtttccctggtggacgggccaaacaactagttcggtaggtaaaggtgtgactacgtacggaccagcagacgccgacgccgacggccccttggtggttcggtcgtaccgatcgactaggaaccgacggaccggacccggtccctacggacgggtaccttcccgtaggacgtacgttacgttttacgtcggtacctaccgtacggtcggtaacgggaccgtacccggacccgtaccgtacggaccgtacgcggtacggtacggggtacggaaccggggtacggggtaacgttcgggaaccgggtaccgtaacgttacgtacgttcgttacggtaccgggtacgggttcgggtaggggtaacgttagggttaacgttacggttccgggtaccggtttcggggtttaccgggggttcggggttacggggaccgggtacggtacgtaggttaccggtaccgggtttcggtcggtacgacgtcccgtaggtccgtcccggtccccggtacggtaccctccgttccgttacccgttcccgttccccttcgttcccgtacttcccggtacttcccg

SEQ ID NO: 57335 - DNA, 682 bp, Homo sapiens
  misc_feature: GYAE6OF02G3AFW.49.9.A09.1.454.CMB.1.raw
tcagagtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctggtgtccgtggccccaggacagacggccaggtttccctgtgagggctaaacgaacagttggtaggtaaaggtgtgcaacgtggtaccagcagaagccaggccaggcccctgtagttggtcgtcatgatgacagcgaccgcctcgaggactcctgagtcgtattttcgtaggctcgaagtcgtagggaaccacggaccctaaccctcggacccgtcgacgtaccgaaggggtacgtaacgggaccgggggtatagggaacgggacccgtaactagtaagtcgttgtacggaagggttggtaggggtaattacggtaaggttaacggtgggttcggtaccgttcgttacgggagtacggtacgggaaccgtaggggttacccgaaccggttaccgtaacgggtacaaccggtacccgaaccgggtacccctaaacccccgagttaccggtaacctacggttccctttacgttacccccggtcccttacccgttcctacccttccgtaccgtaccg

SEQ ID NO: 57336 - DNA, 499 bp, Homo sapiens
  misc_feature: GYAE6OF01C1JYT.18.23.C01.1.454.CMB.1.raw
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccattccccttcttccgtgtctgcgtctgtaggagaccgagtcaccatcacttgtcgggcgaatcaggatattaaaacctggttagttggtatcagcagaaaccaggaaaagcccctaagctgcagatgattggtccgtccagtttccaagatggggccccatcgagattccgcgtcagtggatctgggacagattcactctcaccatcagcagcctgcagcctgaagtattttgctaacttactattgtcagcaggcgcacaattcccgctcactttcggcggagggaccaaggtgagatacgaaacgatgtgctgcacatntgtcttntac

SEQ ID NO: 57337 - DNA, 507 bp, Homo sapiens
  misc_feature: GYAE6OF01DEGQJ.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagccctaagctgcagatgattggtccgtccagtttccaagatggggccccatcgagattccgcgtcagtggatctgggacagatttcactctcaccatcagcagcctgcagcctgaagtattttgctaacttactattgtcagcaggcgcaactaactttcccgctcactttcggcggacgggaccaaggtggagatacgaaacgactgtggctgcacatctgtcttctac

SEQ ID NO: 57338 - DNA, 510 bp, Homo sapiens
  misc_feature: GYAE6OF01BT4WY.18.23.C01.1.454.CMB.1.raw
  modified_base (492)..(492): a, c, t, g, unknown or other
  misc_feature (492)..(492): n is a, c, g, or t
tcagtacgagtatgcacgaccggtgctcgatttagtacacgtgattagggattgggggcaggagtcagacccagtcatgacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagccctaagctgcagatgattggtccgtccagtttccaagatggggccccatcgagattccgcgtcagtggatcgtgggacagatttcactctcaccatcagcagcctgcagcctgaagtattttgactaactttactattgtcagcaggcgcactaactttcccgctctacgttcggcggagggaccaaggtggaagagtacgaaacgactggnggctgcacatctgtcttc

SEQ ID NO: 57339 - DNA, 508 bp, Homo sapiens
  misc_feature: GYAE6OF01CS38F.18.23.C01.1.454.CMB.1.raw
  modified_base (502)..(502): a, c, t, g, unknown or other
  misc_feature (502)..(502): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcaagaaaaccaggaaaagccctaagctgcagatgattggtccgtccagtttccaagatggggccccatcgagattccgcgtcagtggatctgggacagatttcactctcaccatcagcagctgcagcctgaagattttgctaacttactaattgtcagtcaggcgcaacaatttcccgactcactttcggcggtagggaccaaggtgagatcgaaacgactgtgctgctaccatctgtnttctac

SEQ ID NO: 57340 - DNA, 505 bp, Homo sapiens
  misc_feature: GYAE6OF01CV6DP.18.23.C01.1.454.CMB.1.raw
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaaccaggaaaagccctaagctgcagatgattggtccgtccagtttccaagatggggccccatcgagattccgcgtcagtggatctgggacagatttcactctcaccatcagcagcctgcagcctgaagtattttgctaacttactattgtcagcaggcgcacaatttcccgctcactttcggcggagggaccaaggtggagatacgaaacgactggtggctgcaccatctntcttntac

SEQ ID NO: 57341 - DNA, 500 bp, Homo sapiens
  misc_feature: GYAE6OF01DI33A.18.23.C01.1.454.CMB.1.raw
  modified_base (177)..(177): a, c, t, g, unknown or other
  misc_feature (177)..(177): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttnttccgtgtctgcgtctgtaggagaccgagtcaccatcacttgtcgggcgaatcaggatattaaaacctggttagttggtatcagcagaaaccaggaaaagccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcaacaatttcccgctcactttcggcggagggaccaaggtggagatacgaaacgactgtggctgcacatctgtcttcac

SEQ ID NO: 57342 - DNA, 552 bp, Homo sapiens
  misc_feature: GYAE6OF01D5CBZ.18.23.C01.1.454.CMB.1.raw
  modified_base (125)..(125): a, c, t, g, unknown or other
  misc_feature (125)..(125): n is a, c, g, or t
  modified_base (177)..(177): a, c, t, g, unknown or other
  misc_feature (177)..(177): n is a, c, g, or t
  modified_base (368)..(368): a, c, t, g, unknown or other
  misc_feature (368)..(368): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgntgctctggctcccaggttccagatgcgacatccagatgacccagtccccttnttccgtgtctgcgtctgtaggagaccgagtcaccatcacttgtcgggcgaatcaggatattaaaacctggttagtttggtatcagcagaaaccaggaaaagccctaagctgcagatgattggtccgtccagtttccaaagatggggccccatcgagattcctcgtcagtggatctgggacagattcactcncacatcagcagcctgcagcctgtaagtatttagctaacttactaattgtcaagctaggcgctaccgaatttccccgcttcaccgttttacgggccggaagggtaccaagggtagggacgaaagtccaaaacggtaaactggtgggaccttacggctaacccgattaccttgttcttcctaaccg

SEQ ID NO: 57343 - DNA, 524 bp, Homo sapiens
  misc_feature: GYAE6OF01BLPTE.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagccctaagctgcagatgattggtccgtccagtttccaagatggggccccatcgagattccgcgtcagtggatctgggacagatttcactctcaccatcagcagcctgcagcctagaagtattttgactaactttacttattcgtacagcaggccgcaacaactttcccgcttctacgtttcggccggacgggaccgaagggtggagatacgaaacgaatggtcggctcgacacatctcgtcttctac

SEQ ID NO: 57344 - DNA, 518 bp, Homo sapiens
  misc_feature: GYAE6OF01E1PHE.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggcccccatcgagattccgcgtcagtggatctgggacagtatttcactctcacatcagcagcctgcagcctgaaagtattttgacctaacttacttaatttgtcagcaggcgacacaatttcccgcttcactttcggcggagggaccaagggtgagatacgaaacgactggtcggctgccaccatctgttctctac

SEQ ID NO: 57345 - DNA, 505 bp, Homo sapiens
  misc_feature: GYAE6OF01AK1MU.18.23.C01.1.454.CMB.1.raw
  modified_base (356)..(356): a, c, t, g, unknown or other
  misc_feature (356)..(356): n is a, c, g, or t
  modified_base (423)..(423): a, c, t, g, unknown or other
  misc_feature (423)..(423): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagtttggtatcagcagaaaccaggaaaacgccctaagctgcagatgattggtccgtccagtttccaagatggggccccatcgagattccgcgtcagtgatctgggacngatttcactctcaccatcagcagcctgcagcctgaagtatttgctaacttactattgtcagcaggcncacaatttcccgctcacttcggcggagggaccaaggtcggagatacgaaacgtactggtcggctagcacatctgtcttcgac

SEQ ID NO: 57346 - DNA, 509 bp, Homo sapiens
  misc_feature: GYAE6OF01B9QP6.18.23.C01.1.454.CMB.1.raw
  modified_base (425)..(425): a, c, t, g, unknown or other
  misc_feature (425)..(425): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgctaacttactattgtcagcaggcncacaatttccccgcttcacctttcggcggagggacccaagggtggagatacgaaacgaatgtggctgccacatctgtcttctac

SEQ ID NO: 57347 - DNA, 524 bp, Homo sapiens
  misc_feature: GYAE6OF01CPLXS.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagccctaagctgcagatgattggtccgtccagtttccaagatcggggccccatcgagacttccgcgtcagtgatcgtgggacagtatttcactctcaccatcagcagcctgcagcctgaagtatttgactaacttactaattgtcagcaggcgacaactaactttccccgacttccacgttttcgggacggacgggaccaagggtgagatacgaaacgactaggtggctgcaccatctcgtcttctac

SEQ ID NO: 57348 - DNA, 497 bp, Homo sapiens
  misc_feature: GYAE6OF01CW71S.18.23.C01.1.454.CMB.1.raw
  modified_base (178)..(178): a, c, t, g, unknown or other
  misc_feature (178)..(178): n is a, c, g, or t
  modified_base (338)..(338): a, c, t, g, unknown or other
  misc_feature (338)..(338): n is a, c, g, or t
  modified_base (494)..(494): a, c, t, g, unknown or other
  misc_feature (494)..(494): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttnttccgtgtctgcgtctgtaggagaccgagtcaccatcacttgtcggcgaatcaggatattaaaacctggttagttggtatcagcagaaaccaggaaaagccctaagctgcagatgattggtccgtccagtttccaagatggggccccatcgagattccgngtcagtggatctgggacagatttcactctcaccatcagcagcctgcagcctgaagattttgctaacttactattgtcagcaggcgcacaatttcccgctcactttcggcgaggaccaaggtgagatacgaaacgatggtgctgcaccatctgtctntac

SEQ ID NO: 57349 - DNA, 522 bp, Homo sapiens
  misc_feature: GYAE6OF01CXHXT.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaactggttagttgtatcagcagaaaccaggaaaacgccctaagctgcagatgattggtccgtctagtttccaagatcggggccccatcgagacttccgcgtcagtggatcgtgggacagtattcactctcaccatcagcagcctgcagcctagaagtatttgactaacttactattgacagcaggcgactactaactttcccgctcctacgtttcgggacggagggaccaagggtggagatacgaaacgtactggtcgctgacctaccatcttgtcttctac

SEQ ID NO: 57350 - DNA, 665 bp, Homo sapiens
  misc_feature: GYAE6OF01BROIV.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggataattaaaacctggttagttgtatcagcaagaaaccaggaaaacgccctaagctgcagatgagttcggtccgtcctagtttaccaaggacgtcggggccccagtcgagacttccgcgtacagtgatcgtgggactagtactttcactctacacatcagcagcctgcacgacctagtaaacgttattttacgaccttaacgtttacttaagtttacgtaccgaaggtaccgaagggtacccgtacctaaaccttaaccgttttcccccggactttacccgttaaccggttttacccggggaccggggtaaccggggtaacccgtaaagggggttacgggaacgtaaacgttaccggtaaaaaccggtaacggttgggtacggacctacggacctaaccgtacttaccgttacgtttcccttcgttaacccg

SEQ ID NO: 57351 - DNA, 525 bp, Homo sapiens
  misc_feature: GYAE6OF01CKVMZ.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcaagaaaccaggaaaagccctaagctgcagatgattggtccgtcagtttccaagatcggggccccatcgagattccgcgtcagtggatcgtgggacagatttcactctcaccatcagcagcctgcagcctagaagtatttcgactaacttactattgtcagtcaggcacactaacttcccgctctacgtttcggacggtacgggaccaagggtggaagtagtacgaaacggtataggtcggctgacacctatctgttcttctac

SEQ ID NO: 57352 - DNA, 523 bp, Homo sapiens
  misc_feature: GYAE6OF01AU123.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcaagaaaccaggaaaacgccctaagctgcagatgattggtccgtccagtttccaagagtcgggccccatcgagacttccgcgtcagtggatcgtgggacagtatttcactctcaccatcagcagcctgcagcctagaagtatttgactaacttactattgtcagcaggcgacactaacttcccgctctacgtttcggcggacggaccgaagggtggagacgtacgaaacgtatggtcggctgactacatctgtcttctac

SEQ ID NO: 57353 - DNA, 547 bp, Homo sapiens
  misc_feature: GYAE6OF01BLVUB.18.23.C01.1.454.CMB.1.raw
  modified_base (278)..(278): a, c, t, g, unknown or other
  misc_feature (278)..(278): n is a, c, g, or t
  modified_base (382)..(382): a, c, t, g, unknown or other
  misc_feature (382)..(382): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttggtatcagcagaaaccaggaaaacnccctaagctgcagatgattggtccgtccagtttccaagatcggggccccagtcgagacttccgcgtcagtggatcgtgggacagactttcactctcaccatcancagcctgcagcctagaagtatttgactaacttactattgtacagcaggccgcaactaactttcccgcttcctaccgtttcgggacggtacgggaccgtaaggtcggagtaactacgaaacgtaacgtcggtggctgacctacctactacttcgtccttcgtaccg

SEQ ID NO: 57354 - DNA, 545 bp, Homo sapiens
  misc_feature: GYAE6OF01ANH57.18.23.C01.1.454.CMB.1.raw
  modified_base (443)..(443): a, c, t, g, unknown or other
  misc_feature (443)..(443): n is a, c, g, or t
tcagtacgagtatgcacgaccggtgctcgatttagtacacgtgattagggattggggcaggagtcagacccagtcaggacacagcatggacacgagggtcccgctcagctcctgggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaacgccctaagctgcagatgattggtccgtccagtttccaagatcggggccccagtcgagattccgcgtcagtggatcgtggacagatttcactctcaccatcagcagcctgcagcctagaagtatttgactaacttactattgtcagcaggcgacactaatttccccgnttcctaccgtttcgggaccgggtacgggaccctaagggtcgaagacgttaccgaaaacggtaactggtcggctggaccacctagttactcgtccttctaccg

SEQ ID NO: 57355 - DNA, 671 bp, Homo sapiens
  misc_feature: GYAE6OF01C2Y4M.18.23.C01.1.454.CMB.1.raw
tcagtacgagtatgcacgaccggtgctcgatttagtacacgtgattagggattgggggcaggagtcagacccagtcagtacacagcatggacacgagggtccccgctcagctcctggggctcctgctgctctggctcccaggttccagatgcgacatccagatgacccagtccccttcttccgtgtctgcgtctgtagggacgaccgagtcaccatcacttggtcggcaatcaggataacttaaaccgtggtttagttggtatcagcaagaaaccaaggaaaacgccctaagctgcagtatgtagttcggtcccgtacctacgtttaccaaggtacggtccggggacccctagtaccgagtacgtttcccggcgtacgaggtggtatcggtagggactagtactttcactctaccacctatcgacgcacgtccgtgacacgcctagtaagttacttttcgaccttaacttacttagttcgtacacgtacgacggaccgactaacctaaccgtttccccgtcttaccgttaccggtttccggggaccgggacgggtaaccggtaaggggtacgggaaacgtaacgtaaccggtaaaaccggtaacgttagggtcggtaccgtacggacccctaaccgtacgttccgtttacggttccctttaccgttacccg

SEQ ID NO: 57356 - DNA, 622 bp, Homo sapiens
  misc_feature: GYAE6OF01CUODE.18.23.C01.1.454.CMB.1.raw
  modified_base (279)..(279): a, c, t, g, unknown or other
  misc_feature (279)..(279): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttggtatcagcagaaaaccaggaaaacnccctaagctgcagatgattggtccgtcctagtttccaaggatcggggaccccatcgagacttccgcgtcagtggatcgtgggacagtatttcactctcaccatcagcagcctgcagcctagaagtatttgactaacttacggtattcgtacagtcaggccactaacctaactttccccgacttccgtaccgtttcgggaccgggtaacgggaacccgtaaaggggttacggaacggtaacgtaacccgtaaaaaccggtaaacgttcgggttacgggtacccgttacgggaccctaacccgtaacgtttacccgttacggttacccgttttccgttaaacccg

SEQ ID NO: 57357 - DNA, 527 bp, Homo sapiens
  misc_feature: GYAE6OF01A0929.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagccctaagctgcagatgattggtccgtccagtttccaagactggggccccagtcgagattccgcgtcagtggatcgtgggacagatttcactctcaccatcagcagcctgcacgcctagaagtatttcgactaactttactattgtacagcaggcgcactaactttcccgcttcctacgtttcggcgggacggaccgaagggtgagagtacgaaacgatggtgctagcctaccatacttgtcttctaccg

SEQ ID NO: 57358 - DNA, 515 bp, Homo sapiens
  misc_feature: GYAE6OF01CSAVJ.18.23.C01.1.454.CMB.1.raw
  modified_base (342)..(342): a, c, t, g, unknown or other
  misc_feature (342)..(342): n is a, c, g, or t
  modified_base (400)..(400): a, c, t, g, unknown or other
  misc_feature (400)..(400): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatataaaacctggttagttggtatcagcagaaaaccaggaaaacgcccctaaagctgcagatgattggccgtccagtttccaagtatcggggccccatcgagattccgngtcagtgatctgggacagatttcactctcaccatcagtcagcctgcagcctagaagtntttgactaactttactattgtcagcaggcgcaacaactttcccgctctacgtttcggcggacgggaccaaggtggacgatacgaaacgatggtcggctgcacatctgtcttctac

SEQ ID NO: 57359 - DNA, 549 bp, Homo sapiens
  misc_feature: GYAE6OF01DLB4Q.18.23.C01.1.454.CMB.1.raw
  modified_base (345)..(345): a, c, t, g, unknown or other
  misc_feature (345)..(345): n is a, c, g, or t
  modified_base (376)..(376): a, c, t, g, unknown or other
  misc_feature (376)..(376): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcaagaaaaccaggaaaacgccctaagctgcagatgattcggtccgtccagtttccaagatcggggccccatcgagattccgngtcagtggatcgtgggacagtatttcactcncacatcagcagcctgcagcctagaagtattttgactaacttactaattgtacagcaggcacactaacttcccgcttcctacgtttcgggacggtacgggacctaagggtcgacgtaacgtacgaaaacgtaacgttggtcgcgtagacctaactatcctgttccttcgtaccg

SEQ ID NO: 57360 - DNA, 552 bp, Homo sapiens
  misc_feature: GYAE6OF01B4WGQ.18.23.C01.1.454.CMB.1.raw
  modified_base (430)..(430): a, c, t, g, unknown or other
  misc_feature (430)..(430): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagccctaagctgcagatgattggtccgtccagtttccaagatcggggccccagtcgagattccgcgtcagtggatctgggacagatttcactctcaccatcaacagcctgcagcctagaagtattttgactaacttactattgtcagcaggcncactaactttcccgctctacgtttcgggacggagggaccgtaagggtcggaagagtaccgaaaacggtaaccgtaggtcggcgtcggccaacccgtattcttacgttcttccgacttccccg

SEQ ID NO: 57361 - DNA, 503 bp, Homo sapiens
  misc_feature: GYAE6OF01DXN1B.18.23.C01.1.454.CMB.1.raw
  modified_base (494)..(494): a, c, t, g, unknown or other
  misc_feature (494)..(494): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttggtatcagcagaaaccaggaaaagccctaagctgcagatgattggtccgtcagtttccaagatgggccccatcgagattccgcgtcagtggatctgggacagatttcactctcaccatcagcagcctgcagcctgaagtatttgactaacttactattgtcagcaggcgcaactaactttcccgctctacgtttcggcggaggaccgaaggtggagatacgaaacgatgtgctgacacatntgtctgtac

SEQ ID NO: 57362 - DNA, 553 bp, Homo sapiens
  misc_feature: GYAE6OF01AF1LK.18.23.C01.1.454.CMB.1.raw
  modified_base (411)..(411): a, c, t, g, unknown or other
  misc_feature (411)..(411): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaacgccctaagctgcagatgattggtccgtcctagtttccaagactcggggccccagtcgagtacttcccggcgtcgagtggatcgtgggacagtatttcactctcaaccatcagcacgcctgcacgcctagaagtntttgactaacttactattgtcagcaggcgacactaacttcccgcttcgtaccgtttcggacggtacgggaccgaagggtggacgtagtaaccgaaacgtaacgtggtcggctacgccgtaaccattcctgttccttctaccg

SEQ ID NO: 57363 - DNA, 549 bp, Homo sapiens
  misc_feature: GYAE6OF01DL2L7.18.23.C01.1.454.CMB.1.raw
  modified_base (462)..(462): a, c, t, g, unknown or other
  misc_feature (462)..(462): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaacgccctaagctgcagatgattggtccgtctagtttccaagtacgtcggggccccagtcgagtacttccgcgtcaggtgatcgtgggactagtacttcactctcaccatcagcagcctgcagtcctagtaagtatttgactaactttactattcgtacagcgaggccgacaactaactttccccgntacctacgttcgggacggacgggaccaagggtgagacgtacgaaacgtaacgtggtcggctgacctacctattcttcgttctctacg

SEQ ID NO: 57364 - DNA, 582 bp, Homo sapiens
  misc_feature: GYAE6OF01CPMRP.18.23.C01.1.454.CMB.1.raw
  modified_base (277)..(277): a, c, t, g, unknown or other
  misc_feature (277)..(277): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttgtatcagcagaaaccaggaaaacnccctaagctgcagatgattggtcctccagtttccaagtacgtcggggaccccagtcgagtacgttccggcgtccgaggtggaactcgtagggacagtactttcgactctacaccatcagcacgcctgccacgcctagtaagttagtttacgactaactttacttagttcgtacagtcgaggccactaactaactttcccgcttcgtaccgtttcgggacggacgggaccgtaagggtggaacgtagtaaccgaaacgtacgttggtcggtcgtacgacctaaccgtactccttcgtcttcgtacc

SEQ ID NO: 57365 - DNA, 556 bp, Homo sapiens
  misc_feature: GYAE6OF01BNP4L.18.23.C01.1.454.CMB.1.raw
  modified_base (347)..(347): a, c, t, g, unknown or other
  misc_feature (347)..(347): n is a, c, g, or t
  modified_base (411)..(411): a, c, t, g, unknown or other
  misc_feature (411)..(411): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctccaggttccagatgcgacatccagatgacccagtccccttcttccgtgtctgcgtctgtaggagaccgagtcaccatcacttgtcgggcaatcaggatattaaaacctggttagtttggtatcagacaagaaaccaggaaaacgccctaagctgcagatgattcggtccgtctagtttccaaggagtcgggccccaagtcgagtacttccgngtcaggtggatcgtgggacagtactttcgacttctcacatcagtcagcctgcagcctagaagtntttagactaactttacatttcgacagcgaggcctacacctaactttcccgactcgtaccgtttggaccggaggaccgtaaggtcgaagacttacgaaacgtagtaggtcgactcgaccgacctacgttctagttccttactaccg

SEQ ID NO: 57366 - DNA, 533 bp, Homo sapiens
  misc_feature: GYAE6OF01AHAC9.18.23.C01.1.454.CMB.1.raw
  modified_base (381)..(381): a, c, t, g, unknown or other
  misc_feature (381)..(381): n is a, c, g, or t
  modified_base (520)..(520): a, c, t, g, unknown or other
  misc_feature (520)..(520): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagccctaagctgcagatgattggtccgtccagtttccaagagtcggggccccagtcgagacttccgcgtcaggtggatcgtgggacagtatttcactctcaccntcagcagcctgcagcctagaagtattttagactaactttactattcgtcagcgaggcacaacctaactttcccgcttacctacgtttcgggacggacgggaaccagggtggaagtatacgaaacgatggtggctgcacntctcgtcttctac

SEQ ID NO: 57367 - DNA, 522 bp, Homo sapiens
  misc_feature: GYAE6OF01DAFCG.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagccctaagctgcagatgattggtccgtcagtttccaagatcggggccccatcgagattccgcgtcagtggatctgggacagtattcactctcaccatcagcagcctgcagcctagaagtattttagactaacttactattcgtcagtcaggccgcaactaactttcccgcttctacgtttcgggacggtacgggaccgaagggtggagatacgaaacgatggtggctgacaccatctgtcttctac

SEQ ID NO: 57368 - DNA, 703 bp, Homo sapiens
  misc_feature: GYAE6OF01BD6B3.18.23.C01.1.454.CMB.1.raw
tcagtacgagtatgcacgaccggtgctcgatttagtacacgtgatttagggagttgggggcaggagtcagacccagtcaggacacagcatggacacgagggtccccgctcagctcctgggctcctgctgcttctggctcccaggttccagtatgcgacataccagactcgacccagtccccttcttccgtgtctgcgtctgtaggacgaccgagtccaccagtccgacgttggtcggacgaatcaggtataattaaaccgtggttagtttgtatcagacaagaaaccaaggaaaacgaccctaagctagacgagactgaagtttcggtccgtaccgtacgtttaccgaaggtacggtaccgggacccctagtacgtagtacttcccgcgtcgacggtgacgtacgtaggactagtactttccgactccgtaccactactcacgtaccacgtcctagaccgacgtacctagtaaagtttactttacgaccgtttaactttacgttagtttacgtacgtaacgtaccgtaacggtccgtacgtaaccgttaaccgtttacccccgaccgtttaccggtaccggtttaccgggaccgggtaacggtaaccggtagggtacggtaacgtaacgttaccggaaacggttcgtagggtcgacgtccgaaccgtaccgtacgtaccgttacgttcccgttacgtaccccg

SEQ ID NO: 57369 - DNA, 529 bp, Homo sapiens
  misc_feature: GYAE6OF01B33SX.18.23.C01.1.454.CMB.1.raw
  modified_base (432)..(432): a, c, t, g, unknown or other
  misc_feature (432)..(432): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcaagaaaccaggaaaacgccctaagctgcagatgattggtccgtccagtttccaagagtcggggccccatcgagattccgcgtcagtggatcgtgggacagtatttcactctcacatcagcagcctgcacgctagaagtatttgactaacttactattgtcagtcaggcncactacttcccgcttcctacgtttcggcggtacggaccgaagggtgagactacgaaacggtactggtcggctgactacctatcctgttcttcgtacc

SEQ ID NO: 57370 - DNA, 544 bp, Homo sapiens
  misc_feature: GYAE6OF01A3ZV4.18.23.C01.1.454.CMB.1.raw
  modified_base (283)..(283): a, c, t, g, unknown or other
  misc_feature (283)..(283): n is a, c, g, or t
  modified_base (396)..(396): a, c, t, g, unknown or other
  misc_feature (396)..(396): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
  modified_base (494)..(494): a, c, t, g, unknown or other
  misc_feature (494)..(494): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcaatcaggataatttaaaaccgtggttagtttggtatcagcaagaaaccaaggaaaacnccctaaagctgcaagatgtattcggtccgtcctagtttaccaaggagtcggggaccccagtccgagtacttccgcgtcaggtgatcgtgggacagtactttcactctcaaccntcagcagcctgcagcctagaagtatttcgactaacttactattcgtcagcaggcncaactacttccnctctacgttcggacggacggacgaggtgganacgtacgaaacgtatggtcgactacgcctacgactctcgttcttctaccg

SEQ ID NO: 57371 - DNA, 625 bp, Homo sapiens
  misc_feature: GYAE6OF01BZLSB.18.23.C01.1.454.CMB.1.raw
  modified_base (276)..(276): a, c, t, g, unknown or other
  misc_feature (276)..(276): n is a, c, g, or t
tcagtacgagtatgcacgaccggtgctcgatttagtacacgtgattagggattgggggcaggagtcagacccagtcaggacacagcatggacacgaggtcccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttggtatcagcagaaaccaggaaaacnccctaagctgcagatgagttggtccgtcctagtttccaagagtcggggccccatcgagacttccgcgtcagtggatcgtagggacagtatttccacttctacaccatcagccacgcctgcagtacctagtaagtacttttacgactaaccgtttacttactttgtaccagaccgtacgggccgactaaccttaaccgttttcccccggactttacccgtaccggttttccggggaccggggtaacgggtaacccggtaacggggttagggaaccgaagttacccgaaaacgtacgtagggtccggacttacgaccctaaccgtattccgttacgttccttcgttacccg

SEQ ID NO: 57372 - DNA, 549 bp, Homo sapiens
  misc_feature: GYAE6OF01CJDIQ.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaaccaggaaaacgccctaagctgcagatgattggtccgtcagtttccaagagtcggggccccagtcgagtacttccgcgtcaggtggatcgtgggacagtattcactctcaccatcagcagcctgcacgcctagaagtattttcgactaacttacttattcgtacagcaggccactaactaacttcccgcttcctacgtttcgggacggtacgggaccgaagggtcggagtaagtaccgaaaacggtactggtcggctcgacctactatctcgtcttctac

SEQ ID NO: 57373 - DNA, 507 bp, Homo sapiens
  misc_feature: GYAE6OF01DTMXC.18.23.C01.1.454.CMB.1.raw
  modified_base (177)..(177): a, c, t, g, unknown or other
  misc_feature (177)..(177): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttnttccgtgtctgcgtctgtaggagaccgagtcaccatcacttgtcgggcgaatcaggatattaaaacctggttatttggtatcagcagaaaccaggaaaagccctaagctgcagatgattggtccgtccagtttccaagatcggggccccatcgagattccgcgtcagtggatcgtgggacagatttcactctcacatcagcagcctgcagcctagaagtatttgctaacttactattgtcagtcaggcgcaactaactttcccgctctacgtttcggcggagggaccaaggtggagatacgaaacgatgtgctgctacatntgtctntac

SEQ ID NO: 57374 - DNA, 524 bp, Homo sapiens
  misc_feature: GYAE6OF01CSCP2.18.23.C01.1.454.CMB.1.raw
  modified_base (282)..(282): a, c, t, g, unknown or other
  misc_feature (282)..(282): n is a, c, g, or t
tcagtacgagtatgcacgaccggtgctcgatttagtacacgtgattagggattggggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggtttagttggtatcagcaagaaaccaggaaaacnccctaagctgcagatgattggtccgtcagtttccaaggactcggggccccagtcgagacttccgcgtcagtggatcgtgggacagtattcactctcaccatcagcacgcctgcacgcctagtaagtattttagactaacttacttattcgtcagcaggcacactaacttccgctctacgtttcggacggacggaccgaggtggagagtacgaacgatgtcgcgtgctacatctctcttctac

SEQ ID NO: 57375 - DNA, 510 bp, Homo sapiens
  misc_feature: GYAE6OF01BLE2F.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagccctaagctgcagatgattggtccgtccagtttccaagatggggccccatcgagattccgcgtcagtggatctgggacagatttcactctcaccatcagcagcctgcagcctgaagtattttgactaacttactattgtcagcaggcgcacaacttcccgctctactttcggcggagggaccgaaggtgagatacgaaacgtaactggtggctgcaccatctcgtctctac

SEQ ID NO: 57376 - DNA, 607 bp, Homo sapiens
  misc_feature: GYAE6OF01CXK3G.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatataaactggttagttgtatcagcaagaaaccaggaaaacgccctaagctagcagatgattggccgtcagtttaccaagacgtcggggccccagtcgagtacttccgcgtcagtggatcgtgggacagtattcactctcacatcagcacgcctgacagcctagtaaagttattttacgacttaacttactatttcgtacgtagcgaacgccgtactaacctaaccgtttcccgacttccgtaccgtttccggggaccgggtacgggaaccgtaagggtcggaagtaacgtaacgaaaaccggtagttacgggtacgggtaccgttagacccgtacccgttaacgttccgttttacgtcctttaccgtaacccg

SEQ ID NO: 57377 - DNA, 637 bp, Homo sapiens
  misc_feature: GYAE6OF01CZG6I.18.23.C01.1.454.CMB.1.raw
  modified_base (364)..(364): a, c, t, g, unknown or other
  misc_feature (364)..(364): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttggtcgggcgaatcaggataattaaaaccgtggttagttggtatcagacaagaaaaccaaggaaaacgccctaagctgacagatgattggtcctctacgtttcaagagtcggggccccagtcgagacgttccgcgtcagtgatcgnggacagtattcactctcactatcagcagcctgcagcctagaagttatttcgactaaacttacttagttgtacacgcgtacggccactaacgttaacctttccccggacttaccgtacccggttttcggggaccgggaacggggtaaccgtaaggggtacgggtaaacggtaacgtaaacccgtaaaacgggtaaccttcggggttaccgggaccttacgggtaacccaaacccgtttaactcccgtttacggttccctttaccgttaaccccg

SEQ ID NO: 57378 - DNA, 579 bp, Homo sapiens
  misc_feature: GYAE6OF01CIWSH.18.23.C01.1.454.CMB.1.raw
  modified_base (283)..(283): a, c, t, g, unknown or other
  misc_feature (283)..(283): n is a, c, g, or t
  modified_base (365)..(365): a, c, t, g, unknown or other
  misc_feature (365)..(365): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacatccagatgacccacgtccccttcttccgtgtctgcgtctgtaggagaccgagtcaccatcacttgtcgggcgaatcaggatattaaaacctggttagttggtatcagcaagaaaccaaggaaaacnccctaagctgcagatgattcggtcctcagtttccaaggacgtcggggaccccagtcgagtacttccgcgtcgagtggatcgngggacagtacttcactctacacctatcagcagcctgcagcctagtaagttatttacgacttaacttacttatttcgtactacgcgacggccgactaacctaactttcccgacttccgtaccgtttccgggacgggtacgggtaaccgagggtacggacgtacgtaacgaaacgtagtggtcggctacgacctactacttctcgttcttcgtacc

SEQ ID NO: 57379 - DNA, 533 bp, Homo sapiens
  misc_feature: GYAE6OF01EM5OC.18.23.C01.1.454.CMB.1.raw
  modified_base (409)..(409): a, c, t, g, unknown or other
  misc_feature (409)..(409): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagtttggtatcagcaagaaaccaggaaaacgccctaagctgcagatgattggtccgtccagtttaccaagacgtcggggccccagtcgagtacttccgcgtcagtggatcgtgggacagtattcactctcaccatcagcagcctgcacgcctagaacgtnttttgactaacttactattgtcagcaggcgacactaacttcccgctacgtcgttcgggcgacgggtaccgaggtcggagacgtacgaaacgagttggngcgtnaccactatctcgtctcgtacc

SEQ ID NO: 57380 - DNA, 596 bp, Homo sapiens
  misc_feature: GYAE6OF01C2PBP.18.23.C01.1.454.CMB.1.raw
tcagtacgagtatgcacgaccggtgctcgatttagtacacgtgattagggagttggggggcaggagtcagacccagtcaggacacagcatggacacgaggtccccgctcagctcctggggctcctgctgctctggctcccaggttccagatgcgacatccagatcgacccagtccccttcttccgtgtctgcgtctgtaggagaccgagtcaccatcacttgtcggcgaatcaggatattaaaacctggttagttgtatcagcaagaaaccaaggaaaacgccctaagctgcagatgattggtccgtcctagtttaccaaggacgtcggggacccctagtcgagacttccgcgtcaggtggatcgtagggacagtacttcactctacaccatcagcacgcctgcagcctagtaagtattttagaccttaactttacttattcgtacagacgaggaccgtacgtaactaacgtttcccgcttaccgtaccgtttcgggacgggtacgggtaaccgtaagggtacggaacgtacgtaaccgaaacgtacgtacggtcggacgtcgaccgtacctacttccgttacgtccttctacccg

SEQ ID NO: 57381 - DNA, 606 bp, Homo sapiens
  misc_feature: GYAE6OF01BRO0Y.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttgtatcagcagaaaccaggaaaacgccctaagctgcagatgattggtccgtcctagtttccaagcgtcggggccccagtcgagtacttccgcgtcgagtggatcgtgggacagtatttcactctcaccatcagcacgcctgcagcctagaagtatttagactaactttactattgtacagcgagcgacactaactttcccgacttccgtacgtttcgggaccgggtacgggaaccgtaaaggggtacggaacgtaacgtaaccggtaaaaccggtaaccgttacgggttcgggacccgttacggacccgtaaaccctacgtttacccgtttacgttcccgtttaccttaacccg

SEQ ID NO: 57382 - DNA, 618 bp, Homo sapiens
  misc_feature: GYAE6OF01C3F8F.18.23.C01.1.454.CMB.1.raw
  modified_base (612)..(612): a, c, t, g, unknown or other
  misc_feature (612)..(612): n is a, c, g, or t
  modified_base (615)..(616): a, c, t, g, unknown or other
  misc_feature (615)..(616): n is a, c, g, or t
  modified_base (618)..(618): a, c, t, g, unknown or other
  misc_feature (618)..(618): n is a, c, g, or t
tcagtacgagtatgcacgaccggtgctcgatttagtacacgtgattagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaatcatgatttatgatgtcactaatcggccctgaggggtttctaatcgcttctctggctcaagtctggcaacaccgcctccctgaccatcctctgggcctcgaggctgaggcgaggctagtatttacttactcgcagctacaattacaacagaccacaagcaacttctacttatcgttcgttacggtaacgttacggaaccgtaacggtcctaaccgtccgttaggtaccaccgaacccgaaccgggcccctaaccccgacttacgtcctaacttcccgttacgttacccccacccttacccttaccctaacctaccgttaccggttaccttacggaccgggtccgggtacccgttaggggaccaaacggggtccgtaaccgagttaacgcgtnacnngn

SEQ ID NO: 57383 - DNA, 586 bp, Homo sapiens
  misc_feature: GYAE6OF01DKJ0Z.18.23.C01.1.454.CMB.1.raw
  modified_base (277)..(277): a, c, t, g, unknown or other
  misc_feature (277)..(277): n is a, c, g, or t
  modified_base (364)..(364): a, c, t, g, unknown or other
  misc_feature (364)..(364): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcaatcaggatattaaaacctggttagttggtatcagcaagaaaccaggaaacnccctaagctgcagatgattcggtcctacctagtttccaaggacgtcggggacccctagtcgagtacttccggcgtcaggtggatcgnggacagtacttcactctacacatcagcagcctgcagcctagtaagtactttagactaacttactattcgtcagcaggcactactaacgtttcccgcttaccgtaccgtttcgggacggtacgggaaccgtaagggtaggaacgtaactaccgtaaaaccggtacgttaggtcggaccgtacggaccctaacgtacttaccgttcgttaccttccgtaacccg

SEQ ID NO: 57384 - DNA, 552 bp, Homo sapiens
  misc_feature: GYAE6OF01BMBQ5.18.23.C01.1.454.CMB.1.raw
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggataattaaaacctggttagtttggtatcagacaagaaaaccaggaaaacgccctaagctgcagatgattggtcctcctagtttccaagagtcggggccccatcgagacttccgcgtcagtggatcgtgggacagtatttcactctcacatcagcagcctgcagcctagaagtattttacgactaactttactatttgtacagctaggccgacaacctaactttcccgacttactaccgtttcgggacggtacggaccgaaggtggagaacgtacgaaaacggtactggtcggctagactacctatacctntcttntacc

SEQ ID NO: 57385 - DNA, 523 bp, Homo sapiens
  misc_feature: GYAE6OF01ED6XY.18.23.C01.1.454.CMB.1.raw
  modified_base (280)..(280): a, c, t, g, unknown or other
  misc_feature (280)..(280): n is a, c, g, or t
  modified_base (439)..(439): a, c, t, g, unknown or other
  misc_feature (439)..(439): n is a, c, g, or t
  modified_base (515)..(515): a, c, t, g, unknown or other
  misc_feature (515)..(515): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagtttggtatcagcaagaaaccaggaaaacnccctaagctgcagatgattcggtccgtcctagtttccaagacgtcggggccccagtcgagtacttccgcgtcagtggatcgtggacagtatttcactctcacatcagcagcctgcagcctagaagtattttcgactaacttactattcgtcagcaggcncaactacttcccgctctacgttcggcggacggacgaggtgagactacgaaacgtatgtcggctgacctacatcctntcttctac

SEQ ID NO: 57386 - DNA, 606 bp, Homo sapiens
  misc_feature: GYAE6OF01CA0I3.18.23.C01.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctactctggctccgaggtgccagatgtgacatccagatgacccagtctccatcctcctgtctgcatctgtagganacagagtcaaccatcacttgccgggcaagtcagagctattagacagtacttaatttaaagttggtatcagacaagaaaacgagggaaacnccctaagctcctagatctatcgactactactaccgtagtttcgaacgtaaacggtcgggtacccaagtacgtaaaggttcgaaggtggacgtaggtcggatcggtagggaactagtactttcgacttcgtacacctactcaacgctaagtccgtacgacctaaccgtagtaagttacttttacgaacttaacgttactaacgttagtacaacgtaagtacgttaactacgtaccgttacgttacgtttcggaccgtaagggactaacgtcgttaggataacgtaacgaaacgtacgtacgtaggtctgtctaaccg

SEQ ID NO: 57387 - DNA, 534 bp, Homo sapiens
  misc_feature: GYAE6OF01CPI9Z.18.23.C01.1.454.CMB.1.raw
  modified_base (445)..(445): a, c, t, g, unknown or other
  misc_feature (445)..(445): n is a, c, g, or t
  modified_base (524)..(524): a, c, t, g, unknown or other
  misc_feature (524)..(524): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaaggaaaacgccctaagctgcagatgattggtccgtccagtttcccaagtatcgggggcccccagtcgagacttcccggcgtcagtggatcgtgggacagtacttcactctcaccatcagcagcctgcagcctagaagtattttgactaacttaacttattgtacagcaggccnctaactaactttcccgctctacgtttcggacggtaggaccgaagggtggagatacgaaacgacgtggtgctgctacatntcgtctctac

SEQ ID NO: 57388 - DNA, 541 bp, Homo sapiens
  misc_feature: GYAE6OF01D9YBG.18.23.C01.1.454.CMB.1.raw
tcagtacgagtatgcacgaccggtgctcgatttagtacacgtgattagggattgggggcaggagtcagacccagtcaggacacagcatggacacgaggtcccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttgtatcagcagaaaccaggaaaacgccctaagctgcagatgattcggtccgtcctagtttccaagacgtcggggccccatcgagtacttccgcgtccgaggtggatcgtgggactaggtactttcactctacaccatcagcacgcctgcacgcctagaagtattttcgactaactttacttattcgtcagcgaggcgacaactaactttcccgcttctacgttcggacggacggaccaaggtggacgataccgaaacgtatggtcgctgacctacacttctcttctctacc

SEQ ID NO: 57389 - DNA, 556 bp, Homo sapiens
  misc_feature: GYAE6OF01EAEKH.18.23.C01.1.454.CMB.1.raw
  modified_base (549)..(549): a, c, t, g, unknown or other
  misc_feature (549)..(549): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcaagaaaccaaggaaaacgccctaaagctagcagatgagttcggtccgtcctagtttaccaagacgtcggggacccccagtcggagtacgttcccgcgtcgagtggatcgtgggacagtatttcactctacaccatcagcacgcctgcagcctagaagttatttcgactaactttacttattcgtacacgctaggccactactaacttccgcttctacgtttcggacggagggaccaagggtcgaagagtacgaaacgtagtggtggcgtgacctacactctcttntctaccg

SEQ ID NO: 57390 - DNA, 526 bp, Homo sapiens
  misc_feature: GYAE6OF01DBOTS.18.23.C01.1.454.CMB.1.raw
  modified_base (386)..(386): a, c, t, g, unknown or other
  misc_feature (386)..(386): n is a, c, g, or t
tcagtacgagtatgcacgaccggtgctcgatttagtacacgtgattagggattgggggcaggagtcagacccagtcaggacacagcatggacacgaggtcccgctcagctcctggggctcctgctgctctggctcccaggttccagatgcgacatccagatgacccagtccccttcttcccgtgtctgcgtctgtaggagaccgagtcaccatcacttgtcgggcgaatcaggatataaaacctggttagtttggtatcagcagaaaaccaggaaaagccctaagctgcagatgattggccgtccagtttccaagatggggccccatcgagattccgcgtcagtggatctgggacagatttcactctcaccatcagcagcctgcancctgaagattttgcaacttactaattgtcaagcaagcgcaacaatttcccgctcactttcggacggtagggacccaaagggtgaaggattacgaaaacgaaacgtggtcggacgtgctacccaatcctggtcttctaacc

SEQ ID NO: 57391 - DNA, 538 bp, Homo sapiens
  misc_feature: GYAE6OF01B5IFY.18.23.C01.1.454.CMB.1.raw
  modified_base (270)..(270): a, c, t, g, unknown or other
  misc_feature (270)..(270): n is a, c, g, or t
  modified_base (530)..(530): a, c, t, g, unknown or other
  misc_feature (530)..(530): n is a, c, g, or t
tcagtacgagtatgcacgaccggtgctcgatttagtacacgtgattagggattgggggcaggagtcagacccagtcaggacacagcatggacacgaggtccccgctcagctcctgggctcctgctgctctggctcccaggttccagatgcgacatccagatgacccagtccccttcttccgtgtctgcgtctgtaggagaccgagtcaccatcacttgtcggcaagtcagagcattagcagctattaatgtatcagcagaaacaggaaancccctaagctcctgatctatgctacatccagtttgacgtaaagtgggtacccatcaaggttcagtggcagtggatcgtgggacagtatttcactctcaccatcagcagtctacgcaaccgtgaagtattttacaacttacttactactactaacaagtagtacttacgtaccgttaccgttacgtttacgttcggacggacggtacgacgtacgtagacgtacgtaacgaacgtacgtggtacgtacgtcaccactcgtntcgttacc

SEQ ID NO: 57392 - DNA, 543 bp, Homo sapiens
  misc_feature: GYAE6OF01CYL0U.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttattggtatcagcaagaaaccaggaaaagccctaagctgcagatgattggtccgtctagtttccaagatcggggccccaagtcgagattccgcgtcagtggatcgtgggacagactttcaactctacacatcagcagcctgcacgcctgaaagtactttagactaaacgtttactaattgtaccagcctaaggccgactaacaacttttccccgcttacaacgtttcggacggaggaccgaagggtcgaagtactacgaaacgtaactggtgctgacaccatctgtcttcgtac

SEQ ID NO: 57393 - DNA, 604 bp, Homo sapiens
  misc_feature: GYAE6OF01DAIAV.18.23.C01.1.454.CMB.1.raw
  modified_base (355)..(355): a, c, t, g, unknown or other
  misc_feature (355)..(355): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttggtatcagcaagaaaaccaaggaaaacgccctaagctgacagatgattcggtccgttccagtttacccaagtacgtcggggcccctagtcgagacttcccgngtcagtggatcgtgggactagtattcactctacacatcagcagcctgcagcctagaagttattttagacttaactttacttatttcgacgtagtcgacgggctacctaaccttaaccgtttccccgacttaccgtaccggtttcgggaccgggacgggaacccgtaaggggtcggaagacgtaaccgaaacggtaacgttggttcgggacttacgacgtaccctattccgttcgttcctttacctaccg

SEQ ID NO: 57394 - DNA, 534 bp, Homo sapiens
  misc_feature: GYAE6OF01ARGN2.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtcccttcttccgtgtctgcgtctgtaggagaccgagtcaccatcacttgtcgggcaatcaggatattaaaacctggttagtttggtatcagcagaaaccaggaaaacgccctaagctgcagatgattggtccgtcctagtttccaagatcggggccccatcgagattccgcgtcagtggatcgtgggacagtattcactctcaccatacagcagcctgcagcctgaacgtattttagactaacttacttattgtacagcgacgcgtacactaacttcccgctctacgtttcggcggtagggaccgaagggtcggagatacgaaacgtacgtggtcggcgtcgaccgtacactctcgttcttctac

SEQ ID NO: 57395 - DNA, 600 bp, Homo sapiens
  misc_feature: GYAE6OF01CIPG2.18.23.C01.1.454.CMB.1.raw
  modified_base (574)..(574): a, c, t, g, unknown or other
  misc_feature (574)..(574): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcagatataaaacctggttagttggtatcagacaagaaaccgaaggaaaacgccctaagctagcagatgattcggtcctctagttaccaagacgtcgggaccccagtcgagtacgttccgcgtcgagtgatcgtagggacagtattcactcacaccatcagcacgtcctagctacgctagtaatatttcgactaacttacttatgtacagctaggcgactactaaccgtttccccgacttaccgtaccgtttccggggaacgggtaacgggaacccgaaggggttcgaaacggtaactaaccggtaaaaccggaacgttggtaccgggacttacgacctaaccgtnttacccgttgttccttaccgttaccg

SEQ ID NO: 57396 - DNA, 591 bp, Homo sapiens
  misc_feature: GYAE6OF01CE8CN.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttggtatcagcaagaaaccaaggaaaacgccctaagctgcagatgattcggtccgtccagtttccaagagtcggggccccatcgagtacttccgcgtcagtggatcgtgggacagtatttcactctcaccatcagcagcctgcacgctagaagtatttgactaacttacttattcgtacacgcgacggcgactaactaacgtttccccgcttaccgttaccgtttaccgggaccgggtaacggggtaccgaagggtaggacgaacgtaacgaaaaccggtaacgttagggtcggaccgtacggacctaaccgtacttacgttcgttccgttcgttaaccg

SEQ ID NO: 57397 - DNA, 630 bp, Homo sapiens
  misc_feature: GYAE6OF01C9HHA.18.23.C01.1.454.CMB.1.raw
  modified_base (425)..(425): a, c, t, g, unknown or other
  misc_feature (425)..(425): n is a, c, g, or t
tcagtacgagtatgcacgaccggtgctcgatttagtacacgtgattagggattgggggcaggagtcagacccagtcaggacacagcatggacacgaggtccccgctcagctcctggggctcctgctgctctggctcccaggttccagatgcgacatccagatgacccagtccccttcttccgtgtctgcgtctgtaggagaccgagtcaccatcacttgtcgggcgaatcgaaggataattaaaacctggttagtttggtatcagcaagaaaccaggaaaacgccctaagctgacagatgattggtccgtcctagtttccaagacgtcggggaccccaagtcgagacttccgcgtcagttgatcgtgggactagactttcacttctacaccatcacgcaagcctagctacgccttagaaacgttntttacgactaactttactattcgtacagcgtaggcctactaacctaacgtttccccgacttacctaaccggttttcggggaccgggaacggggtaacccgtaaggggttacggaacgtaacgtaacccgtaaaaacggtaccgttggtaccgggtcgtaaccggtacctaacccgtacgttacttcgggttaccttaccctaccg

SEQ ID NO: 57398 - DNA, 783 bp, Homo sapiens
  misc_feature: GYAE6OF01CZZOR.18.23.C01.1.454.CMB.1.raw
tcagtacgagtatgcacgaccggtgctcgatttagtacacgtgattagggagttgggggcaggagtcagacccagtcaggacacagcatggacacgagggtccccgctcagctcctggggctcctgctgctctggctcccaggttccagatgcgacatccagatcgacccacgtccccttcttccgtgtctgcgtctgtaggagaccgagtcaccatcacttgtcggcgaatcagatattaaaccgtggttagttgtatcagcaagaaaccaggaaaacgaccctaagctagcagatgtacgttcggtccgtacctagtttaccaaggacgtcgggacccctagtccgtagacgttccgcgtacaggttcggagtcgtaggggactaggtactttccgactcttaccaacctatccgacgccgaacgtcccgtacgaccgtaacggtaacccgttaaaagttacgttttacgaaacccttaacgttttaccttaagtttaccggtaaccgaacggtaccgtacgggaccgtaccgtaacccgtttaacccttttacccccggtacctttacccgggtttaaccggttttcccgggggaacccggggtaacgggggtaaccccgggtaaaggggttacgggtaaacggtaaaccgttaacccggaaaaaaccgggttaaccggttacgggtaaccgggtcccgttaacccgggtaacccgtaacccgttaaccgtttaccggtttaccggtttaccctttccggttaccccttttaccccccgg

SEQ ID NO: 57399 - DNA, 566 bp, Homo sapiens
  misc_feature: GYAE6OF01BOTA9.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaacctggttagttggtatcagcaagaaaccaggaaaacgccctaagctgacagatgagttcggtccgtcctagtttaccaagtacgtcgggccccagtcgagacgttccgcgtcaggtggatcgtgggacagtatttcactctacacatcagcagcctgcacgcctaggaagttatttacgacttaactttacttattcgtacagcgaggcacaactaactttcccgctcgtacgtttcgggacgggtacgggaccgtaagggtcggagtaacgtaccgaaacgtacgtggtcggactgacctaccgtatcgttcgttctctaccg

SEQ ID NO: 57400 - DNA, 499 bp, Homo sapiens
  misc_feature: GYAE6OF01DB9ZH.18.23.C01.1.454.CMB.1.raw
  modified_base (424)..(424): a, c, t, g, unknown or other
  misc_feature (424)..(424): n is a, c, g, or t
tcagtacgagtatgcacgaccggtgctcgatttagtacacgtgattagggattgggggcaggagtcagacccagtcaggacacagcatggacacgaggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagccctaaagctgcagatgattggtccgtccagtttccaagatggggccccatcgagattccgcgtcagtggatctgggacagattcactctcaccatcagcagcctgcagcctagaagtattttgctaacttactattgtcagcaggcncaacaatttcccgctcactttcggcgagggaccaaggtgagatcgaaacgatgtggctgcacatctgtcttcgac

SEQ ID NO: 57401 - DNA, 561 bp, Homo sapiens
  misc_feature: GYAE6OF01EMPAG.18.23.C01.1.454.CMB.1.raw
  modified_base (317)..(317): a, c, t, g, unknown or other
  misc_feature (317)..(317): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttggtatcagcaagaaaccaggaaaagccctaaagctgcagatgattggtccgtcagtttccaagntcgggccccatcgagacttccgcgtcagtggatcgtgggacagtatttcactctcaccatcagcagcctgcagcctagaagtattttagctaacttacttattgtacagcaggcacaactaactttcccgcttacctaccgtttcgggacgggaacgggacccgtaagggtacggagtaacgtaccgaaaacggtaacgtaggtcggctacggacctaacctactcgttcgttccttcgtaccc

SEQ ID NO: 57402 - DNA, 578 bp, Homo sapiens
  misc_feature: GYAE6OF01DOM6P.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttgtatcagcaagaaaccaaggaaaacgccctaagctgcagatgattcggtccgtcctagtttaccaagcgtcggggaccccagtcgagacttccgcgtcaggtggatcgtgggacagtactttcactctcacatcagcagcctgcacgtcctagtaacgttattttacgaccttaacttacttattgtcaggtcacggccgactaaccttactttccccgacttctacggtttcgggacgggacgggaaccgtaagggtaggacgtaataccgaaaacgtagtcggtcggactcgaccgtacctattccttacgtcttccgtaccg

SEQ ID NO: 57403 - DNA, 533 bp, Homo sapiens
  misc_feature: GYAE6OF01C9PJJ.18.23.C01.1.454.CMB.1.raw
  modified_base (279)..(279): a, c, t, g, unknown or other
  misc_feature (279)..(279): n is a, c, g, or t
  modified_base (372)..(372): a, c, t, g, unknown or other
  misc_feature (372)..(372): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttggtatcagcaagaaaccaggaaaacnccctaagctagcagatgattggtccgtctaggtttaccaagtcgtcggggccccagtcgagtacttccgcgtcaggttgatcgtgggacagtntttcactctcacctatcagcagccctgcacgcctagaacgttagtttgaccttaacttacttattcgcagcgacggcacaactacttcccgcttcacgtttcggcgggacggaccgaaggtgagtagtacgaaacgatggtgctgcacatctgtctcgtac

SEQ ID NO: 57404 - DNA, 556 bp, Homo sapiens
  misc_feature: GYAE6OF01ADRQZ.18.23.C01.1.454.CMB.1.raw
  modified_base (178)..(178): a, c, t, g, unknown or other
  misc_feature (178)..(178): n is a, c, g, or t
  modified_base (406)..(406): a, c, t, g, unknown or other
  misc_feature (406)..(406): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttnttccgtgtctgcgtctgtaggagaccgagtcaccatcacttgtcgggcatcaggatattaaaacctggttagttggtatcagcagaaccaggaaacgccctaagctgcagatgattcggtcctccagtttccaagacgtcggggccccagtcgagcttccgcgtcgagtgatcgtaggacagtactttcgactctacaccatcagcagcctgccagcctagtaacgtntttcgactaacttacttatcgtcagcacgtcgactacgtaactttcccgacttccgtacgtttccgggacggtacggaccgaagggtcgaacgtactacgaaacgtagtggtcggactacgacgtacctatacctgttccttcgtacccg

SEQ ID NO: 57405 - DNA, 771 bp, Homo sapiens
  misc_feature: GYAE6OF01EWXNE.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatgacccagtccccttcttccgtgtctgcgtctgtaggagaccgagtcacatcacttgtcgggcgaatcaggtatattaaaaccgtggttagtttggtatcgagtcaagaaaaccaaggaaaacgccctaagctgcagatgattggtccgtccagtttccaagacgtcgggccccagtcgagtacgttccgcgtacaggtgatcgagggacaggtactttacgaccttcgtacctaacctattaccaacggtacctaacgtcccgtacgtaccgaaccgtcccgttaaggtaaacgttaacgttttcggaaccttaaaccgttttaaccttaacgttttcgttaccggtaacggtaccggtaacggggtacccggtaacctaaacccgtttaaacccgttttccccccggtaactttaccccgttaacccgggtttttacccgggggaacggggtaaccgggggtaaccccggtaaaggggttacggggtaaaccgtaaaccggttaaaccggtaaaacccggttaaccgggttcggtaaccgggttaccgtacgggtacccctaaacccgttacttccgtttaaccggtttcccttccggttaaccccgg

SEQ ID NO: 57406 - DNA, 650 bp, Homo sapiens
  misc_feature: GYAE6OF01C1KFK.18.23.C01.1.454.CMB.1.raw
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccacgtccccttcttccgtgtctgcgtctgtaggagaccgagtcaccatcacttgtcgggcgaatcaggataattaaaacctggtttagttggtatcgagcaagaaaccaaggaaaacgccctaagctagcagatgtacttggtccgtactagtttaccaaggtacgtcggggaccccagtcgagtacttcccgngtcagtgactcgtaggganagtacttcactctacacctatcagcacgcctgacacgcgtagtaagttactttacgaccttaacttacttattcgtacagtacgacggaccgacctaaccgtaacctttaccccggtccttaccgtaccgttttaccggggaccggggtacgggtaaccgtaaggggttacggaaacgtaacgtaaaccgtaaaccggtaacgttacgggtccgggtaccttacggacccgtaaccgttaacgttccgttacgttccttccgttaacccg

SEQ ID NO: 57407 - DNA, 723 bp, Homo sapiens
  misc_feature: GYAE6OF01C2NQZ.18.23.C01.1.454.CMB.1.raw
tcagtacgagtatgcacgaccggtgctcgatttagtacacgtgattagggattggggggcaggagtcagacccagtcaggacacagcatggacacgaggtcccgctcagctcctgggctcctgctgctctggcctcccaggttccagatgcgacatccagatcgacccacgtccccttcttccgtgtcctgcgtctgtaggacgaccgagtccaccatcacttgtcgggcgaatcgaggtataattaaaaccgtggtttagtttaggtactacgaacgcgaacgaaaaccaaggaaaacgcccctaaaggcctagacaggatagtattcggtccgtacctaaggtttaccgaaaggtacgtacggggaccccctagtccggtaagtacgtttcccggcgtacgtaggtaggtaacgttcgtaggggtacacggttaacgtttccaacctttccgtacctaaccctagttaccgaaacggtctaacggtcccctagggaccctaacggtcccgttaggtaaacgtttaacgtttttacggaaccttaacttttaacgttagtttacgtcgaacggtccgaaggccgaactaaccgttaaccgtttcccgtactacccgtacgtttccgggacgggacgggtaacctaagggtacggacggtaataaccgaaacgtacggtaggtcggctacgacgtaacctacgtacttacgtcttacgtaccg

SEQ ID NO: 57408 - DNA, 517 bp, Homo sapiens
  misc_feature: GYAE6OF01BLRAG.18.23.C01.1.454.CMB.1.raw
  modified_base (436)..(436): a, c, t, g, unknown or other
  misc_feature (436)..(436): n is a, c, g, or t
  modified_base (510)..(510): a, c, t, g, unknown or other
  misc_feature (510)..(510): n is a, c, g, or t
  modified_base (512)..(513): a, c, t, g, unknown or other
  misc_feature (512)..(513): n is a, c, g, or t
  modified_base (515)..(517): a, c, t, g, unknown or other
  misc_feature (515)..(517): n is a, c, g, or t
tcagtacgagtatgcacgaccggtgctcgatttagtacacgtgattagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttacggaactgggaacccaaggtcaccgtcctaggtccacgcccaaggcccaaccccnctcgtcacctcctcgttccccgccctccctccatacctcgtactgacgccgggctcggcaacggcacgatacgnanncnnn

SEQ ID NO: 57409 - DNA, 577 bp, Homo sapiens
  misc_feature: GYAE6OF01B3DVL.18.23.C01.1.454.CMB.1.raw
  modified_base (436)..(436): a, c, t, g, unknown or other
  misc_feature (436)..(436): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaaccaggaaaagccctaagctgcagatgattggtccgtcagtttccaagatcggggccccatcgagacttccgcgtcagtgatcgtgggacagtatttcactctccaccatcagcacgcctgcacgacctagtaagtattttgactaacttactattgtacagcaggcnctaacctaactttccccgacttaccgtacgtttccggacgggtacgggaacccgtaagggtcggacgaacgtaccgtaaaaccggtaacttacgggtcggacgtcgacctacctacgttacttcgttccgtttctaacccg

SEQ ID NO: 57410 - DNA, 743 bp, Homo sapiens
  misc_feature: GYAE6OF01A1UI0.18.23.C01.1.454.CMB.1.raw
tcagtacgagtatgcacgaccggtgctcgatttagtacacgtgattagggattgggggcaggagtcagacccagtcagggacacagcatggacacgaggtcccgctcagctcctggggctcctgctgctctggctcccaggttccagatgcgacatccagatcgacccagtccccttcttccgtgtctcgcgtcctgtaggagaccgagtcaccatcacttgtcggtcgaatcaggatattaaaacctggttagtttggtatcagacaagaaaccaggaaaacgccctaagcctgcagatgtagttcggtaccgtcctagtttccaaggactcgggggacccccagtaccgacgtactttcccggcgttcgtacggttggacgttccgtagggaactaggtacttttaccaaccttccgtacccaaccgtatccaacggtccgacggtccctacggaccgtacggtacccgtaggtaaacggttacttttacggaaccgtaaaccttttaacttacgtttacggtaccgtacggtaccggtaacgggtaccgtaccgtaaccgttaaccgtttaccccgtccgttaccgttaaccgttttccgggggaacccggggtaacggggtaaacccgtaacggggtacgggtaaaccggtaacgtaacccgtaaaaccggtaaccgtcgggtacgggtccgtaccggacccgtaacctacttaccgttcgttccgtttaccgtacccg

SEQ ID NO: 57411 - DNA, 539 bp, Homo sapiens
  misc_feature: GYAE6OF01B4M54.18.23.C01.1.454.CMB.1.raw
tcagtacgagtatgcacgaccggtgctcgatttagtacacgtgattagggattgggggcaggagtcagacccagtcaggacacagcatggacacgaggtcccgctcagctcctggggctcctgctgctctggctcccaggttccagatgcgacatccagatgacccagtccccttcttccgtgtctgcgtctgtaggagaccgagtcaccatcacttgtcggcaatcaggattattaaaacctggttagttggtatcagtcagaaaccaggaaaacgccctaagctgcagatgattggtccgtccagtttccaagagtcggggccccagtcgagacttccggcgtcagtggatcgtggacagatttcactctcaccatcagcacgcctgcacgcctagaacgtactttgactaacttactattgtcagcaggccgacactaactttcccgcttaccgtacgtttcggacggtacggaccgtagggtacggagtacgtacgaaacgtatggtcgcgtagactacatctcgtcttctaccg

SEQ ID NO: 57412 - DNA, 542 bp, Homo sapiens
  misc_feature: GYAE6OF01DNX1S.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccattccccttcttccgtgtctgcgtctgtaggagaccgagtcaccatcacttgtcgggcgaatcaggatattaaaacctggttagttggtatcagcaagaaaccaggaaaagccctaagctgcagatgattggtccgtcagtttccaagtatcggggccccagtcgagacttccgcgtcaggtggatctgggacagatttcactctcaccatcagcagcctgcagcctagaagtattttgacctaacttacttattgtacagcaggcgacaactaactttccccgcttctaccgtttcggacggtacgggaccgaagggtcggagagtacgaaaacggtaacgtggtcggctcgacctaccatcttcgtcttctac

SEQ ID NO: 57413 - DNA, 565 bp, Homo sapiens
  misc_feature: GYAE6OF01D6JTO.18.23.C01.1.454.CMB.1.raw
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcacatcacttgtcggcaatcaggatattaaactggttagttgtatcagcagaaaccaggaaaacgccctaagctagacagatgagttcggtccgtcctagtttaccaagtacgtcggggacccctagtcgacgtactccgcgtcaggtggatcgngggactagtattcactctcaccatcagcagcctgcngacctagagtatttgacctaacttntattgtnacgcaggcactactaacctttcccgacttccgtacgtttcgggacggtacgggtaaccagggttaggacggtaattaccgaaacgtaaccgtggtcggacctgacccgtacctagttcttcgttcttccgtacc

SEQ ID NO: 57414 - DNA, 598 bp, Homo sapiens
  misc_feature: GYAE6OF01CEDTE.18.23.C01.1.454.CMB.1.raw
  modified_base (410)..(410): a, c, t, g, unknown or other
  misc_feature (410)..(410): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaacgccctaagctgcagatgattcggtccgtcctagtttccaaggagtcggggccccagtcgagacttccgcgtcagtggatcgtgggacagtactttcactctacaccatcagcagcctgcagcctagaagttntttagacctaactttactattcgtcacgcgaggccactaactaacctttccccgcttaccgtaccgttttccgggaccgggtacgggtaacccgtaaggggtcggaacgaacgtaaccgaaacggtaacgtacgggtcggtaccgtaggaccctacccgtacttaccgttcggttcctttccgtaccg

SEQ ID NO: 57415 - DNA, 566 bp, Homo sapiens
  misc_feature: GYAE6OF01BGNNT.18.23.C01.1.454.CMB.1.raw
  modified_base (441)..(441): a, c, t, g, unknown or other
  misc_feature (441)..(441): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcaatcaggatattaaaacctggttagtttgtatcagcagaaaccaggaaaacgccctaagctgcagatgattggtccgtcctaagtttccaagtacgtcggggccccctagtccggagtacgttccgcgtcaaggtcggatcgtgggactagtactttcactctcaccatcagcacgcctgcacgcctagtaagtctttagactaacttacttattntcagcacggcacactaacttcccgctcctacgtttcggcgggaacggaccgtaagggtacggagtacgtacgaaacggtacgtggtcggactacggactaccgtactcctacgttcgttctaccg

SEQ ID NO: 57416 - DNA, 513 bp, Homo sapiens
  misc_feature: GYAE6OF01EJ2GD.18.23.C01.1.454.CMB.1.raw
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttggtatcagcaagaaaccaggaaaacgccctaagctgacagatgattggtccgtccagtttccaagacgtcggggccccatcgagtattccgcgtcaggtgatcngggacagtattcactcncaccatcagcacgcctgcagcctagaagtatttgactaacttacttattgtacagcagcgcactacttcccgctctacttcggacggacggacagggagagactacgaacgtagtggtgctgactacatctcttctctc

SEQ ID NO: 57417 - DNA, 767 bp, Homo sapiens
  misc_feature: GYAE6OF01ECDP2.18.23.C01.1.454.CMB.1.raw
  modified_base (214)..(214): a, c, t, g, unknown or other
  misc_feature (214)..(214): n is a, c, g, or t
tcagtacgagtatgcacgaccggtgctcgatttagtacacgtgattagggattggggggcaggagtcagacccagtcaggacacagcatggacacgacggtcccgctcagctcctggggctcctgctgctctggcctcccaggttccagatgcgacactccagactcgacccacgttccccttcttccgtgtctgcgtctggtaggacgaccgngtccactatctacgttggtcgggacaactcgaggtaataactttaaaccgttggttaagtttggtatcagacaacgaaacgaaggaaacctaccctaagctagacgagtagtgtacgttcggtaccgttacctacgtttaccgaaggtacgtccgggaccctagtacggtaagtaccgttccggcgtacgtaggtacggacgttcggtacgggaactacggtactttaccgacttacctaccgtaactacgtacgacggtacctaaccggtccttacgaaccgtacgtacccgttaagtaacggtttacttttacggaacctttaacgttttaaccgttacgtttcggaacctacggacgtaaccgggtctaaccgtaacccgttaccgtttccccggacctttacccggttacggtttaccgggggaaccgggtacggggtaaccggttaaggggtcgttaaacggaaccgttaaaccggtaacgggtacttacggggtccggtaccttacggaccgttaaccgtaccttacgttctaccgttccgtacccg

SEQ ID NO: 57418 - DNA, 640 bp, Homo sapiens
  misc_feature: GYAE6OF01BFHES.18.23.C01.1.454.CMB.1.raw
  modified_base (432)..(432): a, c, t, g, unknown or other
  misc_feature (432)..(432): n is a, c, g, or t
tcagtacgagtatgcacgaccggtgctcgatttagtacacgtgattagggattgggggcaggagtcagacccagtcaggacacagcatggacacgagggtccccgctcagctcctgggctcctgctgctctggcctcccaggttccagatgcgacatccagatcgacccacgttccccttcttccgtgtctgcgtctgtaggacgaccgagtcaccatcacttggtcggacaatcaggattaattaaaaccgtggtttagtttgtatcgagacaagaaaccgaaggaaaaccgccctaagcctgacgagtatgtacgttcggtccgtacctacgtttaccgaaggtcgtccggggacccctagtaccgacgtacttccggacgtcgaggtgactcgtgggactagtacttcacttcacactatcagcagccngaccacgtctagaagttactttacgaactttaacgttattcgttacgtcgacgtcgacgccgtaccaacttaaccgtttcccgacttaccgttaccggtttacgggaaccgggtacggaaccggtaagggtacggaacgtaacgtaaaccgaaacgtacgtggtacggtcgtacgacgtacctagtctttacgttccttcgttccccg

SEQ ID NO: 57419 - DNA, 616 bp, Homo sapiens
  misc_feature: GYAE6OF01COZUW.18.23.C01.1.454.CMB.1.raw
  modified_base (301)..(301): a, c, t, g, unknown or other
  misc_feature (301)..(301): n is a, c, g, or t
tcagtacgagtatgcacgaccggtgctcgatttagtacacgtgattagggattgggggcaggagtcagacccagtcaggacacagcatggacacgagggtccccgctcagctccgtggggctcctgctgctctggcctcccaggttccagatgcgacatccagatcgacccacgtccccttcttccgtgtctgcgtctgtaggagaccgagtccaccatccacgttggtcgggacgaatcgaggaattaagttaaaacctggtttagtttggtatcgagacaagtaaaaccaggaaaaccnccctaagcctagcagatgacttcggcctactacgttaccaagtacgtccgggcccctagtcgacgtcttccgcgtacgaggtggaactcggtcggaactagttacttccgacttcctaccacctataccagtaccacgtccctgacacgcgtagaagttctttacgacttaacgttacttagtcgtcagcgacgccgactacctaacgtttcccgacttacgtaccgttcgggacggtacggacgaggtcgaagaactaaccgaacgtactggtacgccgtacaccgtaccctagttcctcgttcttccgtaccg

SEQ ID NO: 57420 - DNA, 797 bp, Homo sapiens
  misc_feature: GYAE6OF01D4XU6.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacatccagatcgacccacgtccccttcttccgtgtctgcgtctgtaggagaccgagtcaccatacacttggtcgggacaatcaggaattaagttaaaaccgttggtttagtttggtatcgagacaagaaaaccgaaggaaaacgccctaagctgacagtatagtacgttcggtcccgtaccgtaacgtttaccgaaaggtacggtccgggggacccctaagtaccggaacgtaaccgttcccggacggttccgtaaggttcgggaacgttccggtaggggtaactaggttaacttttaccaaccctttacctacccgaacctaacgtaccgaacgacccgtacgtcccttcggaccgtaacgtacccgttaaggtaaacggtttacttttacggaaacccttaaacttttaacttacgttttcgtacgaacggtccgaagggtccctactaaaccgttaaccgttttccccgacctttaccgttaaccggttttccggggaaccggggtaacggggaacccgttaaagggggtcgggtaaacgtaaacgtaaacccggtaaaaccggtaacgttaggggttcggacccgttacggaccccgtaaaccttacgttaccgtttacggttcccttacgttaacccg

SEQ ID NO: 57421 - DNA, 555 bp, Homo sapiens
  misc_feature: GYAE6OF01BVD6C.18.23.C01.1.454.CMB.1.raw
  modified_base (298)..(298): a, c, t, g, unknown or other
  misc_feature (298)..(298): n is a, c, g, or t
  modified_base (539)..(539): a, c, t, g, unknown or other
  misc_feature (539)..(539): n is a, c, g, or t
  modified_base (551)..(551): a, c, t, g, unknown or other
  misc_feature (551)..(551): n is a, c, g, or t
  modified_base (554)..(555): a, c, t, g, unknown or other
  misc_feature (554)..(555): n is a, c, g, or t
tcagtacgagtatgcacgaccggtgctcgatttagtacacgtgattagggattggggcctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgccccaaactcatgatttatgatgtcactaatcggcctcgaggggttctaatcgcttctctgctcaagtctggcaacacggcctccngaccatctcgtggctccgagctgacggacgagctgattactactgcagctacatactacaagcaccagcactctattatcgttcgttacgaacgtacgggaacctaaggtccaacccggtctaggtccacgacccaacggccccaaacccgtctcgtcaaccttccgtccgttaccccctacccttccctacctacttaccgtcgtaacgtcgacggccgggtctacgggacgtacggcgnaacgtagctagntgnn

SEQ ID NO: 57422 - DNA, 536 bp, Homo sapiens
  misc_feature: GYAE6OF01EGWA9.18.23.C01.1.454.CMB.1.raw
  modified_base (279)..(279): a, c, t, g, unknown or other
  misc_feature (279)..(279): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaanccctaagctgcagatgattggtccgtccagtttccaagatggggccccatcgagattccgcgtcagtggatctgggacagatttcactctcaccatccagcagcctgcagcctgaagtatttgactaactttactattgtcagcaggcgcaactaacttcccgctctacgtttcgggacggtacgggaccgaagggtcggagaacgttacgaaacgtaactggtaggccgtgccgtacctatccttgttcttcgtac

SEQ ID NO: 57423 - DNA, 620 bp, Homo sapiens
  misc_feature: GYAE6OF01EB4H0.18.23.C01.1.454.CMB.1.raw
  modified_base (283)..(283): a, c, t, g, unknown or other
  misc_feature (283)..(283): n is a, c, g, or t
tcagtacgagtatgcacgaccggtgctcgatttagtacacgtgattagggattgggggcaggagtcagacccagtcaggacacagcatggacacgaggtccccgctcagctcctggggctcctgctgctctggctcccaggttccagatgcgacatccagatcgacccagtccccttcttccgtgtctgcgtctgtaggagaccgagtcaccatcacttggtcggcaatcaggataagttaaaacctggttagtttggtatcgagacaagaaaccaggaaacnccctaagctagcagatgtagttcggtcctcctagtttaccaagtcgtcgggaccccagtcgacgtacttccgcgtcgaggtggatcggtcgggactaggtacttcgactccgtactaccatcacgcacgccgtgaccacgtcctaggtaagttacgttttgaaccttaactttacttagtcgtacgagtccgaggccactaacgtacctttcccgcgttaccttccggttacgggaccggtaacgggtaccgtaaggggtacgaacgaacgtaaccggaaaacgtacgttcggtacggcctacgacctaccgtagttccctggttccctcttacccg

SEQ ID NO: 57424 - DNA, 649 bp, Homo sapiens
  misc_feature: GYAE6OF01CIHGS.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagtccccttcttccgtgtctgcgtctgtaggagaccgagtcaccatcacttgtcgggcaatcaggatattaaaacctggttagttgatcagacaagaaaccaggaaaacgccctaagctagcagatagattcggtccgtacctagtttaccaaggacgttcggggaccccctagtacggtacgtacttcccggcgttacgaggtggtatcggtagggactagttaactttccgaacttcctaccaaccgtattcacgccacgcctcgccacgtacctaggtaacgttagtttcgaaccttaactttaacttagttcgtacacggacgacggacctacctaacttaaccgtttccccgacttccgttaccgtttcgggaccgggtacgggaaccgtaagggtacggacgtaacgtacgtaaacggtacgtacggtcggaccgtagacccgtactacttccgttcgttccttccgtaacccg

SEQ ID NO: 57425 - DNA, 531 bp, Homo sapiens
  misc_feature: GYAE6OF01EK7GV.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagccctaagctgcagatgattggtccgtcagtttccaagatggggccccatcgagattccgcgtcagtggatcgtgggacagatttcactctcacatcagcagcctgcagcctagaagtattttgactaacttacttattgtacagcaggcgcactaacttcccgcttcctactttcgggacggacgggaccaaggtcggagactacgaaacgtaactggtcggctagacctacctattcctgttcctcgtaccg

SEQ ID NO: 57426 - DNA, 759 bp, Homo sapiens
  misc_feature: GYAE6OF01DT9DP.18.23.C01.1.454.CMB.1.raw
  modified_base (291)..(291): a, c, t, g, unknown or other
  misc_feature (291)..(291): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccacgtcccccttcttccgtgtctgtcgtctgtaggagaccgagtcaccatcacttggtcgggacgaatcgaggattaattaaaaccgttggttagttggtatcagcaagaaaccaaggaaacnccctaagctgacagtatgtacgttcggtacccgttacctacggtttaccaaggtacggtccggggacccctagtacggacggtacgttccggcgtaccgtaggtggacgtcggtacgggtactagttaacgtttcctaactccgttaccctaaacctacgtaccgaacgacccgtaaccggtccctcggaccgtaacggtacccgttaaggttaacgtttaacgttttacgtacccttaaacttttaacgttacgtttcgtacgtaccggtacgaacgggtaccgaccgttaaccttaacccgtttaccccgtacctttacccgttacccggttttcggggaccggggtaaccgggtaaccgggtaaaggggtacggtaaaccggtaacgtaaccggtaaaaccggtacggttacgggttacggaccgtacgaccctaccgtacttaccgttcttccttccgtacccg

SEQ ID NO: 57427 - DNA, 760 bp, Homo sapiens
  misc_feature: GYAE6OF01C3TY0.18.23.C01.1.454.CMB.1.raw
  modified_base (283)..(283): a, c, t, g, unknown or other
  misc_feature (283)..(283): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagtccccttcttccgtgtctgcgtctgtaggagaccgagtcaccatctacttgtcgggcgaatcaggatattaaaacctggttagttgtatcagacaagaaaaccaggaaaacnccctaagctgacagatgatttcggccttaccgtagtttaccaaggtacgtcggggaccccctagtaccggtacgtaacgtttcccggcgttacgtacggttcgggtaacttcggttaggggaactaacggttacttttaccgtaacccttccttaccaaacccgtaacgttaccaacggtcccgaacggtccccgttacggaaccgtaacggtacccgttaagttaaacggttacttttttacggaaccttaacctttaacttacgtttacgtacgtacgtacgtacgggccgtaacctaacccgttaaaccgttttccccgaccgttaccgttaccggttttaccggggacggggtaacggggaaccgtaaacggggtacggaacgtaacgtaaccggtaaaaccggtaagttcgggtacggtaccgttacgacccgtaacctactttaccgttacgttcccgtttcgttaacccg

SEQ ID NO: 57428 - DNA, 711 bp, Homo sapiens
  misc_feature: GYAE6OF01BJS6T.18.23.C01.1.454.CMB.1.raw
tcagtacgagtatgcacgaccggtgctcgatttagtacacgtgattagggattgggggcaggagtcagacccagtcaggacacagcatggacacgacgggtccccgctcagctcctggggctcctgctgctctggctcccaggttccagatgcgacatccagatgacccacgtccccttcttccgtgtctgcgtctgtaggagaccgagtcaccatcacttgtcggcaatcaggatattaaactggttagttgtatcagcaacgaaaccaaggaaaacgccctaagctgacagatgagttcggtccgtctagtttccaagacgtccgggccccagtcgagtacttccgcgtcgagtgatcgtaggactagtactttacactctacacctatcagacacgcctgcacgtctagtaagtactttcgaccttaactttacttacgttacgttacgacggtaccgaacgggtacccgtaaccgttaaccgttaacccgttttcccccggtacccgttacccggtttacccgggttttacccgggggacccgggttaaccggggaaacccggtaaaggggttacgggtaaacggtaaaccgtaaacccggtaaaaaccgggttaaccggttacgggttaccgggtacccgttaccggtaacccgttaacccgtacgtttacccggtttaccgtttcccgtttaccgttaacccccg

SEQ ID NO: 57429 - DNA, 582 bp, Homo sapiens
  misc_feature: GYAE6OF01BLARO.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggataattaaaacctggttagttggtatcagcaagaaaccaggaaaacgccctaagctgcagatgattggtccgtcagtttccaagagtcggggccccatcgagacttccgcgtcagtggatcgtgggacagtactttcactctcaccatcagcacgcctgcagcctagaacgtattttagactaactttactattgacagcacggcacgactaacttcccgcttaccgtaccgtttcgggacgggtaacgggaaccgtaaggggtcggaacgtaacgtacgaaaaccggtaactagggttacggaccgttcgacctaacccgtacgttaccttcgttcccttcgtacccg

SEQ ID NO: 57430 - DNA, 607 bp, Homo sapiens
  misc_feature: GYAE6OF01DN0JN.18.23.C01.1.454.CMB.1.raw
  modified_base (275)..(275): a, c, t, g, unknown or other
  misc_feature (275)..(275): n is a, c, g, or t
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcaatcaggatataaactggttagttgtatcagcaagaaaccaaggaaaacnccctaagcctgcagatgattggtccgtctagtttaccaagtacgtcgggaccccagtcgagtacttccgcgtcgaggtgactcgngggactagtactttcactctaccacatcagcacgcctgacncgtcctagtaagttattttacgaccttaactttatacgttgtacacgtcgacggcgtacctaaccttaacctttccccggacttaccgttaccggtttacggggaccggggtaacgggaacccgtaagggtcggaacgtaacgaaccgtaaaacggtacgttggtacggctcggacctaccgtacttcttcgttccttcgtacccg

SEQ ID NO: 57431 - DNA, 732 bp, Homo sapiens
  misc_feature: GYAE6OF01E01Q9.18.23.C01.1.454.CMB.1.raw
  modified_base (278)..(278): a, c, t, g, unknown or other
  misc_feature (278)..(278): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttggtatcagcaagaaaccaggaaaacnccctaaagctagcaagactgtaagttcggtcccgttacctaagttttcccaaaggtacgtcggggacccccaagtcgaacgtacgttcccgcgtacgaggtggaagttcgtaggggaacctaggttaacttttccgaaccttctaccgaaccctattaccgaggacctaaggtcccctaggtccaacgtacccgttaaggtaaacgttacttttacggaaccttaaacctttaaccttaagtttccgtacgtaacggcgtaaccgggtcgtaacctaacccgttaaccgtttccccggacctttaccgaaccggtttttcccggggaaccgggtaacgggtaacccgtaaaggggtacggtaaacggaaacttaaccggaaaaaccggtacgttcggtacggtacccgtacggtacccaacctacgttccgttacgttacccgttcttaacccg

SEQ ID NO: 57432 - DNA, 734 bp, Homo sapiens
  misc_feature: GYAE6OF01C3VBK.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacatccagatcgacccagtccccttcttccgtgtctgcgtctgtaggagaccgagtcaccatctacgttgtcgggacaatcgaggtattaacttaaaaccgttggttagtttggtatcgagtacaagaaaaccgaaggaaacgtaccctaagctagacagatgtagttcggtaccgtactagttaccaaggtacgtccggggacccctagtaccggagtaccgtttccggacgtcgtaggtcggtactacgtagggactaggttactttccgactacctaccaacctagtaccaggtaccacgtcctacgaccacggtaccgttaagtaaacgtttactttacggaaccttaaccgttttaacttagttacgtacgtaaggtaccgaacggaccctaactaaccttaacccgtttccccgtaaccttacccggttaacccggtttcggggaaccgggtaacgggtaaacccggtaacggggttagggaaacgttaacggtaaaccgtaaaccgggtacggttacggtcggaccgttacgacccgttacctaacgttccgttccgttaccttccttacccg

SEQ ID NO: 57433 - DNA, 702 bp, Homo sapiens
  misc_feature: GYAE6OF01C489M.18.23.C01.1.454.CMB.1.raw
  modified_base (179)..(179): a, c, t, g, unknown or other
  misc_feature (179)..(179): n is a, c, g, or t
tcagtacgagtatgcacgaccggtgctcgatttagtacacgtgattagggattgggggcaggagtcagacccagtcaggacacagcatggacacgagggtccccgctcagctcctggggcctcctgctgctctggctccaggttccagatgcgacatccagatcgacccagtccccttnttccgtgttctgcgtctgtaggagaccgagtcaccatctacgttggtcgggcaatcaggtattaattaaaaccgtggtttagttggtatcgagacaagaaaccgaacggaaaacgcccgtaagctagacagtagtgtacgttcggtccgtactacgttaccgaaggtcgtaccgggggacccctagtaccggtacgtaccgtttccggacgtacgtaggtacggtagtccggttacggggactagttacttacctaccgtcctacaccctatccgaagcacgtcctagaccacgtaccgtagtaacgtttatttacgaccttaacttacttagttctcgacgtcgacggccgtaactaaccttaccgtttcccgtacgttacggttaccggtttacgggaccgggtacgggtaaccgtaaacggggttacgaacggttaaactaaccggaaaaccggttgttacgggtacggaccgtaccggacctacccgtacttccgttaacgtttccctacgttaccccg

SEQ ID NO: 57434 - DNA, 752 bp, Homo sapiens
  misc_feature: GYAE6OF01C7NG6.18.23.C01.1.454.CMB.1.raw
  modified_base (179)..(179): a, c, t, g, unknown or other
  misc_feature (179)..(179): n is a, c, g, or t
  modified_base (374)..(374): a, c, t, g, unknown or other
  misc_feature (374)..(374): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagtccccttntccgtgtctgcgtcgtgtaggagaccgagtacaccatcacgttggtacgggcaagtcaggacttaattaaaccgttggttttaagttggtactacagacaacgaaaaccgaaggaaaccgccctaagcctggacagatgtattcggtcctcctagttaccaagtacgtccgggacccagtcgagtaccgttccgngttacgagtggtactcggtagggactagtactttaccaaccgttctaccgtaacctacgttaccgaacggtccgaacgtcccgttaggaccctaacggtacccgttaagggtaaaccgtttagtttttaccgaacctttaaaccgttttacttaggttttaccggcgtaaccgtcggtaacggtacctaaccggtaaaccctttaacgtttccccccgtaagttcccgtaaccgggtttccgggaacgggtaaccgggtaaccgtaagggtacgggaaacctaacgtaaccggtaaaaccgttacggttacggtcgggtacccgtaagtacccccgtaccgttacggttgtacccgtttttccaaccggtttaccccg

SEQ ID NO: 57435 - DNA, 684 bp, Homo sapiens
  misc_feature: GYAE6OF01DTC2A.18.23.C01.1.454.CMB.1.raw
  modified_base (310)..(310): a, c, t, g, unknown or other
  misc_feature (310)..(310): n is a, c, g, or t
  modified_base (672)..(672): a, c, t, g, unknown or other
  misc_feature (672)..(672): n is a, c, g, or t
tcagtacgagtatgcacgaccggtgctcgatttagtacacgtgattaaggggaaggttgggggcgacggagtcagtacccagttccacggacacagcatggacacggagggtccccggctcgacgacgtcctggggcttcctgctgctctggctcccaggttccagatgcgacatccagatcgacccagttccccttcttccgtgtctgcgtctgtaggagaccgagtcaccatcactttggcggcaatcgaggtataacttaaaaccgtggtttacgtttggtatcagacaagaaaaccaaggaaaacnccctaagctacgacagtatggtagtttcggtccgtacctaggtttaccaaggtacgtcggggaccctagtcgaagtcgtccgacgtcgtaagtcggactcgacggaatagtactttccacttctacaactactcgaacgctaacgtccctggaccacgtaccgtagtaacgtttaacgttttacgaacctttaacgtttaccttagttcgtacgacgacgacggacctaactaccttaacgtttccccgtattaccgttacggtttacggacgggtacggaaccgtaagggttacgaacgtactaaaccgaaaccggtagttcggtccggaccttacgaacctacgttacttcgttacgttntttccgtacccg

SEQ ID NO: 57436 - DNA, 775 bp, Homo sapiens
  misc_feature: GYAE6OF01DI2UQ.18.23.C01.1.454.CMB.1.raw
  modified_base (179)..(179): a, c, t, g, unknown or other
  misc_feature (179)..(179): n is a, c, g, or t
  modified_base (281)..(281): a, c, t, g, unknown or other
  misc_feature (281)..(281): n is a, c, g, or t
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatcgacccagttccccttnttccgtgtcctgcgtctgtaggagaccgagtcaccatctacttggtcgggacgtaaatcgaaggtaattaacttaaaaccgttggtttagtttggtatcganacaagaaaaccaaggtaaaaccgccctaagctagactagtatgtattcgggtcccttaccgtaagtttccgaaagtcggtaccgggacccctagtacggaacgtaccttcccggagtaccgtaaggtcggtaacgttccggtaggggtaactaagttacctttaccgaaccttccgtaaccaaaccgttattaccccgaaaggcctaaccggtcccgtacgccgtaaccgtccgttaaggttaaacggttacttttacggaaccttaaacttttacgttaacgttcggttacaacggtccgaaccgggtacctaccgttaaacctaaccgtttcccccggaatttaccgtaccgggttttacggggaacccgggtaacgggtaacccggttaaagggtacgaaacgttaaaccgaaacgtaaaccggtaacgttcgggtcgtacccgttacgacccctaacttacggttcctacggttttcctacgttaccccg

SEQ ID NO: 57437 - DNA, 571 bp, Homo sapiens
  misc_feature: GYAE6OF01C8LAI.18.23.C01.1.454.CMB.1.raw
  modified_base (178)..(178): a, c, t, g, unknown or other
  misc_feature (178)..(178): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttnttccgtgtctgcgtctgtaggagaccgagtcaccatcacttgtcggcgaatcaggatattaaaacctggttagttggtatcagcagaaaccaggaaaacgccctaagctgcagatgattggtccgtcagtttccaagacgtcggggccccagtcgagacttccgcgtcagtggatcgtggacagtattcactctcaccatcagcacgcctgcacgcctagaagtattttcgactaacttactattcgtacagtcgaggcgactaacctaactttcccgcttcgtacgtttccgggacgggtacgggaccgtaagggtcggaacgtacgtaaccgaaaacgtacgtggtcggaccgtacgaccgtaacctattccgttcgttccttcgtacccg

SEQ ID NO: 57438 - DNA, 670 bp, Homo sapiens
  misc_feature: GYAE6OF01DGRA2.18.23.C01.1.454.CMB.1.raw
  modified_base (437)..(437): a, c, t, g, unknown or other
  misc_feature (437)..(437): n is a, c, g, or t
tcagtacgagtatgcacgaccggtgctcgatttagtacacgtgattagggattggggggcaggagtcagacccagtcaggacacagcatggacacgagggtcccgctcagctcctggggctcctgctgctctggctcccaggttccagatgcgacatccagatcgacccagtccccttcttccgtgtctgcgtctggtaggagaccgagtcaccatcacttggcggacatcaggattaattaaaacgtggttagttggtatcagcaagaaaccaggaaaactcccaagcctagacagtatagtacgtggtcccgtactacggtttacaagtacgtccggggacccctagtccggtagtacgttccgcgtacgaggtggtatcgtagggactagtactttcacgtctacaccctatcaacgtccgacgtacctcgacncgtaccgtagtaacgttagtttacgaccttaacgttacttacgttacgtacgacgaccggacgtacgtaccgtaacgttaacctttcccgtaccgttaccgttaccggtttacgggaccgggttacgggaaccggtaagggtacgggaacgtacgtaaccgtaaacggtacgttacggtcggtaccgtacggaccctacgttacttaccgtttcgttcccttcgttaaccccg

SEQ ID NO: 57439 - DNA, 814 bp, Homo sapiens
  misc_feature: GYAE6OF01DO27H.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacatccagatcgaccctacgtccccttcttccgtgtctgcgtctgtaggacgaccgagtcaccatcctacgttggtccgggacgaatcgaaggtaattaacgttaaaaccgttggtttagtttggtaatcgaagaccaagaaaaccgaaggaaaaccgtcccctaagcctagacagtatagtagttcggtcccgttacgtacgtttaccaaggtcggtccggggacccctagtaccggacgtaccgtttcccggcgttacgaggttacggacgttcggtacgggactaagttaactttcccgaaccttcccgttaccaacccgtattacccgaacggtcccgtaaccggtccctaccggaccgtaacggtaccccgttaagggttaaacgttacggtttttaacaacccgtttaaacttttacgttacgtttacgtaccgacgtacggtacgggaccgtaccgtaaacctttaacccgtttaccccgtaccgtttaccggtacccggttttaccggggaaccggggttaccgggaaaccggttaacggggttacgggaaaccgtaccgttaaaccggtaaaccggtaaggttacggtaccggtaccgttacgaccccttaccgtaactttccgtttaaccgttccttcccgttaaccccg

SEQ ID NO: 57440 - DNA, 635 bp, Homo sapiens
  misc_feature: GYAE6OF01DSLID.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggacgaccgagtcaccatcacttgtcgggcaatcgaggatattaaaacctggttagttggtatcagcaagaaaccgaaggaaaacgccctaagctagacagtatgtagttcggtccgtactacgtttaccaaggtcgtccggggacccctagtacgacgtacttccggcgtacgaggtggtatcgtgggaactagtactttcactctcacctatcagcagcctgcagtcctagtaattactttcgacctaagtttactagttcgtacaggcgacggctactaaccgtaaccgtttcccgacttacgtaccggtttacgggacgggtaacgggtaccgtaagggttacggaacgtaacgttaacccggaaaacgtccggttagggtccggaccgttcggaaccctaccgtaacgttccgttacggttccttctaacccg

SEQ ID NO: 57441 - DNA, 531 bp, Homo sapiens
  misc_feature: GYAE6OF01AOQQX.18.23.C01.1.454.CMB.1.raw
  modified_base (278)..(278): a, c, t, g, unknown or other
  misc_feature (278)..(278): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagtttggtatcagcagaaaccaggaaaanccctaagctgcagatgattggtccgtccagtttccaagatcggggccccatcgagacttccgcgtcagtggatcgtgggacagatttcactctcaccatcagcagcctgcagcctgaagtatttcgactaacttactactcgtacaacagtagttactacgtacccgtacgttacgttttcggaccgaggggaccaagcgtggagatacaaacgagtgtggctcgccaccatctctacttctatccttccccg

SEQ ID NO: 57442 - DNA, 550 bp, Homo sapiens
  misc_feature: GYAE6OF01B3IF1.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaacgccctaagctgcagatgattggtccgtccagtttccaagagtcggggccccagtcgagattccgcgtcaggtggatcgtgggacagtatttcactctcaccatcagcagcctgcagcctagaacgtattttcgactaactttacttattgtacagacgacggcgacaacctaacttcccgcttctacgtttcggacgggtacgggaccgaagggtcggaagactaccgaaacgtactggtcgcgtacgacctactactcgtgttcctctaccg

SEQ ID NO: 57443 - DNA, 583 bp, Homo sapiens
  misc_feature: GYAE6OF01A46IA.18.23.C01.1.454.CMB.1.raw
  modified_base (385)..(385): a, c, t, g, unknown or other
  misc_feature (385)..(385): n is a, c, g, or t
tcagtacgagtatgcacgaccggtgctcgatttagtacacgtgattagggattgggggcaggagtcagacccagtcaggacacagcatggacacgaggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagtttggtatcagcagaaaccaggaaaacgccctaagctgcagatgattggtccgtcctagtttccaagtagtcggggcccccagtcgagtacttccgcgtcaggtggatcgtgggacagtactttcactctcaccntcagcagcctgcagcctagaagtatttcgactaacttactattcgtcagcgaggcacactaactttcccgcttcctacgtttcggacggtacgggtaccgagggtcggaagtacgtaacgaaaacggtacgttagggtcggtccgttacggaccccgtaacccgtacgttacccgtttcgtttcccgtttcttacccg

SEQ ID NO: 57444 - DNA, 754 bp, Homo sapiens
  misc_feature: GYAE6OF01CTUUC.18.23.C01.1.454.CMB.1.raw
  modified_base (742)..(742): a, c, t, g, unknown or other
  misc_feature (742)..(742): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagtcccttcttccgtgtctgcgtctgtaggacgaccgagtcaccatcacgttgtcgggacgaactcgaaggtaattaagttaaaaaccgttgggtttaagttttaggtaacttaccgaagaccgaaagaaaaaccgaagggaaaaaccgtcccctaaaagccgttagaccaaggtactaggtaacgttcggtcccgtacctaacgtttacccgaaaggtaccgttaccggggacccctaagtccggtaagtaccgtttacccggacggttaccgtaagggttacggtaacgttaccgggtaacgggggtaaccttaaacgggttacgttttaccgtaaaccctttccgtaaacccgtaaaccctaacgttaccgaacggtaccgtaacggtcccgtaggacccgaacgtaccgtaagtaacgttattacggaactaacgtttactagtacgtacgacgccgtaggccgtactaaccgttaaccttcccgtacttaccgtacgttcgggaacgtacgggaacgtaggtacgagtacgtaacgaacgtagtggcgtctcgacctacgtactcgtnttcctgttaccg

SEQ ID NO: 57445 - DNA, 614 bp, Homo sapiens
  misc_feature: GYAE6OF01ERKV0.18.23.C01.1.454.CMB.1.raw
  modified_base (412)..(412): a, c, t, g, unknown or other
  misc_feature (412)..(412): n is a, c, g, or t
  modified_base (450)..(450): a, c, t, g, unknown or other
  misc_feature (450)..(450): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacatccagatcgacccagttccccttcttccgtgtctgcgtctgtaggagaccgagtcaccatcacttggtcggcaatcgaggtataattaaaaccgtggttagtttggtatcgagtacaagaaaccaaggaaaacgccctaaagtctagacagtatgtagttcggtacccgtctagtttaccaagtcggtccgggccctagtacggagtacttccggcgtacaggtggtactcggtaggactagtactttcacttcncaacatcagcacgcctgcacgtctagtaattacgtttnaacctaactttactgtacgtcgagcgtagctacacttaaccgttcccattctaccgttcggacgggtacgaccgtagggcgtacgaacgtaaccgtaaacggagttagggtccgcgtaccgaacccgtacgttactaccgtttcggtaccttaccgttaacccg

SEQ ID NO: 57446 - DNA, 687 bp, Homo sapiens
  misc_feature: GYAE6OF01C0DPL.18.23.C01.1.454.CMB.1.raw
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
tcagtacgagtatgcacgaccggtgctcgatttagtacacgtgattagggattggggggcaggagtcagacccagtcaggacacagcatggacacgagggtccccgctcagctcctggggcctcctgctgctctggcctcccaggttccagatgcgacactccagatcgacccctacgttccccctttcttccgtgtctgcgtcgtgtaggacgaccgagtccacatcacgttggtcgggacaancgaaggtaattaacttaaaaccgtggtttagtttgtatcagctaaacgaaaccgaaggaaaccnccctaagctagacagatggtacttcggtccgtactacgtttaccaagcgtccgggaccctagcgagtacttccggcgtacgagtgatcgtagggactagtacttcactctacacatcngcacgtcngacncactagtacgttctttacgacttaacctttgttacgttcgtacgacgtacgacggaccacctaaccgtttaaccgttccccgtcgttacccgttaccggttacggggaccgggtacggaaccgggaaagggttcggaaacgtaaccgttaaacgggaaacccttaaacgggttcggtaccgggtacccgttacggaaccctttaacctaacgtttacccgtttaccttccggtttaatttaccccccg

SEQ ID NO: 57447 - DNA, 842 bp, Homo sapiens
  misc_feature: GYAE6OF01D7GQO.18.23.C01.1.454.CMB.1.raw
tcagtacgagtatgcacgaccggtgctcgatttagtacacgtgattagggattgggggcaggagtcagacccagtcaggacacagcatggacacgacgggtccccgctcagctccgtggggcctcctgctgctcgtggcctcccgtaggttccagatcgacgacactccgagtactcgacccctacgttccccctttcttccgtgtctgtcgttcgtggtaggacgaccgagtccacctatccgtacgttggtaccgggactaacgtcgaaggtaacttaaacgtttaaaaccggtttgggttttaagtttcggtaacttacgaacggtaccgaaaacggtaaaaaccggaacgggtaaaacccgtaccccgtaaaggtccgtacggaccgtaagtaacgttcgggttaacgttttcccgggttacccgttaaccgttacgtttaacccgaagggtaccgggtcccggtacccctaagtacggtacgtaccggtttccggacgttacggtacggtacggtaacttccgggtaacggaacttacggtttacctttacccgaacctttccctaaccgtaacccgtacgttaccgaacgtaccgtaaccgtcccgtagaccgtaccggttcgttaaacggttaacgtttacgtttaccgtaaaccttacgtttacgttagttcgaacgttagcgtacggtaccaaccttaaccgtaccgtttccgaccgtttacggtaccggttacgggacggtacggtacgtagggtcgtaacgtaacgtacgtaaacgtggtacggtcgactaccgtaccgtaccttagttccgttcgttacctcgttacccg

SEQ ID NO: 57448 - DNA, 581 bp, Homo sapiens
  misc_feature: GYAE6OF01AS8M6.18.23.C01.1.454.CMB.1.raw
  modified_base (560)..(560): a, c, t, g, unknown or other
  misc_feature (560)..(560): n is a, c, g, or t
tcagtacgagtatgcacgaccggtgctcgatttagtacacgtgattagggattgggggcaggagtcagacccagtcaggacacagcatggacacgagggtccctgctcagctcctggggctcctgctgctctggctcccaggttccagatgcgacatccagatgacccagtccccttcttccgtgtctgcgtctgtaggagaccgagtcaccatcacttgtcggcgaatcaggataattaaaacctggttagttggtatcagcagaaaccaggaaaacgcccctaagctgcagatgattggtccgtcctagtttaccaaggagtcggggccccagtcgagacttccgcgtcagtggatcgtgggactagatttcactctcaccatcagccagcctgcacgtcctagaagttacttttagacctaacttactactttgccagcgaggaccgcaactaacgtttcccgcttacctcggtttacgggcggtaacgggaccgtaagggtacggaagtacgtaccggaaaaggtacgtggtacgggccttacggacctaacccgngttaccttcgttccttacccg

SEQ ID NO: 57449 - DNA, 746 bp, Homo sapiens
  misc_feature: GYAE6OF01EAUE4.18.23.C01.1.454.CMB.1.raw
tcagtacgagtatgcacgaccggtgctcgatttagtacacgtgattagggattgggggcaggagtcagacccagtcaggacacagcatggaacacggacggtcccgctcagcctccgtggggcctcctgctgtctcgtcggcctcccgtaggttccagatcgacgacactaccgagtatccgaccctaccgttcccctttcgttccgtgtctcgtccgttcgtggtacggacgaccgtagtccaacctatcctacgttcggtccgggactaactacgaaggtaacttaaacgtttaaaaccggtttggttttaaggttttaggtactacgacgtaccgaaacgaaaaccgaaagggaaaaccctacccgtaagccgtgacagtagtagtagtttccggtcccgtactacggtttaccaagtcggtccgggaccctagtcggacttaccgttccgcgtacgtaggtagacgtcggtaggactagttacttaccacttctaccgactatacgacgacgtacgtcctcgaccgtacgtccgtaagtaacgtttgtttacgaacctttaacgtttacttagttcgtacgacgacgacgaccgtaactaaccgttacctttccccgactttaccgttaccggtttccgggaacgggtaaccgggtaaccggtaagggtacggtaacgaacgtaaccgaaacgttacggtaggtcgacgtacgacctacctattcgttcttccttgtacccg

SEQ ID NO: 57450 - DNA, 727 bp, Homo sapiens
  misc_feature: GYAE6OF01CUJEY.18.23.C01.1.454.CMB.1.raw
  modified_base (304)..(304): a, c, t, g, unknown or other
  misc_feature (304)..(304): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacatccagatcgaccctacgttccccttcttccgtgtctgcgtctgtaggacgaccgagtccaccatcctacgttggtcgggacaatcgaaggtataacttaaaaccgtggtttagttggtatcgagacaacgaaaccgaaggaaaaccncccgtaagctagacagtatgtacgttcggtacctccgtacgttaccaggacgtccgggacccctagcgtagtcgttccgcgtcgtaggtgacgttcgaggtaactaggttacttcctaactctacgacctagtaccgagcctaacggtcccttacggacctacgtacccggttaagttaacgttttaacgtttttacgaaaccctttaaccgttttaacgttacgtttaccgggtaaccacggggttaaccgaacgggcccttaacccgtaaacctttaacccggttttccccgaacgtttaccgttacgggtttacccggggacggacggtaaccgtaggggtcgaaacgttaacaaaccgtaaacgtgtacgggtcgtaccaccgtaccgtaacttcgttcgttaccgttcctccgtaccc

SEQ ID NO: 57451 - DNA, 736 bp, Homo sapiens
  misc_feature: GYAE6OF01CKDR7.18.23.C01.1.454.CMB.1.raw
tcagtacgagtatgcacgaccggtgctcgatttagtacacgtgattagggattgggggcaggagtcagacccagtcaggacacagcatggacacggaggtccccgctcagctcctgggctcctgctgctctggctcccaggttccagatgcgacatccagatcgacccacgttccccttcttcccgtgtcctgcgtcgtgtaggacgaccgagtccaccatcgtacgttggtcgggacgaatcgaaggtaattaaacgttaaaaccgttggtttagtttaggtaattcgaacggaccgaaacggaaaaaccgaagggaaaaacccgaccccgtaaagcgtacggactagtaatggtaacgtttcggtccgtacctacgtttaccaaaggtcgtaccgggaccccagtcggtatacgtccgcgttcgagtggactacggtggactagtacttacacgtctaccgaactatcgaagcgacgtcctcgtacgactaccgtagtaaacgttacttttacgaaccttaacgtttacttaacgttcggttaccgagaacccggtaggaccctaccgttaaaccgttaaccgtttccccgaccttacccggttaccgggtttacggggaccgggtaacgggtacccggtaagggtaaccgaacggtacgtaaaccgtaacggtaacgtcggtcggtaccgtcgtaccctaccgttactaccgtttcgtacgtttcgtaccccg

SEQ ID NO: 57452 - DNA, 592 bp, Homo sapiens
  misc_feature: GYAE6OF01ACJCM.18.23.C01.1.454.CMB.1.raw
  modified_base (394)..(394): a, c, t, g, unknown or other
  misc_feature (394)..(394): n is a, c, g, or t
tcagtacgagtatgcacgaccggtgctcgatttagtacacgtgattagggattggggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtccaccatcacttggtcggcaatcaggataattaaaacctggtttagttggtatcagcaagaaaccaaggaaacgccctaagctgcagatgattcggtccgtacctagtttaccaaggacgtcggggccccagtcgagtcgttccgcgtcaggtgatcgtagggacagtctttcactcctacaactntacgagcacgcctgacacgtacctagtaacgttatttcgaacctaactttactagttcgtacgagtcgacggcactaacttacttcccgcttccgtacgttcgggaccgggtaggaccgtagggtcggaacgtacgtaaccgaaacggtacgtagggtccggactccggactacccgtctaccgttcgttcttctacc

SEQ ID NO: 57453 - DNA, 735 bp, Homo sapiens
  misc_feature: GYAE6OF01EFKG1.18.23.C01.1.454.CMB.1.raw
tcagtacgagtatgcacgaccggtgctcgatttagtacacgtgattagggattgggggcaggagtcagacccagtcaggacacagcatggacacgacgggtccccgctcagctccgtggggctcctgctgctctggctcccaggttccagatgcgacatccagatcgaccctacgtcccctttcttccgtgtctgcgttctggtaggacgaccgagtcaccatcacgttggcggacaatcgaggaattaacttaaaacgttggttagttggtatcagacaacgaaaaccgaacggtaaaaccgcccgtaagcgtacgacaagtatagtacgttcgggtacccgttaccgtagtttacccgaaggtcgtccggggacccctagtccgagtaccgttccgcgtacgaggtgtactacgtacgggactagttacgtttaccaccgttctaccaaccgtatccgaacgcgtaacgccctcggacctacggtaccgttagtaaacggtttctttaacggaaaccctttaactttaacgttacgttacgtacgacggtccgtaacggcccgtaactaaccgtttaaccgttccccggtactaacccggtttacggttaccggggaacgggtaaccggggtactaacggggtaggtaacgtaacttaaccggaaacgttacgtacgggtacggaccttacgaccgtaccttagtacccgttactttcctaaccgttaccccg

SEQ ID NO: 57454 - DNA, 707 bp, Homo sapiens
  misc_feature: GYAE6OF01EGRVQ.18.23.C01.1.454.CMB.1.raw
  modified_base (309)..(309): a, c, t, g, unknown or other
  misc_feature (309)..(309): n is a, c, g, or t
tcagtacgagtatgcacgaccggtgctcgatttagtacacgtgattagggattgggggcaggagtcagacccagtcaggacacagcatggacacgaggtcccgctcagctcctgggctcctgctgctctggcctcccaggttccagatgcgacatccagatcgaccctacgttccccttcttccgtgtctgcgtctggtaggacgaccgagtccacctatctacgttggtcgggactaatacgaggaattaacgttaaaccgttggtttagtttggtactcgagacgaaacgaaaccgaaggaaaaccncccgtaagctagacagtatgacgttcggtacctcctagtttaccgaagtcggtaccgggaccctagtacgagtacgtccgagtcgaggtgacgtcgaggactagttacttcacctacaccgtacagtcacgcacgtcctgaccgacgtacgttaagtaaacgtttctttacgaaccttaactttacgtaagttcgtacgacggtacgacggtccaacctaaccgttaccgttaccccgcgtttaaccgttaccgggttaccggggaacgggtaaccgggtaacccggtaagggtaccggtaaataaaccggtaacgtaaacccgggttaagttccggtcgggaaccctgaaccccgttacgtaactttccgttccggtttacctcccggtttaccccg

SEQ ID NO: 57455 - DNA, 818 bp, Homo sapiens
  misc_feature: GYAE6OF01C3TZX.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacatccagactcgaccctacgtccccttcttccgtgtctgcgtctgtaggagaccgagtcaccatctacgtttggtcggacaatcgaaggtaattaacgttaaaacgttggtttagtttaggtaattcagacaaagaaaacccgaaggtaaaaccgaccctaagactagacagtatgtaacgtttcggtccgttacgtacgtttaaccgaaggtacggtaccggggtacccctagtaccggtacgtaccgtttacccggcgttaccgtaggttacgggtaacttcgggtacgggtaacgtaacgttacctttaccgtaacccttcctaccaacccgtaattaccggacggacctacggtaccctacggtaccgtaaccggtacgttaaggtaaacgtttacgttttaaccggtaacctttaaacgttttaacttacgttttacgtacgtaacggtcgaacgggtacctaacccgttaaccgtttaacccgttttcccccgtaccgtttcccgttaaccgggtttaccggggaacccggggtaacgggtaacccggtaaagggttacgggtaaacgtaaacggtaaccgtaaaacggtaccgttagggtacgtaccgttacgacccttaacgttacttcccgttcgttacccgttccttaacccg

SEQ ID NO: 57456 - DNA, 695 bp, Homo sapiens
  misc_feature: GYAE6OF01E5BHK.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccctacgttccccttcttccgtgtctgcgtctgtaggagaccgagtcaccatcacttggcgggcaatcaggataagttaaaaccgttggttagtttggatcagacaagaaaccaaggaaaacgccctaagctagcagatgattcggtccgtcacgtttcgaaggacgtccgggccccagtccggagtacgttccggcgtcgtaggtggactcgtaggactagtactttcactcctacacactcacgcacgcctgacctacgtcctaggtaactttagtttacgaccttaactttagtacgtttacgaccgtaggaccgtacggtaccgtacctaacccgttaaccgtttccccgacgtttaacccggttacccgggtttagggggaacccgggttaaacggggaacccgtaaaggggttacgaaaaccggtaaccgttaaccgtaaaccgggtaacgtcggttcggtaacccgttccgtaaccccgtaaccttacgtaccgtttcccgtttccttacccgttaccccg

SEQ ID NO: 57457 - DNA, 837 bp, Homo sapiens
  misc_feature: GYAE6OF01DJYV1.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctgggctcctgctgctctggcctcccaggttccagatgcgacatccagatcgacccacgttccccttcttccgtgtctgccgtctggtaggacgaccgagtccaccatctacgttggtcgggactaaatcgaaggtaattaaacgtttaaaaccgtggttttagttggtaatcgaagacgaaacgaaaaccgaaggtaaaaccgccccgttaaaggccgttaggaccaaggtaagtttacggtaagttttccggggttaccccgttccgttaaacggttttacccgaaaggtaccggtcccgggggaccccctaaggtaccggacgtaaccgtttcccggacgttcgacggttggtaacgttcccggtaggggactaagttactttccgaacttccgaccctactacgttaccgaacggtaccacggtccctcggaaccgtacggtacccgttaggtaaacgtttaccttttaaccgtaacctttaaaccttttacgtttaacgtttacggaccgtaccgggacgtaaccggtacccgtaccctaaaccgtttaacccgtttaccccggtcttaacccgttaccggttttaccgggaccggggtaacgggtaaccgtaacgggttacggaacgttaacaacccggtaaaacggttacggtacggtccggtacctacggtaccctaaaccgtacttacccgttcttaaccgttcccgttaccccg

SEQ ID NO: 57458 - DNA, 797 bp, Homo sapiens
  misc_feature: GYAE6OF01AQRYH.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggcctcctgctgctctggctcccaggttccagactgcgacactccagatcgacccagtccccttctccgtgtctgctctgtaggacgaccgagtccaccagtctacgttggtcgggcaaatccgaaggtacttaacgttaaaaacccgttggtttaacgtttggtaactcgagacgaacgaaaaccgaaggtaaaaacgcccccttaaagcctagccgaagtacgtgaacgtttcggtacccgtacctacgttttacccgaaaggtaccgttccggggaccccctagtaccggtacgtaacgtttcccggcgttacgaggtacggaacctcgtacggggaactacggttactttacacccgttccgacctaccaacttcgacgtcctaacgccgttacgaccgtaccgtaccgtagtaaacgttactttgaaccttaaacttacgttaacgtttcgtacgacggtacgtacgggaccctaccgtaacgttaacccgtttacccccgtcgttacccggtttaccggtttaccggggaccgggttaaacggggaacccggttaagggtacggtaaccgtaaaggtaacccgttaaaacgggtaacgttcggggtaggtaccccgttacgacccgtaaccgtttaccgttacccgttcgtttaccgtttaacccgttaccccg

SEQ ID NO: 57459 - DNA, 827 bp, Homo sapiens
  misc_feature: GYAE6OF01D3B60.18.23.C01.1.454.CMB.1.raw
tcagtacgagtatgcacgaccggtgctcgatttagtacacgtgattagggattgggggcaggagtcagacccagtcaggacacagcatggacacgacgggtccccgctcagctccgtggggctcctgctgctctggcctcccgaggttccagatgcgacactccagatcgaccctacgttccccttcgttccgtgttctcgtcgtcgtggtaggacgaccgtacgtccaccatccgtacgttcggtaccgggacgtaatacgaaggtaacttaacgtttaaaaccggttgggttttaggtttaggtaactacgaagaccgtaaacggaaaaccggaaacgggtaaaacccgtaccctaaaggcttacggacgtaagtagttaggttaacggtttccgggttacccgttacttaacggtttaccgaaaggtccggttaccggggaacccctaggttaccggtaacgtccgtttcccggtacgtacggtaaggtacggtacgttacggtaggggaactaggtttacctttacaccgttacctaccgtaacctacgtaccgacgtacccgtacgtcccgtacggaccgttacggtaccgttaaaggtaacttttcgtttaaccggaaccttttaacttacgtttagtaccgacgtacgacgtacgggaccctaacgttaacccgttaccttccccggtacttacccgggttacgttcggggaacggacgggtaacgtagggtaccgtaagtaacgaaaccggtaacgtaggtcgggtcgtaccgtacgaaccgttacgttacgtttccggtaccttccgtcgttaccccg

SEQ ID NO: 57460 - DNA, 616 bp, Homo sapiens
  misc_feature: GYAE6OF01BL4OD.18.23.C01.1.454.CMB.1.raw
  modified_base (280)..(280): a, c, t, g, unknown or other
  misc_feature (280)..(280): n is a, c, g, or t
  modified_base (428)..(428): a, c, t, g, unknown or other
  misc_feature (428)..(428): n is a, c, g, or t
tcagtacgagtatgcacgaccggtgctcgatttagtacacgtgattagggattgggggcaggagtcagacccagtcaggacacagcatggacacgaggtccccgctcagctcctggggctcctgctgctctggctcccaggttccagatgcgacatccagatgacccagtccccttcttccgtgtctgcgtctgtaggagccgagtcaccatcacttgtcgggcgaatcaggataattaaaacctggttagtttggtatcagcaagaaaccaggaaaacnccctaagctgcagatgtattcgtccgtctagtttactaagagtcggggaccccagtcgagtacttccggcgtcaggtggacttacgtgggaacctaggtaactttcgactactacaacctatcagcacgcctgcacgcctagtaagtntttacgactaaccttacgtattgtactagacgaggaccgtacaactaacctttccccgcttacgttaccgtttcgggacgggtacgggtaaccgtaggggtacggtaacgaacgtaaccgaaaacgtaacgtttacggtcgggaccgttagacccgtaaccgactttacttcgttccgttcctaaccg

SEQ ID NO: 57461 - DNA, 850 bp, Homo sapiens
  misc_feature: GYAE6OF01EKHIC.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgaccctacgtccccttcttccgtgtctgcgtctggtaggacgaccgagtcaccatcacgttggcggacaatcagtataattaaacgtggttagttggtatcgagacaacgaaaccgaaggaaaaccgccctaagctagacagtatgtacgttcggtacccgttaccgtagtttaccgaaggtcggtccggggacccctagtacgacgtacgttcccggcgtacgaggtggtacttcggtagggaactacggttactttaccaccttaccgtacctaacccgtacttaccgaacggtacccgtaacggtcccttacggaccgtaaccggtacccgtttaaaggtaaacgttttacgttttaccggtaaaccctttaaacccgtttttaacgttaacgttttacggtaccgtaaccgggtaccggtaaccggtcccgttaaaccgttaaaccccgttttaaccccgttttcccccggtaaccgttttaccccgggtttaacccgggttttacccggggggaaccggggttaaacccgggggtaacccggttaaagggggtaacggtaaacgtaaaccggttaaacccgggtaaaacccggttacggtttaccgggtaccggtacccgttacggaaccccttaaccgttaacgtttcccgttacggtttcccttaaccgtttacccccg

SEQ ID NO: 57462 - DNA, 619 bp, Homo sapiens
  misc_feature: GYAE6OF01D3PZK.18.23.C01.1.454.CMB.1.raw
  modified_base (367)..(367): a, c, t, g, unknown or other
  misc_feature (367)..(367): n is a, c, g, or t
tcagtacgagtatgcacgaccggtgctcgatttagtacacgtgattagggattggggggcaggagtcagacccagtcaggacacagcatggacacgagggtccccgctcagctcctggggctcctgctgctctggctcccaggttccagatgcgacatccagatcgacccagtccccttcttccgtgtctgcgtctgtaggacgaccgagtcaccatcacttggtcgggacaatcgaggataattaaaacgtggttagttggtatcagacaagaaaccaaggaaaacgccctaagctagacagatgtagttcggtccgtaccgtagttaccaaggtacgtcgggacccctagtcggagtacttccgngtcgaggtggactcgtaggactagtactttcactctaccacatcgacgcacgtcctgcacgtccgtagaacgttactttacgaccttaaactttacttaattcgtcaacgcgaggtccgactaacttaaccttcccgcttacgtacgttcggggacggacggtaccgtaagggtacggaagtaagtaaccgaaacggtagtacggttcggccttacgaccctacgtacttaccgttcgttccgttactaccg

SEQ ID NO: 57463 - DNA, 569 bp, Homo sapiens
  misc_feature: GYAE6OF01E3GIJ.18.23.C01.1.454.CMB.1.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgcggnaatcagatattaaactggttagttgatnagcagaaaccaggaaaacnccctaagctgcagatgagttcggtcctcctagtttccaagacgtcgggccccagtcgagtacttccgcgtcaagtggatcgtagggactagtactttcactctaccactatcagcagcctgcagctagtaagtctttagaccttaacttactattacgtcagcacggccgactaaccgtaacttcccgtacttaccttacggtttcgggacgggtaacgggtaaccgtagggtacgacgtaacgtaacgaaaccgtagtcggtcggactcgacacctacttacgtcgttctcgtaccg

SEQ ID NO: 57464 - DNA, 744 bp, Homo sapiens
  misc_feature: GYAE6OF01DKN8Y.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgaacatccagatgacccacgtccccttcttccgtgtctgcgtctgtaggacgaccgagtcaccatccacgttggtcgggacgaactcgaaggtaattaaacgttaaaaaccgtggtttagtttaggtatcaagacaaagaaaaccgaaggaaaacgccctaaagcctagacagtattaggtagttcgggtcccgtcctacgtttaccgaaggtcggtccggggaccccaagtcgagacgttccgcgtcagtggtactcggtagggactaagtacttacactctaccacctatcagtcagtccctgacctacgtacctagtaaacgttacttttacgaacctttaactttcttaacgtttcgtacgacggtcgaacgggtacctaaccgtaaaccgttaaccgtttcccccggaacctttacccggttaacggtttcccgggggaaccgggtaacggggtaacccgtaaagggggtacgaaccgttaaacgtaaacccgtaaaagggtaacccggttggttaaccgggaccgtttaccggaaacccgtaacccgtttaagttcccctttcggttaccgttaccttaacccgg

SEQ ID NO: 57465 - DNA, 757 bp, Homo sapiens
  misc_feature: GYAE6OF01ECMZB.18.23.C01.1.454.CMB.1.raw
tcagtacgagtatgcacgaccggtgctcgatttagtacacgtgattagggattgggggcaggagtcagacccagtcaggacacagcatggacacggacgggtccccgctcagctccgtggggctcctgctgctctggcctcccgaggttccagagtcgaccgacaactccgaagtactacggaacccctcggttccccctttcgtttcccggtgtcctggtccgttcgttggaacgggacgaccggtataccgaacctattcgtacgttcgggacgggactaagtaccgaaggtaacttaaacgtttaaaccgttgggtttagtttaggtactcgaaggacaaacgaaaccgtaaaggaaaccctcccgtaagctacgactaggtaatcgtacgttaccggttccctacgttaccgttaacgaggtccggtaccgggaccctagtaccggtacgttcgtccgcgttagaggttgactgggtaggaactgttaacctttcaccctacgtaccaaactctacggacgtacctcggtcctacggaactacgttacgtagttaacttcgttacaactttacgtacttagtcggacagtccggacgacctaacgtaacttcccggtacccttggttaacccgtacggggttaccgggaacggtaaccgggtaagtacgggaaggtaacccaaggttaaacccgacggtaggtcccggtgacctacggaccctagtcgttaacgtctttaccgcccttaaccg

SEQ ID NO: 57466 - DNA, 522 bp, Homo sapiens
  misc_feature: GYAE6OF01EJJOM.18.23.C01.1.454.CMB.1.raw
  modified_base (474)..(474): a, c, t, g, unknown or other
  misc_feature (474)..(474): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcggcaatcaggatattaaaacctggttagtttgtatcagcaagaaaccaggaaaacgccctaagctgcagatgattcggtccgtccagtttccaagcgtcgggccccatcgagtacttccgcgtcagtggatcgtggactagtactttcactctcaccatcagcagtcctgcagcctagtaagtatttgactaacttatatgtcagcacgcactactacttcccgcttcacgttcggcgacggaccgaggtganatacgaaacgtagtggtcgacgtcgactacataccgtnttctntaccg

SEQ ID NO: 57467 - DNA, 800 bp, Homo sapiens
  misc_feature: GYAE6OF01D3PDK.18.23.C01.1.454.CMB.1.raw
  modified_base (307)..(307): a, c, t, g, unknown or other
  misc_feature (307)..(307): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgaccctacgtccccttcttccgtgtctgcgttctggtaggacgaccgagtccaccatctacgttggtcggacgtaatcgaaggtattaactttaaaaccgttggtttagtttggtatcgagacaagaaaaccgaaggaaaccncccgtaagctagacagtatgtagttcggtaccgtcctagtttaccgaaggtacgtccgggacccctagtcgaacgtacttccggacgtcgtaggtgacgttcggtagggtactagttaacgtttccgaccttccgtaccctaacctaatccgaaaccggcctaacggtcccgttacggaccgtaccggttacccgttaaggtaaacgtttacgttttaccggaacctttaaaccttttacgttaaagtttccgaaccgtaacggccgtaacggtcccgtaactaacccgtttaccgttttacccccggacgtttaacccgtttacccgggtttacccggggaaccggggttaaccggggtaacccggtaaaggggttccggaaaccggtaaccgttaaaacccgggtaaaacggttacggttccggtaaggtccccttaagggacccctaaccggttacgttccgttttacccggttacctttcccgtacccg

SEQ ID NO: 57468 - DNA, 660 bp, Homo sapiens
  misc_feature: GYAE6OF01A0KKT.18.23.C01.1.454.CMB.1.raw
  modified_base (283)..(283): a, c, t, g, unknown or other
  misc_feature (283)..(283): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagtccccttcttccgtgtctgcgtctgtaggagaccgagtcaccatcacttggtcggcaatcgaggtataattaaaacctggttagttggtatcagcaagaaaccaggaaaacnccctaagctgacagatgattcggtcctcctagtttccaagcgtcgggccccagtcgagtacttccggctcgaggtggatcgtacgggactagtactttccactacctacaacctataccaacgtcaacgtcctagaccgacgtacccgttaggaaagttacgtttcgaaccttaacgtttacttaagttacgtaccgaaggccgtacggcccgtaactaaccgttaaccgtttccccggactttaccggtaccggtttaccgggaccgggtaacgggtacccgtaaggggttacggaagtaaccgtaaaccggaaacgttaacgtacggtcggtcctacggaccctaacgtattaccgttagttcccttactacccg

SEQ ID NO: 57469 - DNA, 861 bp, Homo sapiens
  misc_feature: GYAE6OF01E0IUQ.18.23.C01.1.454.CMB.1.raw
tcagtacgagtatgcacgaccggtgctcgatttagtacacgtgattagggattgggggcaggagtcagacccagtcaggacacagcatggacacgaggtccccgctcagctcctggggctcctgctgctctggcctcccaggttccagatgcgacatccagactcgacccacgttccccttcttccgtgtctgcgtcgtgtaggacgaccgagtccaactactctacgttggtaccgggacgtaatccgaaggtaacttaaacgtttaaaaccgtttggttttaacggtttaggtataccgaacgtaccgaaaacggaaaaccgaaacgggaaaaacccgtccccgttaaaggccgttacggactaaggtagttaacgggacgtttccggggttaccccgtaccttaaacggttttacccgaagggttaccgggtacccggggtaccccaaggttaccgtaacgggttaccttcccggcggttacggtacggtacggtactcgggttaagggaaccttaggttacctttccgtaacccttcctaaccgaaccttacgtacgaaccgtccgtaccgtccgtaccgacggtaacgtacccgttaaaggttaaacgtttacgttttaacgaaccctttaacgttttaactacttcggtactaacggtaccgaacgggtcctaaccgttaaccgttaacccgttcccgtaccttacccggtttaccggtaccggggtaccggaacgggtaccggtaaacgggtacggtaaccggtaaccttaaaccggtaaccggtaaggttcggtaccggacgtaaccgttaccctacgttaccgttacgttacgtttcccgttacctaccccg

SEQ ID NO: 57470 - DNA, 874 bp, Homo sapiens
  misc_feature: GYAE6OF01EZAO3.18.23.C01.1.454.CMB.1.raw
  modified_base (297)..(297): a, c, t, g, unknown or other
  misc_feature (297)..(297): n is a, c, g, or t
tcagtacgagtatgcacgaccggtgctcgatttagtacacgtgattagggattgggggcaggagtcagacccagtcaggacacagcatggacacgaggtccccgctcagctcctggggctcctgctgctctggctccaggttccagatgcgacatccagatcgacccagtccccttcttccgtgtctgcgtctgtaggagaccgagtccactatctacgttggtccgggacaatcgaaggtatacttaaaccgtggttagttaggtatcagtaccgaacgaaaaccgacggaaaacnccctaaagcgtagaccgaagtatacgtagttcggtacccgttacctacgtttaccaaggtacggtaccggggacccctaagtccggtaacgtaccgttcccggtacgtccgtaggtacggtacttcggtacgggtaactacggttaacttccgtaaccgttcctaacccgtacctacgtacccgaacggtacctacgtacccgtcggtaccgtaacggtaccccgttaaggtaaacgtttacttttaccgggaaacctttaaacctttaaccgtttacgttttaccggtaaccgttaacgggaccgtaaccgggacccgtttaaacccgtaacgttttaaacccccggtttcccccgtacgttttaaccccggttaccccgggttttacgggggaaccccgggggtttaaaccgggaacccgggttaaaacgggggttaccggttaaacccgttaaaccgttaaaccgggtaaaaaccccgggttagggtttcccggaacggggtacccttaaccggacccgtaaacccccgtagtttacccccggtttacgtttaccccgttacccgttaaccccg

SEQ ID NO: 57471 - DNA, 658 bp, Homo sapiens
  misc_feature: GYAE6OF01AN4KZ.18.23.C01.1.454.CMB.1.raw
  modified_base (295)..(295): a, c, t, g, unknown or other
  misc_feature (295)..(295): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttggtcgggcaatcgaaggaacttaattaaaaccgttggtttaagttttggtatcaagtacaagaaaaccaggaaaacnccctaagctagcagatgtattcggtccgtcctagtttaccaaggtacgtccggggcccctagtacggaacgtacgtttcccggacgttcgaggttggacgttcggaggggaactaggttactttcgacttcctacacctatccgagcctacgtcctagacctacgtcctaaggtaacgttacgtttacgacttaactttacgttattcggtacacggtacgacggacgacctaacgttaaccgtttcccgacttccgtaccggttaccgggacggtacgggaaccgtaagggttcggaacgtacgtaaacgaacgtagttaggtacgcgtacgacctaccgtacttctacgttcttctacccg

SEQ ID NO: 57472 - DNA, 696 bp, Homo sapiens
  misc_feature: GYAE6OF01CEXE3.18.23.C01.1.454.CMB.1.raw
  modified_base (292)..(292): a, c, t, g, unknown or other
  misc_feature (292)..(292): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgaccctacgtccccttcttccgtgtctgcgtctggtaggacgaccgagtcaccatcacttggtcgggcaatcgaaggattaacttaaaaccgtggttagttggtatcagacaagaaaccaaggaaacnccctaagctcgacaaggtactagtacgttcggtcccgtacctacgtttacccgaaaggtcggtccggggaccccctagtccggaagtacctttcccggacgttacgaggttacggacttcgggtaggggtaacctaaggttacttttaccaccttcctaccaacctagtcacgcacgcctgcacgtcctagtaagttactttacgacttaactttacttagttagtctacgctacgggacctactaaccttaacccgtttcccgacctttaccgtaccggtttccggggaaccgggtaacgggtaacccgtaagggggttacgaacggtaacgtaaaccgaaacggtaacgttgggtcggaccttcggaccctaacctattacggttccttcgttccttacccg

SEQ ID NO: 57473 - DNA, 829 bp, Homo sapiens
  misc_feature: GYAE6OF01D3PGL.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggcctcccgaggttccagatgcgacatccagatcgaccctacgttccccttcttccgtgtctgcgtctgtaggacgaccgagtccaccatcctacgttggtcgggacaatcgaaggtaacttaaacttaaaaccgttggtttagttttggtatacgagacaagaaaaccgaaggaaaaccgtccctaagctagacgaagtagtaggtacgtttcgggtacccgtaccgtaggtttacccgaaaggtaccggtacccggggaccccctaaggtaccggaacgtaccgtttcccggacgttacgtagggtcggtacgttacgggtacgggaactaggttaaccttttccaaccgtttacctaccctaacccgtacgttaccgaacggtacctaccggtcccgtagacccgtaacggtacccgttaagggttaaacgtttacgtttttaccggaaccctttaaaccgttttacgttaacgtttcggtaaccgtaaccggtccggtaaccggtacccgtaacctaaacccgtttaacccgttttcccccggaccttttaccccgggttaaccggtttacccgggggaaccggggtaacgggtaaacccggtaaagggttacggaaacgtaaccgtaaccgtaaacggtacgtgggtacggccgtacgaccctacgttacgtctttcgttcctccgttaccg

SEQ ID NO: 57474 - DNA, 616 bp, Homo sapiens
  misc_feature: GYAE6OF01BAIAF.18.23.C01.1.454.CMB.1.raw
  modified_base (288)..(288): a, c, t, g, unknown or other
  misc_feature (288)..(288): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacgttggtcgggcaatcaggtattaattaaaaccgtggttagtttggtatcagacaagaaaccaaggaaaccnccctaagctgacagatgagttcggtcccgtctacggtttccaaggtcgtccggggaccccagtcgacgtacgttccggcgtcgagtggacgtcgtgggactaggtactttccacttcctacctactactacgagcctacgcctacgaccgtacgcctaggtaacttagtttcgaaccttactttatagttcgtacacgtacgacggactactacctaacctttcccgacgttccgtaccggttcggacgggacggtacggaagggtgactaacgtacgaaacggtacgtggtcgactacgacctaacgtacttcgtcttcctctaccg

SEQ ID NO: 57475 - DNA, 805 bp, Homo sapiens
  misc_feature: GYAE6OF01CQFSL.18.23.C01.1.454.CMB.1.raw
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
  modified_base (789)..(789): a, c, t, g, unknown or other
  misc_feature (789)..(789): n is a, c, g, or t
tcagtacgagtatgcacgaccggtgctcgatttagtacacgtgattagggagttggggggcaggagtcacgacccagtcaggacacagcatggacacggacggtccccgctcagctccgtggggcctcctgctgtctcgtcggtccctcccgtacggttccaggtatcggaccgactaactaccgaagtacgtacccgacccccttaccgtttccccccttttcgttccgttcgtcgtcggtccgttacgttaggacgggaacgaccggtacctacctaacctacttaccgtacggttcggggtaccgggtacgtaactacggtaaaggttaacttaaaccgtttaaacgggttggggttttagtttagtacacgaacgtaacgtaaacgaaaaccggaaacgaacccgtccgaagtcgacgatagtctaggttcgttccggtaccgtacgtaacgtcggaagtccggcccggtacctaggtacgtacgtcctacggcgtaggtacggtaggtacgttcggaaggtactacttcttacacttccaacgtacagtcncgtaccncgtcgcgacgtacgacttacgttacgttacttacgtaacttactttaagttacgtacgtagcgtacgtagaccctacgttaccctaccgttcccggtaccgttaccggtccgggtaacggtaccgggaacggtacgggtaacggtaacgtaaccggtaactaaaccggggtaaccttgggtacggtaccgttaccgaccggttacctacggttcttaccgttaccnccgtttcccgtacccg

SEQ ID NO: 57476 - DNA, 679 bp, Homo sapiens
  misc_feature: GYAE6OF01D7QPE.18.23.C01.1.454.CMB.1.raw
  modified_base (643)..(643): a, c, t, g, unknown or other
  misc_feature (643)..(643): n is a, c, g, or t
tcagtacgagtatgcacgaccggtgctcgatttagtacacgtgattagggattgggggcaggagtcagacccagtcaggacacagcatggacacgacgggtccccgctcagctccgtggggcctcctgctgctctggcctcccgaggttccagatgcgacatccagatcgaccctacgtccccttctccgtgtctgcgtctggtaggacgaccgagtcacctatctacgttcggtcggacgatcgagtaacttaacgttaaacggttggttagttggtatcgagacaacggaaaccgaaggaaacctcccgtaaagctagacaggtataggtacgtttccggtaccgtaccgtacgtttaccgaaggtccgggtaccgggacccctaggtaccggtagtaccgttccggcggtacgtacggtcgtacgttcgggtaggaacttaggttaccttccaacgttccaacctacgtacgtacgacgtactaccgtctccgatacggtacctaggttaacgttctttacgactttaacgttagtcgttcgacgacgtcggtacgacctacctacttacccggtccgtacgttaccgttacggtacgggaccggaacggacggtagtacgacgtaactaccgaaggtanggtccgatcccggactactctagtcttctctacccg

SEQ ID NO: 57477 - DNA, 850 bp, Homo sapiens
  misc_feature: GYAE6OF01CBDEX.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgaacatccagactcgaccctacgttccccttcttccgtgtctgcgtctagtaggagaccgagtccaccatctacgttgtcgggacgaatcgaggtaattaacgttaaaaaccgtggttttaagtttagggtaatacgaagacgtaaaagaaaacccgtaaggaaaaccgccctaaagcctagacagactaggtacgttacggttacccgtacgtacgtttaccgaagtacggtccgggacccctagtacggtaagtaccgttccggtacgtaccgtaaggtcggaacgtttccggtaaggggaaccgtaggttaacctttttaccgaacccgtttacccaacctaaaccccgttattaacccgtaacggaccggtaaccggtaccccggttcgaccggtaaccgttacccggttaagggttaaaccgttttaagtttttaaccggaaacctttaaaccgtttaaaccggtttatttaaccggacgtaacggaccggtaacgggacccaacgtttaaacccgttaacctttcccccgggacctttaccggttaaccggtttccgggggaaccgggtaacgggttaaaccgaaaggggttaccgacgtaaaccgttaaccgaaaacggttacgttcgggttaacggaccgtttacgaccctaaccgttacgttaccgttacgttaccgttactacccgg

SEQ ID NO: 57478 - DNA, 653 bp, Homo sapiens
  misc_feature: GYAE6OF01AT5PY.18.23.C01.1.454.CMB.1.raw
  modified_base (199)..(199): a, c, t, g, unknown or other
  misc_feature (199)..(199): n is a, c, g, or t
  modified_base (636)..(636): a, c, t, g, unknown or other
  misc_feature (636)..(636): n is a, c, g, or t
tcagtacgagtatgcacgaccggtgctcgatttagtacacgtgattagggattgggggcaggagtcagacccagtcaggacacagcatggacacgaggtcccgctcagctcctggggctcctgctgctctggctcccaggttccagatgcgacatccagatgaccctagtccccttcttccgtgtctgcgtctgtaggngaccgagtcaccatcacttggtcgggcaatcgaggattaattaaacctggttagtttggtatcagacaagaaaccaaggaaaacgccctaagctgacagatagagttcggtcctcctagtttccaagcgtcgggccccagtcgagtacttccggcgtacgaggtggactcggtagggaactaggtactttacgacttccgtaccaacctatacgacgtccacgtccgtacgccagtacccgtagtaaacgtttctttacgaaccttaacgtttactacgttcgtacgtaacggcgacgtaccgtactaaccgtttaaccgttcccggtaccttacgtacccggtttcggggaaccgggtacgggaaccgtagggtacggaacgtaacgtaaccgtaaaacggtcgtaggtcgtaccgtagtacccactacgttcctnttcccgtcgttaacccg

SEQ ID NO: 57479 - DNA, 614 bp, Homo sapiens
  misc_feature: GYAE6OF01EXX75.18.23.C01.1.454.CMB.1.raw
  modified_base (317)..(317): a, c, t, g, unknown or other
  misc_feature (317)..(317): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttgtatcagcagaaaccaggaaaacgccctaagctgcagatgattcggtccgtccagtttccaagngtcgggccccagtcgagtacttccgcgtcagtgatcgtgggacagtatttcactctcacgtatacagcagcctgcagtcctagtaagtatttgactaactttactattcgtacagcgacggcgacacgtaacctttccccggacttaccgtaccgttttacgggaccgggtaacgggtaacccgtaagggtacgggtaacgtaaacgttaccgaaaaacggtaacgttacgggtacgggtaccgtacgacccgtaacccgttaacgttcccgttacgtttcccgtttccgtaacccg

SEQ ID NO: 57480 - DNA, 806 bp, Homo sapiens
  misc_feature: GYAE6OF01BBTCM.18.23.C01.1.454.CMB.1.raw
  modified_base (192)..(192): a, c, t, g, unknown or other
  misc_feature (192)..(192): n is a, c, g, or t
tcagtacgagtatgcacgaccggtgctcgatttagtacacgtgattagggattgggggcaggagtcagacccagtcaggacacagcatggacacgaggtccccgctcagcctcctggggctcctgctgctctggctccaggttccagagtgcgacactccagactcgacccctacgttccccttcttccgtntctcgccgtctgtaggacgaccgacgtccaacgatactacgttggtaccggacgaactcgaaggtaacttaacgtttaaaaccgttgggtttagtttcggtatacgagactaaacgaaaccgaacggaaacccgccctaagcgtcgacgtagtagttgtacgttccggttaccgtaccttaggtttaccaaggtcggtccgggtacccaggtaccggactccgttacccgcgtacgtagtcggatcggtaggacctacggtactttaccactcaccaactgtaccagcctacgtccgtagccgtaacggttcttaaggtaaccgtttgtttactaaacccgttaactttttacgtacttaccggtaacctaggtcccgtaaccggtccgtttaacccgtaccgtttaaacccggttccccgtaacccggtttacccgtttaacccggggttacccgggtaacccgggaaacgggggttaacccgtaaagggtaacccgggtaaagttaaacccggtaaacccggtaaacggttccggttaacggtccgggttacccgaaggttccccaaacccgtttcgttaccctttcggtttacccgtaccgtttacccccg

SEQ ID NO: 57481 - DNA, 701 bp, Homo sapiens
  misc_feature: GYAE6OF01AG4AW.18.23.C01.1.454.CMB.1.raw
  modified_base (233)..(233): a, c, t, g, unknown or other
  misc_feature (233)..(233): n is a, c, g, or t
  modified_base (293)..(293): a, c, t, g, unknown or other
  misc_feature (293)..(293): n is a, c, g, or t
tcagtacgagtatgcacgaccggtgctcgatttagtacacgtgattagggattgggggcaggagtcagacccagtcaggacacagcatggacacgaggtccccgctcagctcctggggctcctgctgctctcggctcccgaggttccagatgcgacatccagatcgacccacgttccccttcttccgtgtctgcgtctgtaggagaccgagtcaccatcacgttggcggcaancgagtattaacttaaacgttggtttagtttgtatcgagacaacgaaaccgaaggaaaccncccgtaagctgacagtactgtacgttcggccgttacctacgtttaaccaaggtacggtccggggaccccagtcgacgtacgttcccggcgtacgaggtgacgtcgtagggactaggttacctttcgacttccgaccaactactaccgacgccgacgtcctacgacacgtactaggtaaacgtttctttacgaaccttaaccgtttactttaacgttcgacgacgtcgtaacggctaaccgtaaccgttacccttcccgtacgttaccgtaccggtttaccggggaccggtacgggtaaccggtaacgggtacggaaacgtaaccgtaaaccggtaaaggtacgttacggtacggtacccgtacgaaccggttaccttacttcccgtttacgttccgttaaccttaccg

SEQ ID NO: 57482 - DNA, 809 bp, Homo sapiens
  misc_feature: GYAE6OF01BKCMV.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcgaggatattaaaacctggttagttggtatcagcaagaaacctaggaaaacgaccctaagctagacagtatgtagttcggtccgtacctagtttaccaaggtacgtcggggaccccctagtacggacgtactttcccggcgttaccgaaggttggacttcgtaggggaactaggtacttttaccaaccgttcctaccgtaacccctagttacccaacggtaccgtaaccgtcccgttaacggacccgtaaccgggtcccgtttaaacggtaaaacggtttaacgttttttaaccggtaaacctttaaacccgttttaacgtttaacgtttacgttaccgtaacggtacgtaaccgggacccgtaacgttaacccgtaacccgtttttacccccgacctttaccgttacccggtttcccggggtaacgggtaaccggggtaaccgtaaaggggttacgggtaaacgtaaaccggttaaaccgtaaaacccggttaacggttaccggttagggtacccgttacggaaacccttaacccggttacgtttacccgttacggttttcccgttacgtttaaccccg

SEQ ID NO: 57483 - DNA, 722 bp, Homo sapiens
  misc_feature: GYAE6OF01DHMOC.18.23.C01.1.454.CMB.1.raw
  modified_base (154)..(154): a, c, t, g, unknown or other
  misc_feature (154)..(154): n is a, c, g, or t
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcganatccagatcgacccacgttccccttcttccgtgtctgcgtctgtaggacgaccgagtccacatcctacttggcggacaagtcgaggtataagttaaaccgtggtttacgttggtatcaagtaccaacgaaaaccgaaggaaaaccgtcccctaaagcctaggaccaggtagtacgtacgtttcggtacccgttaccgtaacgtttacccgaaggtaccggtccggggaccccctaggtacgagttaccgtccggtcgtacacggtagtactacggtaggacctaggttactttccgatcctaccactactcgaagtccacgtcccgtagaccgtacgaccgtagtagtttaactttacgacctttaacttcgttacgttcgaactaggccgacggtaccaaccgtacctactttaccccgacgtttacccgtacggtttcggaccgggttacggacggtaaacgggtggtaccgtaagtaaaccgtaaaccggtaacgttcggtaacgggtccttaacgacccgttacccgttacgttacccgtttcggttaccttccggtaaccccg

SEQ ID NO: 57484 - DNA, 624 bp, Homo sapiens
  misc_feature: GYAE6OF01EJWF4.18.23.C01.1.454.CMB.1.raw
  modified_base (279)..(279): a, c, t, g, unknown or other
  misc_feature (279)..(279): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagtccccttcttccgtgtctgcgtctggtaggagaccgagtcaccatcacgttgtcggcaatcagatattaaaacgtggttagttgtatcagacagaaaccaggaaaacnccctaagctgacagtatagtagttcggtaccgtccgtagtttccgaaagtagtccggggaccccagtcgagtacgttccgcgtacgtagtgatcgtagggactagtacttttacaacttcaccgaaccatccgaagcacgcctcgacagcctagaagttacttttagacttaactttattattcgtacgagctacgggactactaacctaaccgtttccccgacttcccgttaacggtttccgggacggggtaacggtaaccggaaggtacggtaagaacgtaacggaaaacgtacgtggtcgtacgtacgacctaccgtaattccgttacgttcctacttaccg

SEQ ID NO: 57485 - DNA, 569 bp, Homo sapiens
  misc_feature: GYAE6OF01A9N56.18.23.C01.1.454.CMB.1.raw
  modified_base (367)..(367): a, c, t, g, unknown or other
  misc_feature (367)..(367): n is a, c, g, or t
  modified_base (454)..(454): a, c, t, g, unknown or other
  misc_feature (454)..(454): n is a, c, g, or t
  modified_base (557)..(557): a, c, t, g, unknown or other
  misc_feature (557)..(557): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggacttaattaaaacctggttagttgtatcatcaagaaaccaggaaaacgccctaaagctagcagatgattggccgtcctagtttccaaggctcgggccccatccgagtattccgcgttgacgtagatcgtagganacggtacttcaactcctacactaagtcaacgtcacgcctgacacgacctagaacttagtttcgaacctaactttattattcgttacncgtacaggcgacacgtaacttcccgtactccgtacgtttggaccggacggtaaccgaaggtcggagtactacgaaagtacgtgaggctagacctacgacttcncgttcttctacc

SEQ ID NO: 57486 - DNA, 684 bp, Homo sapiens
  misc_feature: GYAE6OF01BD9ZM.18.23.C01.1.454.CMB.1.raw
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (466)..(466): a, c, t, g, unknown or other
  misc_feature (466)..(466): n is a, c, g, or t
  modified_base (483)..(483): a, c, t, g, unknown or other
  misc_feature (483)..(483): n is a, c, g, or t
  modified_base (551)..(551): a, c, t, g, unknown or other
  misc_feature (551)..(551): n is a, c, g, or t
  modified_base (647)..(647): a, c, t, g, unknown or other
  misc_feature (647)..(647): n is a, c, g, or t
  modified_base (666)..(666): a, c, t, g, unknown or other
  misc_feature (666)..(666): n is a, c, g, or t
tcagtacgagtatgcacgaccggtgctcgatttagtacacgtgattagggattgggggcaggagtcagacccagtcaggacacagcatggacacggagggtccccgctcagctccgtggggctcctgctgctctggcctcccaggttccagatgcgacatccagatcgacccncgttccccttcttccgtntctgcgtctgtaggacgaccgagtccaccagtcctacgttggtcgggacaagtcaaggtaataacgtttaaaaccgttggggtttattttggtatacaagaccaaacgaaaaccgaaggaaaacccgcccgtaaagctagacagtacgtaggtacggtttcggtaccgtacccgttaggtttacccgaaggtcgtccggggaccccaagttccggaagtccgttcccgacgttggacggtaggacttacgggtagggaactaggttactttaccnctttacgaccaaccgtntccgagtcgacgtacccgtgcctacggtaccgtaagtaacgttagtttacgaacttaaccttacgttnttacgctaggtaccgcgtaccgactaacgttccttaccctcgttaccgtccgttacgggacgtacggacggtaaggcggaagtacaacggtaacgngttaggcacgtcacctacnttgtacttcgtactcccg

SEQ ID NO: 57487 - DNA, 665 bp, Homo sapiens
  misc_feature: GYAE6OF01A9SRM.18.23.C01.1.454.CMB.1.raw
tcagtacgagtatgcacgaccggtgctcgatttagtacacgtgattagggattgggggcaggagtcagacccagtcaggacacagcatggacacgaggtcccgctcagctcctggggctcctgctgctctggctcccaggttccagatgcgacatccagatgacccagtcccttcttccgtgtctgcgtctgtacggagaccgagtccaccatcacttggtcggcgaatcgaggtataacttaaaaccgttggtttagttggtatcgagccaagaaaccgaagtaaaacgtccctaagctgcgagtatgattcgtccgtctacgttacaagacgtcgggacccagtccgatacgttccgcgtcagtcgatcgcggaactagtacttctacgtcctacaccgtatacacgtcacgtcctgacgtacgtcgttaagaacttagtttaacgaccgttaactttacttacgttcgtacgtaggtacgcgtaccgtactaaccgttaccgttcccgtaccgttacttaccgggtttccggaaccgggtacgggtaaccggtaagggttacgggtaacgtaaaccgtaacggtaaaccgttacggtacgggtaccgtaccgtacgtaaccctaccgttacctaacgtttccgttaccgttcgttaaccccg

SEQ ID NO: 57488 - DNA, 722 bp, Homo sapiens
  misc_feature: GYAE6OF01C64JT.18.23.C01.1.454.CMB.1.raw
  modified_base (270)..(270): a, c, t, g, unknown or other
  misc_feature (270)..(270): n is a, c, g, or t
  modified_base (444)..(444): a, c, t, g, unknown or other
  misc_feature (444)..(444): n is a, c, g, or t
  modified_base (461)..(461): a, c, t, g, unknown or other
  misc_feature (461)..(461): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
  modified_base (675)..(675): a, c, t, g, unknown or other
  misc_feature (675)..(675): n is a, c, g, or t
  modified_base (715)..(715): a, c, t, g, unknown or other
  misc_feature (715)..(715): n is a, c, g, or t
tcagtacgagtatgcacgaccggtgctcgatttagtacacgtgattagggagttgggggcaggagtcacgacccagtcaggacacagcatggacacggacgggtcccgctcacgctccgtggggcctcctgctcgctcgtggcctcccgaggttccagtactcgcaacactaccagactccgaccctacgttcccttcgttccgtgtacgtcgcgtcgtacggacggaaccgcgacgtaccaactactcgacgtttcggaccggactaancgaaggtaacttaaacgttaaaccggttggttagttagtactagaacgaccgaaaacgaaacgtaaaggaacccgtaccgtaagccgtagacagtagtacgtcgttcggtaccctacgttaaccgtacgaaacgtcggtccgggaccctaagtaggcgtaccgtccgacggttnacggttggacttacggnggtaactacgtactttcacttaccnccaacgtnacgacgtcaccgtcgacgacgtacgacgttaaggttaactttacgttaaccgtaactttaacttagtaccttcggaacacgttacggacgtacgtaccgtaaccttaccggttaccctacggttactaaccgggttcgggaaccggaggtaaccgtgggtagaacgtaacaacggtaaccngggtacgacgctaccgaatcccggtaatcggtacttcgtntaccccg

SEQ ID NO: 57489 - DNA, 847 bp, Homo sapiens
  misc_feature: GYAE6OF01AR80T.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacactccagatcgaccctacgttcccccttcttccgtcgtctgtcgtctggtaggacgaccgagtccacctatcacgttggtcgggacgaatacgaggtaattaacgtttaaaaccgttggtttagtttggtatacgagacaagaaaccgaaggaaaaccgccctaagactcgacgtagacgtagtacgttcggttacccgttcctaacggtttacccgtaaacggtacggtacccgggggtaccccctaacggttaccggtacggttaccgtttacccgggtccgttaccggtaacgggtttcgggtaacgttcccgggtaacggggtaaccttacggtttaaccttttaccgtacccgttaccccgttaccctaaacccgtaacgttacccgaacgggacccgtaacccggtccccgttaaccgggacccgtaccggtacccgttaacggttaaacggtttacgttttaaccgtaaccctttaaccgttttaaaccgtttagtttaccgttaaccgacggtaccgtacggtaccgtactaacccgtttaacccgttccccgtaccgttaccgttaccgttaccggggacggaccggtaacggtaacgggtgaacgtacgaaaccgtaaacggtagtacgggtacgtccgtacgaccgtacctagttaccgtttccgttcttaccgttcccg

SEQ ID NO: 57490 - DNA, 634 bp, Homo sapiens
  misc_feature: GYAE6OF01B1XJO.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctggtaggagaccgagtcaccatcacttggtcggcgaatcaggtatattaaaacctggttagtttgtatcgagcaagaaaccaggaaaacgccctaagctgcagatgtacgttcggtcccgtcctagtttaccaaggtacgtcggggtacccccagtcgacgtacgttcccgcgttacgaggtggaactcgtcggacagtacttcgactctacaccactcacgacacgtccgtcgaccacgctacgtaagtagtttacgtaccaactttacgttacgttcgtacgtacgcgacggacgacgtaactaccgttacccgtccgtaccgttacgttaccgggtacggaccgggtaaccgaacgggtaggtacgaacgttaccgaaacgttaggtcggtacggaccgtacgtaccgacctacgtaccttcgttaccgttctacccg

SEQ ID NO: 57491 - DNA, 633 bp, Homo sapiens
  misc_feature: GYAE6OF01AJNW0.18.23.C01.1.454.CMB.1.raw
tcagtacgagtatgcacgaccggtgctcgatttagtacacgtgattagggagttgggggcaggagtcagacccagtcaggacacagcatggacacgaggtccccgctcagctcctgggctcctgctgctctggctcccaggttccagatgcgacatccagatcgacccagtccccttcttccgtgtctgcgtctgtaggagaccgagtcaccatcacttggtcggcgaatcgaggtataagttaaaacctggttagttggtatcagcagaaaccaggaaacgccctaagctgcagatgagttcggccgtcctacgtttaccgaagtagtggggcctccgagtacgagtacttccggcgtcaggtgatcgtgggactagtactttcactctacaccatcagcacgcctgacacgtcccgtaggtaagtacgttttacgaccttaactttacttacgttgtacgtacgtacgacggtccgtactaaccgttaaccgtttcccgtaccttacgttaccggtttacgggaccgggtaacgggaccggtaagggtacggtaacgtacgtaaccggaaacgtacggtggttaccggttacgaccgtaaccgtcttacccgttgttccgttacgtacccg

SEQ ID NO: 57492 - DNA, 789 bp, Homo sapiens
  misc_feature: GYAE6OF01D3CZX.18.23.C01.1.454.CMB.1.raw
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
tcagtacgagtatgcacgaccggtgctcgatttagtacacgtgattagggattggggggcaggagtcagacccagtcaggacacagcatggacacgacgggtccccgctcagctcctggggctcctgctgctctcggcctccctaggttccagatcgcgacactccagactcgaccctacttcccctttcttccgtgtctgtcgttcgtggtacgggacgtaccgacgtcacctactcctacgttcggtaccgggacgtaacgtcgaaggtaactttaaacgttaaaaccgtttgggttttagtttggtatacgacggactaaacgaaaaccgaaggaaaaccnccctaagctgacagtntgtacgttcggtcctacgtagttaccaaggccgtccgggccctagtcggtacgtaccgttccggcgtacgaggttcgtacgttcgggaggaactcgttaactttccgaaccttccaccgtaacctattacccgacgtaccgtacgtccctacggacctacgttaccgtaaggttaacgtttacgtttaccgaacctttaaacgttctttaacggttcgtacggtaccgtaccggtacggttccctaacgttaacccgtttacctttacccggacctttaccgggttccggtttacccgggggacggggtaccggttaacccgggtaagggtacgaacgtaaacttaacccgggaaacggttaaggtcggtaccggtcgtacccgtacgtaaccttacggtacctttaacccgttcctcgtttaaccccg

SEQ ID NO: 57493 - DNA, 536 bp, Homo sapiens
  misc_feature: GYAE6OF01AQ4XY.18.23.C01.1.454.CMB.1.raw
  modified_base (279)..(279): a, c, t, g, unknown or other
  misc_feature (279)..(279): n is a, c, g, or t
  modified_base (408)..(408): a, c, t, g, unknown or other
  misc_feature (408)..(408): n is a, c, g, or t
tcagtacgagtatgcacgaccggtgctcgatttagtacacgtgattagggattgggggcaggagtcagacccagtcaggacacagcatggacacgaggtccccgctcagctcctggggctcctgctgctctggctcccaggttccagatgacgacatccagactggacccagtccccttctccgtgtctgcgtctgtaggagaccgagtcaccatcacttgtcggcaatcaggatattaaaacctggttagtttggtatcagacagaaaccacgaaacnccctaagctgcagatgattcggccgtctagtttccgaagctcggggccccagtccgagacttcccgcgtcgagtggaactctggacagatttcgactctcaaccatcagcagcctgcagcctagaagtntttagactaactactattgtcagcagcacgactaacttcccgacttcacgtttcggacggacggacgtaggtgacgtagtaaccaacgtactggtcggactgacccacacttacgtctctcgtaaccg

SEQ ID NO: 57494 - DNA, 716 bp, Homo sapiens
  misc_feature: GYAE6OF01BKWI2.18.23.C01.1.454.CMB.1.raw
  modified_base (316)..(316): a, c, t, g, unknown or other
  misc_feature (316)..(316): n is a, c, g, or t
  modified_base (474)..(474): a, c, t, g, unknown or other
  misc_feature (474)..(474): n is a, c, g, or t
tcagtacgagtatgcacgaccggtgctcgatttagtacacgtgattaggagttggggcaggagtcagacccagtcaggacacagcatggacacgacggtcccgctcagctccgtgggctcctgctgctctcggctcccaggttccagatgcgacatccagatcgacccacgtcccttcttccgtgtctgtcgtctgtaggacgaccgacgtcacctatcctacgttcggtcggacgtaagtaccgaaggtacttaactttaaaaccgttggtttaagtttaggtactacgagtacgaacgaaaacgaaggaaaacnccctaaggcctagcgagtatggtagttccggtccgttacctagtttacccgaaagtcgttaccggggacccctagtacgacgttacgttcccgacggttactaaggtggtaactcggtacggtaactaggtaactttccgacctactaccaaaccgtnacgacgacgtacgtcgtacgacacgtacgtagtaacgttacgttttacggaacttacctttacgtagtttacgtacgacgacgttaggacccgaactaacccttacgtttacccgcgtttaccgtacggttaccgggaccggttagggaacccgttagggaacgacggtagttaaacccgaacgtaacgttcggtacggtacttcggacttaccgacttacgtaccgttcttcccggttacc

SEQ ID NO: 57495 - DNA, 736 bp, Homo sapiens
  misc_feature: GYAE6OF01AE9S6.18.23.C01.1.454.CMB.1.raw
  modified_base (283)..(283): a, c, t, g, unknown or other
  misc_feature (283)..(283): n is a, c, g, or t
  modified_base (354)..(354): a, c, t, g, unknown or other
  misc_feature (354)..(354): n is a, c, g, or t
  modified_base (697)..(697): a, c, t, g, unknown or other
  misc_feature (697)..(697): n is a, c, g, or t
tcagtacgagtatgcacgaccggtgctcgatttagtacacgtgattagggattgggggcaggagtcagacccagtcaggacacagcatggacacgaggtcccgctcagctcctgggctcctgctgctctggctcccagttccagatgcgacatccagactcgacccagttccccttcttccgtgtctgcgtctgtaggagacgagtcaccatctacttggcggcaatcaggtataacttaaacgtggttagtttggtatcgagacaacgaaaccgaggaaacnccctaagctgacgagatgtacgttcggtcccgtctacgtttacaacggacgtcgggcccctagtacgtacncgttacccgcgtacgagtaggtactcgtagggactacgttactttacacgtcctacctacctagtaccacggtaccacgtccgtacgacgtacgtaccgttaagtaacggtttaacgtttacccgtaaaccgttaaacgttttacctttaacggtttacccgacgttaacccgggctaaccggggtaccctaaccgtaaccgtttaacccctttcccgggtaccctttaacccggttaccggtttaaccgggggaacccgggtaacgggtaaacccggttaagggtacggtaaaccggtaaacgtaacccgtaaacgggttacggtcggtaccgtaccggtanaccccgtcgtaacgttcgttcttaacgttccggttaccc

SEQ ID NO: 57496 - DNA, 580 bp, Homo sapiens
  misc_feature: GYAE6OF01BL9VX.18.23.C01.1.454.CMB.1.raw
  modified_base (177)..(177): a, c, t, g, unknown or other
  misc_feature (177)..(177): n is a, c, g, or t
  modified_base (320)..(320): a, c, t, g, unknown or other
  misc_feature (320)..(320): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (445)..(445): a, c, t, g, unknown or other
  misc_feature (445)..(445): n is a, c, g, or t
tcagtacgagtatgcacgaccggtgctcgatttagtacacgtgattagggattgggggcaggagtcagacccagtcaggacacagcatggacacgaggtccccgctcagctcctggggctcctgctgctctggctcccaggttccagatgcgacatccagatgacccagtccccttnttccgtgtctgcgtctgtaggagaccgagtcaccatcacttgtcgggcgaatcaggatattaaaacctggttagtttggtatcagacaagaaaccaggaaaagcccctaaagctgcagatgattggtcctcctagtttcaagngtacggggcccctatcgagtacttccgcgtcaggtgatcgtggangtattcactctcacancagcagcctgcagccctaggaattgtttagactaactttactaattcgtcagtcgacgccgtanaactaacgtttcccacttcgtaccgtttacgggccggaacggtaccgaacgggttaggggactaacgtaccgtaaaacgtacggttggtcggtacttgacccgtaacctacttacgttgttcccgttctaacccg

SEQ ID NO: 57497 - DNA, 768 bp, Homo sapiens
  misc_feature: GYAE6OF01A8DYQ.18.23.C01.1.454.CMB.1.raw
  modified_base (717)..(717): a, c, t, g, unknown or other
  misc_feature (717)..(717): n is a, c, g, or t
tcagtacgagtatgcacgaccggtgctcgatttagtacacgtgattagggagttgggggcaggagtcagacccagtcaggacacagcatggacacggacgggtcccgctcagctccgtgggctcctgctgctctggcctccgaggttccagatgacgacatccagatcgaccctacgttcccttctccgtgtctggtcgtcgtaggtacggacgaccggactaccacctataccgtacgttcgggtacgggacgtaactacggtaaggtaaactttaaacgtttaaaaccggtttgggtttaacgtttaggtaactaccgaacggtacgaaacggaaaaccggtaagggaaaaacccctcccgttaagtccgtacgaccgtaaggtacttaagggtacggttttcccggtaccgttacccggttacggtttaacccggaagggtccgggtacccggggtacctacggtaccggtaaggttcccgtaccggtccggtaaggtaggtacggtacgtcggaacgggtactaggttaccttacaacttccgaccgtaaccgtatacgacgtcgtacgtccgtacgtacgagtaccgttaagtagttacgttacaaccgttacgttatagttaccagtacacggtaccgtagtacctaaccggttacctaccgtcgttaacgtcggggttacgaacgggtacgtacggaggtagacgttaanaaccgtagttgcgtacgcgactacctacggtacttggtacttcctgtaccc

SEQ ID NO: 57498 - DNA, 714 bp, Homo sapiens
  misc_feature: GYAE6OF01EW1Z3.18.23.C01.1.454.CMB.1.raw
  modified_base (686)..(686): a, c, t, g, unknown or other
  misc_feature (686)..(686): n is a, c, g, or t
  modified_base (698)..(698): a, c, t, g, unknown or other
  misc_feature (698)..(698): n is a, c, g, or t
tcagtacgagtatgcacgaccggtgctcgatttagtacacgtgattagggattgggggcaggagtcagacccagtcaggacacagcatggacacgaggtccccgctcagctccgtgggctcctgcctgctctggctcccgaggttccagatgcgacatccagatcgacccgagttccccttctccggtgtctgcgtctggtaggacgaccgtagtaccaccgtagtcctacgttggtacgggcgtaatcgaggtacttaaagttaaaaccgttggttaagtttggtactcagacgaacgaaaaccgaaggtaaaccacccgtaagcgtcgacgtaacgtagtacgtacgttccggttacccgtaccgtacgtttaaccgacgtaacgtccggggaccctagtacgtacgtaccgttcgaccgtacgaggtcgacgtcgacggtatacgtacttccacgtcaccgtacgacttacgacgtccgagtcccgacgcgtaccgtacgtaacgttaagttaacgttttaccgaaccgtttaacgtttaccgttaacgtttccgtactaccggtacgaacggtcctacccgtaaccgttaccgttccccgtaccgttacgttaccgggtccggaacgggtacgtaccggtagggttacgacgtacgtacgtaaacggtcgtaggtcggtacncgtactacggtntacgtctctcgtaccg

SEQ ID NO: 57499 - DNA, 763 bp, Homo sapiens
  misc_feature: GYAE6OF01BEZRY.18.23.C01.1.454.CMB.1.raw
tcagtacgagtatgcacgaccggtgctcgatttagtacacgtgattagggattgggggcaggagtcagacccagtcaggacacagcatggacacgaggtccccgctcagctcctggggctcctgctgctctggctcccaggttccagatgcgacatccagatcgaccctacgtcccccttcttcccgtgtctgcgtctgtaggagaccgagtcaccatccacttggtccggcgaatcgaggtaattaacgttaaaaccgtggtttagtttggtaatcaggcaacgaaaccaaggaaaacgtaccctaagacctgacagataggtacgtttcggtccgttaccgtacgtttaccgaaggtacggtccggggtcccctaagtaccgtaacgtacgtttacccggcgttaccgtaaggttcggtacgttcggtacgggtaactacggttactttaccaccttcctacctaacctactacgaaccgtacacccggtcctacggtaccgacggtaccgttaacggtaaacggtttacgttttaccggtaacctttaaacccgttttaacttacgtttacggtactaaccgggtaccgacggtccctaaccgtaaccgttaaccctttccccgaactttcccggttaaccggtttcccggggaccgggtaccgggtaaccgtaaggggtacggtaaacgtacgtaaaccggaaaccggtagttacggtagtcccgtagaccctactacttaccttcgtccttcgtaccc

SEQ ID NO: 57500 - DNA, 700 bp, Homo sapiens
  misc_feature: GYAE6OF01BEXRD.18.23.C01.1.454.CMB.1.raw
  modified_base (551)..(551): a, c, t, g, unknown or other
  misc_feature (551)..(551): n is a, c, g, or t
  modified_base (619)..(619): a, c, t, g, unknown or other
  misc_feature (619)..(619): n is a, c, g, or t
  modified_base (647)..(647): a, c, t, g, unknown or other
  misc_feature (647)..(647): n is a, c, g, or t
tcagtacgagtatgcacgaccggtgctcgatttagtacacgtgattagggattgggggcaggagtcagacccagtcaggacacagcatggacacgacgggtccccgctcagctcctggggctcctgctgctctggcctccaggttccagatgcacactcagatcgaccctagtccccttcttccgtgtcctgcgttctggtaggacgacgagtaccaccatctacgttggcgggacgtaatcgaaggtaattaacgtttaaaacgttgggtttaagtttaggtaacttaccggaagtaaccgaaggaaaaaccgtaaagggaaaacctacccgttaagcaggacaagtacgtagtacgttcgtaccgtacttacgttacgaaggtaccgcggggacccctagaccgtagtaccttcgacgtagacggtgacgtcgtggaacgtagtactttacaacgtcctactaaaccagccgtaacgcacgtaccgacgtacaacggtcctagggaaactttaacggtttacaacttaacgttacctagttcgaggacncggtaacgaccgtaataaccgtaaccgttcgaccttacgtaacgtcgggtaaggacggaaccggtaanacgggagtaaacgtaaccgaaacggtancggttggaacccgtagttacccaacggtactttatagttcccctgttaacccg

SEQ ID NO: 57501 - DNA, 862 bp, Homo sapiens
  misc_feature: GYAE6OF01BBEUK.18.23.C01.1.454.CMB.1.raw
tcagtacgagtatgcacgaccggtgctcgatttagtacacgtgattagggattgggggcaggagtcagacccagtcaggacacagcatggacacggacgggtcccgctcacgctcctgggctcctgctgctctggcctaccgaggttccagtatcgcgacactaccagatccgtaccctacgttccccttcgttccgtgtcgtcggtcgttcgtggtaaggacgtaccgtagtaccaaccgtactccgttaaccgttgggtaccgggtaccgtaatccggaacggttaacttaaacgtttaaaaccggtttggggttttacgtttacggtactccgtaaggaccgtaaacgaaaaccggaacggtaaaaccgtccccgtaaaggccgttacggacgtaacgtacgtggttaacgttccggttacccgttaccgttaacggttaccgaaaggtccggtaccgggacccctagtaccggtactaccgttccggtacgtacgtacggtcggtacgttcggtacgggtaactacgtttaaacttcgtaccttaccaaccttaacccgtagtcccggttaagcccgtacgtccgtaacgaccgttacggtacccgttaaagttaccgtttagtttaaccggaaccgtttaacctttagttacgttaaccgtacgtaacgtcggtaacgtaccgtaacttaacccgttcccgtttacccgtacgttaccggtttaccggtacggaccgggggaactacgggtacggtaggtaaccgtaacggtaaacccggtaacggttacgtccgggtacgaccgtttacggaaccccctaggttcgttaacctcgtttaacccgtccgttaacccg

SEQ ID NO: 57502 - DNA, 768 bp, Homo sapiens
  misc_feature: GYAE6OF01EB8MD.18.23.C01.1.454.CMB.1.raw
  modified_base (239)..(239): a, c, t, g, unknown or other
  misc_feature (239)..(239): n is a, c, g, or t
  modified_base (343)..(343): a, c, t, g, unknown or other
  misc_feature (343)..(343): n is a, c, g, or t
  modified_base (754)..(754): a, c, t, g, unknown or other
  misc_feature (754)..(754): n is a, c, g, or t
tcagtacgagtatgcacgaccggtgctcgatttagtacacgtgattagggagttgggggcaggagtcagacccagtcaggacacagcatggacacgacggtccccgctcagctccgtgggcctccgtgctgctcgtggcctcccgaggttccagatcgacgacagtccagatccgaccctacgttcccccttcgttccgtgtctgtccgttctggtacggacgaccgagtccaaccgtntccgtacgttggtaccgggacaacgtcgaaggtaattaaacgtttaaaaccgttggtttagtttggactacgaacgtacgaaacgaaaaccgaaggtaaaaccncccgtaaagtcgtacgacgacgtagtacggtacgtttccggtaccgtaccgttaacgtttacccgaaggtccggtaccccgggaccctagtacgaacgttaccgttcccggcgttacgtacggtcggtacgtcggtaaggacctaagtactttccgactacccgtacgactaagtccgagtccgaacgtccgtagaccgtacgtaccgttagtaaacgtttcgtttacaaacgtttacttagttacttcgacatacggtaacgccgtaactaaccgttacccttcccgtagttaacccgtccggttacgggaccggtaaccgtaacggtaggtacgtaaactaacgttaaacccgaacggttagtcgggtaccgaccgtacgaaccctaacttcccgtagttacccgtttntccccgttaacccg

SEQ ID NO: 57503 - DNA, 760 bp, Homo sapiens
  misc_feature: GYAE6OF01CNPV0.18.23.C01.1.454.CMB.1.raw
  modified_base (107)..(107): a, c, t, g, unknown or other
  misc_feature (107)..(107): n is a, c, g, or t
  modified_base (295)..(295): a, c, t, g, unknown or other
  misc_feature (295)..(295): n is a, c, g, or t
  modified_base (462)..(462): a, c, t, g, unknown or other
  misc_feature (462)..(462): n is a, c, g, or t
tcagtacgagtatgcacgaccggtgctcgatttagtacacgtgattaagggagttgggggcaggagtcagacccagtcaggacacagcatggacacgagggtccccnctcagctccgtggggctcctgctgctcgtggcctccgaggttccagatgcgacactccaagactcgaacccctcgttccccttcttccgtgtcctcgcgtcctaggtacggagaccgatccacatctacgtggtacggactaatcgaaaggtacttaaacgtttaaaaccggtggtttagttacgtanacgaagacgaaacgaaaaccgtaaaggaaaaccgtcccgtaagaccgtgaccgaagtacgtagtaacgtttcggtacccgtaccgtaaggtttaccgaaaggtcgtaccgggaccctaagtccgaatcgtcccgagttaccgaaggtacgacttcggacgggtaacncgttaacttcgtaacttcacccgtaataccgacgaacgtccaacgtccgagtcctaacgtaccgttaaggttaattacgtttaacccgactttaacgttaccttaattcggacgttaacggaccgttaaggcctaaaccgtacctttaaccggttcccgaaacgtcccggttacggttccgggaacggtaaccggtacggaaggtacgggaacgtaacctaacggtaaacccgtaggccgttacgggaccctacgtacgaccgttatacccgtttctaaacccggtttcttaaccccg

SEQ ID NO: 57504 - DNA, 740 bp, Homo sapiens
  misc_feature: GYAE6OF01EWJYR.18.23.C01.1.454.CMB.1.raw
  modified_base (89)..(89): a, c, t, g, unknown or other
  misc_feature (89)..(89): n is a, c, g, or t
  modified_base (142)..(142): a, c, t, g, unknown or other
  misc_feature (142)..(142): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (584)..(584): a, c, t, g, unknown or other
  misc_feature (584)..(584): n is a, c, g, or t
  modified_base (721)..(721): a, c, t, g, unknown or other
  misc_feature (721)..(721): n is a, c, g, or t
tcagtacgagtatgcacgaccggtgctcgatttagtacacgtgattaggggattgggggggcaggagtcagacccagtcaggacacagnagtgacacggacgggtccccgctcacgcctccgtcggggctcctgctcgctcnggctcccaggttccagatgcgacactccagactcgaccctacgttccccttcttccgtcgtctcgcgtctgtaggacgaccgacgtcaccactcgtacgtttggtcggggacgtaacgtaccgctaaacggttaaaccgttaaacggtttaaaaccggttttgggtttaacggtttacggttaacgtacgaacggtaaaccgaaacggaaaacccggaaacccggaccgtaacgtacccctaacggaacagggaacntaggnttacggttccaggttacccgttaccggttacgttaccggcccgtacggtaccggtaccggtaccggtaccgtacgtacgtacgtacggtacgtcggacggtacgtcgagttacgtacggtacctcgtaccttactacctaccgtaccaccgacgtaccgaccgtaccgacgtccgtacgnccttacgttaccgacgtacttacgttacgtacttactacgtacgtacgtacgtacgtacgtaccgtaccgtaccgtaccgtaccgtccgttaccggttaccgtacgggtccggacggtaacggtacggaacggacgntaacggtacgtacggtacg

SEQ ID NO: 57505 - DNA, 655 bp, Homo sapiens
  misc_feature: GYAE6OF01EAK2N.18.23.C01.1.454.CMB.1.raw
  modified_base (305)..(305): a, c, t, g, unknown or other
  misc_feature (305)..(305): n is a, c, g, or t
tcagtacgagtatgcacgaccggtgctcgatttagtacacgtgattagggagttgggggcaggagtcagacccagtcaggacacagcatggacacgaggtcccgctcagctcctggggctcctgctgctctggcctcccgaggttccagatgcgacatccagatgacccagttccccttcttccgtgtctgcgtctgtaggacgaccgacgtccaccatccgtacgttggtcgggacgtaatcgaaggtaattaacttaaaaccgttggtttacgttggtatcgagacaagaaaccaggaaaccnccctaagcctagcaagtagtagagtttcggtccgtactaggttaccaggtacgtcgggaccctagtcgatacgtccgcgtacgaggtgactcgtaggactagttacttcactcgtacaactatcgagccacgtctgacgtacgtactagtagttactttacgaacttacgttacttaggttcgtacgacggtacgtacggtaccgtacgtaaccgttaccgtttacccgaccgtttacgtaacggtttcccgggaacggtacgggtaaccctaagggtacgtaacggaacgttacggaaacgtgtacggtcgcgtagtacccgtaacgtaacttctacgttctctacccg

SEQ ID NO: 57506 - DNA, 901 bp, Homo sapiens
  misc_feature: GYAE6OF01D3CFW.18.23.C01.1.454.CMB.1.raw
tcagtacgagtatgcacgaccggtgctcgatttagtacacgtgattagggagttgggggcaggagtcacgacccagtcaggacacagcagtggacacggacggtcccgctcagctccgtggggctcctgctgtctcgtcggtcctacccgtaggttccaggtactcggacgactacttccgaagtactccggaacccctaccgtttcccctttccgttccggtgttctcggtccgttcgttagggtaacgggaccgtaaccggtactaccaacctacgttcgtacgttcggggaccggaactaaagtcgtaaggttaactttaacggtttaaacggttggttttaacgttagactacgtacgaaccgaaacggtaaaacgaacggaaacccgtccctaaaggtctaacgacgaagtttacggtacgttacggtttacccgggtccgttaaccgtaaacggtttaccgaaggtttacccgggggacccggtaccccgtacgttacggggttaaccgttaccgttcccgggtagtaacgggtacgggttaggtaaccggttcggaacgggtaatttaacggtttaccgtttacccaccgtttaacccgaccgtaacccgttaacgtaccgttaaccgggccgttacggtcccggtacgaacgtccggtaaacggtacgttaacgttaacggtttacctaaccgtttaacttacgttactacgtacggacgttacgacggtaaccgtacgtaccgttacccgttaccgtacccgtttacgggtacccggttacgggaacgggtacgggtaaccggtaggaacggtacgtaaacggtaccgtaaacgtcggtagtccggacgtcgtaacgtaccgtaactcgggtttccttacggtcttaacccg

SEQ ID NO: 57507 - DNA, 806 bp, Homo sapiens
  misc_feature: GYAE6OF01D9E47.18.23.C01.1.454.CMB.1.raw
  modified_base (591)..(591): a, c, t, g, unknown or other
  misc_feature (591)..(591): n is a, c, g, or t
  modified_base (648)..(648): a, c, t, g, unknown or other
  misc_feature (648)..(648): n is a, c, g, or t
  modified_base (766)..(766): a, c, t, g, unknown or other
  misc_feature (766)..(766): n is a, c, g, or t
  modified_base (782)..(782): a, c, t, g, unknown or other
  misc_feature (782)..(782): n is a, c, g, or t
tcagtacgagtatgcacgaccggtgctcgatttagtacacgtgattaggggattgggggcaggagtcagacccagtcaggacacagcatggacacggagggtccccgctcagctcctggggctcctgctgcttctggcctcccaggttccagatgacgactatccgagactcgaccctacgttcccctttcttccggtgtcctgtccgttcgtggtaggacgaccgtactacaccgtatccgtaacgttcgggtaccgggactaaacgtccgaaaggtaactttaaaacgttttaaaaacccggttggggtttttaaggttttcggtaaacttacgaaacgtaccgaaaacggtaaaaaccggaaacgggtaaaaaccgtaacccttaaggtacgtcgacgtaaagtacgttaggtaacgtttaccgggttacccgtaccgttacggttaaccgtaaggtaccgtccgggaaccctagtacgtaacgtacgttaccggacgtaccggtaggtacggaacggtttctaagggacgtaacgtactttacctaacgtcctaccgtaactacttacgacgaccgtaacgtccggntaacgacgtaccttaaggtaacttagtttcgaaacccttattttaaacgcgttttanaccgtacgagtaccggacttacctaaaccgttaccgttcccgtcgttaagttacccggttggggaacaccgggaataacgggtaggacaacggtaaccttaaacggagttcggatacncggtaactaacccgtntaactttccgttctccgtaacccg

SEQ ID NO: 57508 - DNA, 725 bp, Homo sapiens
  misc_feature: GYAE6OF01BJ7J3.18.23.C01.1.454.CMB.1.raw
tcagtacgagtatgcacgaccggtgctcgatttagtacacgtgattagggattgggggcaggagtcagacccagtcaggacacagcatggacacgacggtccccgctcagctccgtggggctcctgctgctctggcctcccgaggttccagatcgcgacatccagatacgacccacgttcccttctccgtgtctcgcgtcgtgtaggacgaccggagtcactatctagtcggtcgggcaagtcgaggtaacttaacgttaaacgttggtttacgtttgtatacgaaggtacaaacggaaaaccgaacggaaaaccgtccctaaagctaggactagtacgtaggttacgttcggtccttacgtacgttaccaagggcgtaccgggaccctagtcgtaacgtcgtaccgcgtacgtaggtcgtagtcggtacggtaactcggtttacttacaccgtttacccactaccgaactcgaccgtacgaccctacggcgtccgacgttcccggtaaggtaacttcgttttaaaccgactttaaccgtttaagttcgttaccgatacggccgttaacggcctaacctaccgtttaaccgttcccgtaacgttcggtaccgtcgggaaccgggtaggacgttacgggacgacgtaaaccgtacggaaaacggtccgttaacgggccgttactcggaccccttacaacgttcgtttacgttaccttcggtccccg

SEQ ID NO: 57509 - DNA, 895 bp, Homo sapiens
  misc_feature: GYAE6OF01AMCE9.18.23.C01.1.454.CMB.1.raw
  modified_base (188)..(188): a, c, t, g, unknown or other
  misc_feature (188)..(188): n is a, c, g, or t
tcagtacgagtatgcacgaccggtgctcgatttagtacacgtgattagggattgggggcaggagtcagaccagtcaggacacagcatggacacgaggtcccgctcagctcctggggctcctgctgctcgtggcctcccgaggttccagatgcgacatcccagatcgaccctacgtccccttcttccgngtcgtgcgtacgtggtacggacgaccgtagtaccacctatcctacgttcggtaccgggacgtaactcgaaggtaacttaaactttaaaaccggttgggtttaaggtttacggttacgtacgagaaccgtaaacggaaaccgtaaacgggtaaaaccctaccccgtaaagtccgtacgacgtaaggtacgttaggtaacgttccggttacccgtacctacggtttaccgaacggtaccgtccgggacccctaggttaccggacgtaccgttaccggtaccgtacgtacgggtacgtacgttaccgggtagtaaccgtacggttaacttttaccgaccgttaccctaaccgtaaccgtaactaccggtacgtaccggtacccggtacccgtacgtaccgtacgggttaaccttaacgggtaacgtttaggttttaaccaacgtttaacccttttaagtaacgttccgtaacgtaaggccgtaacgggcccttaaacgtaccgttaaccggttttcccgaccgttaccggttcccggttaccgggaacgggtaacccgggtaacggtacggggtaaagtaacccgggtaacttaaaccgggtaaaccggtaccggtttaccgggtaacccggtacgttaaccccgggtacccttaaacccgggttactttacccgggtttacctttaaccctttccccgggttaaccccc

SEQ ID NO: 57510 - DNA, 777 bp, Homo sapiens
  misc_feature: GYAE6OF01BZ7SQ.18.23.C01.1.454.CMB.1.raw
  modified_base (224)..(224): a, c, t, g, unknown or other
  misc_feature (224)..(224): n is a, c, g, or t
  modified_base (704)..(704): a, c, t, g, unknown or other
  misc_feature (704)..(704): n is a, c, g, or t
  modified_base (739)..(739): a, c, t, g, unknown or other
  misc_feature (739)..(739): n is a, c, g, or t
  modified_base (755)..(755): a, c, t, g, unknown or other
  misc_feature (755)..(755): n is a, c, g, or t
tcagtacgagtatgcacgaccggtgctcgatttagtacacgtgattagggagttgggggcaggagtcagacccagtcaggacacagcatggacacggacgggtcccgctcagcctccgtgggcctcctgctgctcgtggcctccgaggttccagatcgacgacactccgagactcgaccctacgtccccttgttccgtgtcgtgtcgtcgtggtaggacgacgngtacacagtctacgtcggtcggacatcgagtacttaacgttaaacgtgtttacggttgtactcgacgacgaaacggtaaaaccgaaacggtaaaaccgtcccgtaaagccgttcggaccgaaaggtacgtacggtttaacggtttccggtaaccggttaccgtaaacggtttaacgaaacgggttaccggttaccccggggactaacggttaccggtaaggtacccgtttacccggacgttacgggacggtttacggtaacgttaccggaacgggtaacgttacgttttaaccgtttaaccgaccgtttcgtaaaccacctaaacggttccgacggtaacgccggtaccgtacgaccgacgtacgtaacgtaaagttacgttacgaaccttaaacctttgtactcgtacgtacgacggttacgaaccgtacgtactaacgttccgtacgttacgtcgggtacggtacggaacggtaacgnggtacgaacgtacgaacgaaacgttgacggtaccngtaaccgaccttacgnttaccgttctcttcgttacccg

SEQ ID NO: 57511 - DNA, 669 bp, Homo sapiens
  misc_feature: GYAE6OF01BFR2J.18.23.C01.1.454.CMB.1.raw
  modified_base (200)..(200): a, c, t, g, unknown or other
  misc_feature (200)..(200): n is a, c, g, or t
  modified_base (313)..(313): a, c, t, g, unknown or other
  misc_feature (313)..(313): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (428)..(428): a, c, t, g, unknown or other
  misc_feature (428)..(428): n is a, c, g, or t
tcagtacgagtatgcacgaccggtgctcgatttagtacacgtgattagggattgggggcaggagtcagacccagtcaggacacagcatggacacgacggtccccgctcagcctcctggggcctcctgctgctctggcctcccgaggttccagatgcgacatccagatcgacccacgttccccttcttccgtgtctgcgtntggtaggacgaccgagtccaccatctacgttggtccgggactaatcgagtaattaattaaaccgttggtttagttgtatcagacaacgaaacaaggaaaaccgccctagctanacgagtatgtacgttcggtcctccgtacgtttaccgaaggtcggtcccggacctagtcgtagtaccttccggngtcgaggngtacgtcggaggactagtctctactccactaacnctacagtcacgccgtcgcgtacgtcgtaaggttaacgttactttacgaacctttaacttacgtttctacgtacgtacggacgtacgccgtacgtacctttaaccttcccgaccgttaccggtaccggtttccggggacgggtaacggtaccgtaagggtacgggtaactaacgtaaccgtaaccggtgtacggtcggactacgtaccggtaccttccgttaagtttccttattcccgtccg

SEQ ID NO: 57512 - DNA, 824 bp, Homo sapiens
  misc_feature: GYAE6OF01C3TU4.18.23.C01.1.454.CMB.1.raw
tcagtacgagtatgcacgaccggtgctcgatttagtacacgtgattagggattgggggcaggagtcagacccagtcaggacacagcatggacacggagggtccccgctcagctcctggggctcctgctgctctggcctccaggtccagatgcgacactccagatcgaccctacgtcccccttcttccgtgttctcggtccgtctggtacggacgaccgtacgtaccaaccactcctacgttcggtaccggggacgtaaacgttcgtaagggtaacttaaaacgtttaaaaaccggttggggtttttaacggtttaggtaacgttccgaaggtacccgtaaaacggaaaaacccggaaaacgggtaaaaaaccgtacccccgtaaaggtccgtacggtaccgtaagtaacgtggttaaaccgtttcgggttaccccggttaccctaacggttttaacccgaaaggtaccgggttaccggggaccccctaaggtaccggtacgtaaaccgtttccccggacgtaccgtacggttcggaattacccgggtaggggaaccttaggttaacctttcgtaacccttctaaccgtaaccctagtaccgacgtaccgtaccgtaccctcgactaaccggtcgtaacggtaagttactttacgaaacctactttaacgtagtttcgaccgtaggtacgacggacctaccgtaacttaccgttacccgcgttaccttacgggttcggaccgggtaacggtacggaaggttacgaagtacgttaaccgaaacgtcgtacggtgaccttagacctcgtaactcgtctcgtctaccc

SEQ ID NO: 57513 - DNA, 792 bp, Homo sapiens
  misc_feature: GYAE6OF01BM388.18.23.C01.1.454.CMB.1.raw
  modified_base (483)..(483): a, c, t, g, unknown or other
  misc_feature (483)..(483): n is a, c, g, or t
tcagtacgagtatgcacgaccggtgctcgatttagtacacgtgattagggagttgggggcaggagtcagacccagtcaggacacagcatggacacgagggtccccgctcagctccgtgggctcctgctgctctggcctcccgtaggttccagactgacgacactccagatcgaccctacgtccctttctcgtgtctgcgtcgtagtaggacgaccgagtccaacctatcgtaccgttggtcgggactaatcgaaggtaattaacgttaaaacgttggttttaacgttaggtactacgagaaccgtaaacgaaaaccgaacggtaaaaccgtacccgtaaggtccgtacgaacgtagaacgttcggtagtttccggtaccgtaccgttagttaccgaggtcggtaccgggcccctagtacgagttaccgttccgacgtacgtacggtagtacgttacgggtacggacttacggttactttaccncccgtaccaccgtaacgtactaaccggacgtaacctccggtccgtacgaccgtacggtaaccgttaaggtaaccgtttagtttacccgtaaagtttaaccgttttacgttaacttacggtcaaccgggtacgaccgttaccgtaactaaccgtttaaccccggttcgtacccgttaccgtttaaccgggttaccggggaaccggttacgggaccggtaaggtacgggtaacctaaacgggtaacaaacgggtttgaccgtccggtacgtactaccgtaacttcgtaggtttaccttcgttccttacccg

SEQ ID NO: 57514 - DNA, 589 bp, Homo sapiens
  misc_feature: GYAE6OF01BGE6W.18.23.C01.1.454.CMB.1.raw
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaaccgtggttagtttggtatcagcagaaaccaggaaaacgcccctaagactgacagagtgattggtccgtccacgttttccaagacttcggggccccagtccgagacttcccggcgttcagtggatcgtgggacagatttcactctcactatcagcagccngcganccgtagaacgtatttcgcctaacgttactagttgtacaggcacggactacaccgtaactttaccccgacttaccgtacctttcgggaccgggacgggtaacccgaagggtacggagtacctaacgtaaaccgggacttgggtcggactcgtacgtaacctacgtacttcgtacgttctaaccg

SEQ ID NO: 57515 - DNA, 685 bp, Homo sapiens
  misc_feature: GYAE6OF01A45OQ.18.23.C01.1.454.CMB.1.raw
  modified_base (216)..(216): a, c, t, g, unknown or other
  misc_feature (216)..(216): n is a, c, g, or t
  modified_base (473)..(473): a, c, t, g, unknown or other
  misc_feature (473)..(473): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
  modified_base (672)..(672): a, c, t, g, unknown or other
  misc_feature (672)..(672): n is a, c, g, or t
tcagtacgagtatgcacgaccggtgctcgatttagtacacgtgattagggattgggggcaggagtcagacccagtcaggacacagcatggacacggaggtccccgctcagctccgtgggctcctgctgctctggcctcccgaggttccagatgcgacatccagtatcgaccctacgtccccttcgttccgtgtcctgcgtcgtgtaggacgaccgngtcacatcacgttggtcggacaatcgaggtataaactttaaaaccgttggtttagttttgtactacgagacgtaaacgaaaaccgaaggaaaacctccccgtaaggcctaggactaagtactacggtacgttccggtacccgtaccgttaacgtttaccgaaggtaccggtcccgggaacccctagtacgacgttacgttccgacgtcgtagtacgtacgtcggagggactagtactttaccacgtcctacacctanacacgctacgtcctgactcgacctagtaacttagttcactaacgtttntacgtnacgtagcgacggtacacgtaacgtaccttccccgatttaccgtccggttcggaacgggtaaccgacggtaaggtacggaactaacgttaacccggaaacttacggttcggacggtctaccgaccgttactattccgttccggttntaacccggtcccg

SEQ ID NO: 57516 - DNA, 862 bp, Homo sapiens
  misc_feature: GYAE6OF01ETHBB.18.23.C01.1.454.CMB.1.raw
tcagtacgagtatgcacgaccggtgctcgatttagtacacgtgattaggggattggggggcaggagtcagacccagtcaggacacagcatggacacgacgggtccccgctcagctccgtggggctcctgctgctctggcctcccaggttccagatgcgacatccagatcgacccacgttccccttcgttccgtgtctcgccgttcgtggtacggacgaccgacgtccacactcgtacgttgggtccgggacgaacgtcgaaggtaacttaaacgtttaaaaccgttgggttttaaggtttacggttacgtcgacgacgaaaacggaaaaaccgaaacgggaaaaccgtacccgtaaacgtcgtacgacgtaacgtacgttaggtaacggttccgggttaccggtttcaaaggtttttacccctaaaggggtaacccttagggggggtcccccccaaggttaccgtaacgggactttcccggacggttccgaaggttcgggaaggttaccctagggggtaacctacggaacgttttccgaaccttacctactaacccaagttccaaggcctaaggccccttaggccctagggacccctggttaaacggcttttacgacctaaaccttttacgtactttaggtccctaagggtcccgtaacgggtcccgtaaccgttaaccccgaaactttttccccggaccttttaccgaaccgttttacgggacccgggtaacgggggtacccgtaaaggggtcgggtaaccggtaaacgtacccgtaaacggtaaccggtaggttacggggaccgttaacgggacctaaccccgtaacgtaccctttacggttacccgtttaccgtacccg

SEQ ID NO: 57517 - DNA, 815 bp, Homo sapiens
  misc_feature: GYAE6OF01AD3PU.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctccgtggggcctcctgctgctctggcctcccgtaggttccagatgcgacactccagatcgacctacgttccccttcgtccgtgtctgctcgtgacggacgaccgcgtacaccatctacgttggtaccggacaagtcgaaggtaacttaaacgtttaaaaccggttggttttaagtttggtaatacgagacaacggaaaaccgaacggaaaaccgtcccgaagccgtcgacgtaagtacgtgtacgttcgtcccgttacgtaaggtttaccgaaggtcgtccgggaccctgtacgtacgtacgttccgacgtacgtaggtcgtatacggacggaacttacgtacttccgtaccttcctaaccactacaacgtcggaccgtccgtccgtacggactaccggtccgttaaggttaacgttcggtttaactaaccgttaaccgttttacgtagttaccgagacccggtaacggacgttacccgtaccgtttaaccgttacccgtttccccgacgttttaacccggtaaccgggtttaccgggggaaccgggtaaacccggggttacgaacggggttaggaaaccccgtttaaaccggtaaaccgggttaaaaccgtacgggttcggttaccgggtaacccttacccgggtaaccccgtacgtttacccgtttacggttacccggtttcccttaaccggtttacccccg

SEQ ID NO: 57518 - DNA, 813 bp, Homo sapiens
  misc_feature: GYAE6OF01E1GHJ.18.23.C01.1.454.CMB.1.raw
  modified_base (187)..(187): a, c, t, g, unknown or other
  misc_feature (187)..(187): n is a, c, g, or t
tcagtacgagtatgcacgaccggtgctcgatttagtacacgtgattagggattgggggcaggagtcagacccagtcaggacacagcatggacacgaggtccccgctcagctcctggggctcctgctgctctggctcccaggttccagatgcgacatccagatacgacccagtaccccttcttccgtntactgcgtctgtaggacgaccgagtaccaaccagtccaacgttggtcgggcaacttcaaggtataacgtttaaaaacctgggttagtttggtatcagtacaagaaaaccaggaaaacgtccctaaagctagtacaagtatagacgttcgtccgtaccagtttaccgaaagtacgtcggggtacccccaaggtccgtaacgtacgttacccgacgttaccaaggttacggtacttaccggtaggggaacctaaggttaccttttaccgaacctttaccctaaccgtaaacccgtacgtaccgaacggacccgttacgcccgttacgaccgtaaccgacccttaaggtaaacgttaacgtttttaccgaaccgttaaaccttaactttaacgttagtacccgtaagaccgttaacggaccgtaactaaccgttaaacccgtttacccggtaccccttaaccgttaacccgggttttccggggtaacccgggtaaaccggggtaacccggtaacgggtaaccggttaaagtaaccgttaaaccggaaaacccggtaaacgttcgggtacggttaccgtaccgaaccctaaaccgtaccgttaacgaccgtttaccgttacttaacccgg

SEQ ID NO: 57519 - DNA, 785 bp, Homo sapiens
  misc_feature: GYAE6OF01AHZY2.18.23.C01.1.454.CMB.1.raw
  modified_base (530)..(530): a, c, t, g, unknown or other
  misc_feature (530)..(530): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatcgcgactatccagatcgaccctacgtccccttcttccgtgtctgcgtctaggtaggacgaccgagttaccacctaactcctacgtttcggaccggggacaaacgttcgaaagggtacttaaacgtttaaaaccgttgggttttaagtttcggataccgagtaccaaacggaaaaacccgaaggaaaaaccgtcccctaaagtccgtacggacgtaagtacgtcggtaacgtttccgggtacccttaccgttaaacggttttacccgaaagggtaccggttaccccggggacccctagtaccgggtacgtaccggtttcccggacgttaccggaggtcggtaactcgtcgggaacctagttctttcacgtcctaccaacngtacacaccgactccgtaggcctacgtcgtaagttaacgtttacgttacgtaacccttaagtttacttacggtcgttaccaagggtcccaagggtaccctaactaaccgtttacccgttcccgtcttaccccgttaacgggttccgggaaccgggttaacggaacggtaagggttcgaaaggttacccctaaaacggtacgtaacgtcggttacgcttaacggccttaccgattaccgtcttcgtcgtaccccgg

SEQ ID NO: 57520 - DNA, 834 bp, Homo sapiens
  misc_feature: GYAE6OF01D5W7G.18.23.C01.1.454.CMB.1.raw
tcagtacgagtatgcacgaccggtgctcgatttagtacacgtgattagggattgggggcaggagtcagacccagtcaggacacagcatggacacgacgggtcccgctcagctccgtggggctcctgctgctctggcctcccgaggttccagatgcgacactccagatcgaccctacgttcccctttcttccgtgtctgcgtctgtaggacgaccgagtccacctatctacgttggtacgggacgtaatcgaggtaattaaactttaaaccgttgggtttagttttaggtatacagacgaaacgaaaaccgaaggaaaccgtaccgtaagcctacggacgaagtagtacggtacgtttccggttacccgttaccgtaacggtttacccgaaggtccggtacccggggtacccctaagtccggtaacgttccgttcccggacgtacgtaggtcgtacgttcgggtacgggaacttacggttactttacctaccgttccgtaaacccaaccttacgtaccggtaccgtacgtaccgtacccgtacggacccgtaacgttacccggttaagttaaacggtttaacttttaccgtaaacccgtttaacttttaaccgtttagttaacgtcgtaacggtacggtacggtaccgtaacccgtaaccgtttaaccgttcccccgtacgtttaaccccgttaccgggtttacccgggaacggggtaacccgggtaaccggtaaagggttccggaaacgtaacgtaaacccgttaacggtacggttaacggccggtaccgtacgacccgttaactacgttaccgtttccgttccttcgttaccg

SEQ ID NO: 57521 - DNA, 689 bp, Homo sapiens
  misc_feature: GYAE6OF01CN0MS.18.23.C01.1.454.CMB.1.raw
  modified_base (413)..(413): a, c, t, g, unknown or other
  misc_feature (413)..(413): n is a, c, g, or t
  modified_base (597)..(597): a, c, t, g, unknown or other
  misc_feature (597)..(597): n is a, c, g, or t
tcagtacgagtatgcacgaccggtgctcgatttagtacacgtgatttagggagttgggggcaggagtcagacccagtcaggacacagcatggacacgaggtcccgctcagctcctgggctcctgctgctcgtggcctcccaggttccagtagttcgacgtacacttccgagtactcgaaccctcggttcccctttcgttccgtcgtctcggcgttcgtggtaggacgaccggacgtccaccactcgacgttggtcggacaatcgaggtacttaacttaaacgtggtttacgttggtactcgaagtacaacgaaaaccgtaaggaaacgtcccttaaggcctagctacggattcggacgtttcggacctcgtagttaccaggcgtccgggacccagtacgagtcgtcgcgtcgnggtacgatcgaggactagttacttcgactctacgactagtacacgtacacgtcgtacgcgtacgtcagttagttacttacgtactaacgttacttatacgacgtagccgaggtaccgacttaacgttaacccgttccgacttaaccggtccggttacggaccgggtaacggtaccgtggggtanaaaccggtacgtaaacctaaccgggtagttacggccggtacgttaacgaccccgtacgtacgtttaccctggtttacccttaccgtaccccg

SEQ ID NO: 57522 - DNA, 1018 bp, Homo sapiens
  misc_feature: GYAE6OF01BKOKF.18.23.C01.1.454.CMB.1.raw
  modified_base (130)..(130): a, c, t, g, unknown or other
  misc_feature (130)..(130): n is a, c, g, or t
tcagtacgagtatgcacgaccggtgctcgatttagtacacgtgattagggattgggggcaggagtcagacccagtcaggacacagcatggacacggacggtccccgctcagctcctggggctcctgctgntctggcctccgaggttccagtatgcgacacgtccaagctcgaccctacgttccccttctttccggtgttctcgcgttcgtaggtacggaacgaccgagtaccaccgtattccgtaacgtttcggtccgggacgtaaacgttaccgaagggttaacttaaaacgttttaaaaacccggtttagggggttttaacggtttttacgggttaacttaccgtaacggtaaccgaaaacggtaaaaaacccgaaaccggggtaaaaaacccgtacccccgttaaaagccgttacggaacccgtaaggtaacgttacggttaaccggttttccgggtttaccccggtttacccgttaaccgggttttaacccggtaaacgggtacgggttcccccgggggacccctaacggttacccgggtaagttaccccgttcccgggtaccgttacggtacgggttacggtacgttacgggtacgggtactaacggtttacctttaccgtacccttacctacccgtaaccctaaccgttcggaaccgacccgtaacggtcccgtaccgtacggccggttaaccgttaagttaacgtttacgttttacccgtaaactttaaaccgttttcgtttaacgtttcggtaccggtagtacccggtaggaccccgttaacttaacccgttaacccgtttccccgtaaccgttaccccgggtttacgggtttccccggggaacggttaaacccgggggaaacggggttaccgggtaaggggtaaacccttaaccgggttaaaaccggaaacccgggtttacggtacggggttaccggttacccggtacccggtacccgttaaaccggttcttaccccgtttgttttaacccccggttctttaccccccg

SEQ ID NO: 57523 - DNA, 695 bp, Homo sapiens
  misc_feature: GYAE6OF01CM5HC.18.23.C01.1.454.CMB.1.raw
  modified_base (430)..(430): a, c, t, g, unknown or other
  misc_feature (430)..(430): n is a, c, g, or t
  modified_base (484)..(484): a, c, t, g, unknown or other
  misc_feature (484)..(484): n is a, c, g, or t
  modified_base (510)..(510): a, c, t, g, unknown or other
  misc_feature (510)..(510): n is a, c, g, or t
tcagtacgagtatgcacgaccggtgctcgatttagtacacgtgattagggattgggggcaggagtcagacccagtcaggacacagcatggacacggacgggtccccgctcagcctccgtggggcctcctgctgctcgtcggcctacccgaggttccagatgacgaccatccgagactaccgaccctacgtttcccccttccgttccgtgttaccgtgtcggttcgtaggtacgggacgaccggtagttacccaactctacctacggttgggaccggacgtaatcgaaggtattaaacgttaaaccggttggtttaagttgtatcgagtacaaagaaaccgaaggaaaccgaccctagctacgataggactgtacgtcgtaccgtactacgtactaaggaccgtccggaccctagtacgtacgtcgtccgntcgtggtacgtagtcggaggactagtcttcgacctcactaccgatacgatccgnccgtagcgtacgtcgtagtaacgttnttacaccttaattactagtacgcgacgcgacgtacgacttaccgtaaccgttccgtcttaccggtaaccggttcgggaccgggtaacggtaacggacggttaacggtagtaaccgtaaacgaaccggtccgtgggtcctaccggtacaccgtacgttacctagttttccctatttcccgtacccg

SEQ ID NO: 57524 - DNA, 496 bp, Homo sapiens
  misc_feature: GYAE6OF02HDFX2.18.23.C01.1.454.CMB.1.raw
tcagtacgagtatgcacgaccggtgctcgatttagtacacgtgattagggattggggcaggagtcagacccagtcaggacacagcatggacacgagggtcccgctcagctcctgggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagatttgcaacttactattgtcagcaggcgcacaatttcccgctcactttcgcggaggaccaaggtgagatcaaacgaactgtggctgcaccatctgtcttctac

SEQ ID NO: 57525 - DNA, 503 bp, Homo sapiens
  misc_feature: GYAE6OF02I4864.18.23.C01.1.454.CMB.1.raw
  modified_base (500)..(500): a, c, t, g, unknown or other
  misc_feature (500)..(500): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcctaactttactatttgtcagcaggcgcacaatttcccgctcactttcggcggaggaccaaggtgagatacgaaacgactgtggctgcacatctgtctntac

SEQ ID NO: 57526 - DNA, 509 bp, Homo sapiens
  misc_feature: GYAE6OF02IRXE0.18.23.C01.1.454.CMB.1.raw
  modified_base (506)..(506): a, c, t, g, unknown or other
  misc_feature (506)..(506): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagcccctaagctgcagatgattggtccgtccagtttccaagatggggccccatcgagattccgcgtcagtggatctgggacagatttcactctcaccatcagcagccctgcagcctgaagatttgactaactttactatttgtcagcaggcgcacaatttcccgctcactttcggcggaggaccaaggtggagagtacgaaacgaactgtggctgcaccatctgttcttntac

SEQ ID NO: 57527 - DNA, 519 bp, Homo sapiens
  misc_feature: GYAE6OF02GAVXO.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaaggaaaagcccctaagctgcagatgattggtccgtccagtttccaagatcggggccccagtcgagacttccgcgtcagtggatcgtgggacagatttcactctcaccatcagcagcctgcagcctgaagtatttgactaacttacttattgtcagcaggcgacactactttcccgctctacgtttcggcggacggaccgagggtgagactacgaaacgaactggtggctgcaccatctcgtcttctac

SEQ ID NO: 57528 - DNA, 567 bp, Homo sapiens
  misc_feature: GYAE6OF02JA88E.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaaagctgcagatgattggtccgtccagtttccaagagtcggggccccagtcgagattccgcgtcagtggatcgtggacagatttcactctcaccatcagcagcctgcagcctgaagtatttgactaacttactattcgtcagcaggcgacacgtaactttcccgcttctacgtttccgggacggacgggtaccaagggtcggagaacgtaccgaaaacggtaaccgttgggtacggaccttcggacctaacccgtacgttccgtacggttccctttactaccg

SEQ ID NO: 57529 - DNA, 507 bp, Homo sapiens
  misc_feature: GYAE6OF02F34EB.18.23.C01.1.454.CMB.1.raw
  modified_base (503)..(503): a, c, t, g, unknown or other
  misc_feature (503)..(503): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagcccctaagctgcagatgattggtccgtccagttccaagatggggccccatcgagattccgcgtcagtggatctggacagatttcactctcaccatcagcagcctgcagcctgaagtatttgactaacttacttattgtcagcaggcgcacaattcccgcttcactttcggcgaggaccaaggtggagatacgaaacgtaactggtggctgcaccatctgttcttntacc

SEQ ID NO: 57530 - DNA, 510 bp, Homo sapiens
  misc_feature: GYAE6OF02IIA1D.18.23.C01.1.454.CMB.1.raw
  modified_base (318)..(318): a, c, t, g, unknown or other
  misc_feature (318)..(318): n is a, c, g, or t
  modified_base (508)..(508): a, c, t, g, unknown or other
  misc_feature (508)..(508): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagntggggccccatcgagattccgcgtcagtggatctgggacagatttcactctcaccatcagcagcctgcagcctgaaagtatttgactaacttactattgtcagcaggcgcactaactttcccgctctacgtttcggacggagggaccaagggtggagagtacgaaacgactgtgctgcaccatctgtctnac

SEQ ID NO: 57531 - DNA, 509 bp, Homo sapiens
  misc_feature: GYAE6OF02IDIIE.18.23.C01.1.454.CMB.1.raw
  modified_base (428)..(428): a, c, t, g, unknown or other
  misc_feature (428)..(428): n is a, c, g, or t
  modified_base (506)..(506): a, c, t, g, unknown or other
  misc_feature (506)..(506): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaaagctgcagatgattggtccgtcagtttccaagatggggccccatcgagattccgcgtcagtggatctgggacagatttcactctcaccatcagcagcctgcagcctgaagtatttgactaacttactatttgtcagcaggcncacaatttcccgctcacgtttcgcggaggaccaaggtgagatacgaaacgaactggtggactgcaccgatctgtcttntac

SEQ ID NO: 57532 - DNA, 495 bp, Homo sapiens
  misc_feature: GYAE6OF02I7XRG.18.23.C01.1.454.CMB.1.raw
  modified_base (493)..(493): a, c, t, g, unknown or other
  misc_feature (493)..(493): n is a, c, g, or t
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagccccctaagctgcagatgattggtccgtccagtttccaagatggggccccatcgagattccgctcagtggatctgggacagatttcactctcaccatcagcagcctgcagcctgaagatttgcaacttacttattgtcagcagcgcacaatttcccgctcactttcggcggaggaccaaggtgagatcgaaacgactgtgctgcactatctgtctnac

SEQ ID NO: 57533 - DNA, 510 bp, Homo sapiens
  misc_feature: GYAE6OF02FXVRU.18.23.C01.1.454.CMB.1.raw
  modified_base (426)..(426): a, c, t, g, unknown or other
  misc_feature (426)..(426): n is a, c, g, or t
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaaagctgcagatgattggtccgtccagtttccaagatggggccccatcgagattccgcgtcagtggatctgggacagattcactctcaccatcagcagcctgcagcctagaagtatttgctaacttactattgtcagcaggcncacaactttcccgcttctacgtttcggcgacggaccaagggtgagactacgaaacgactgtggctgctaccatctcgtctctac

SEQ ID NO: 57534 - DNA, 507 bp, Homo sapiens
  misc_feature: GYAE6OF02G8DCX.18.23.C01.1.454.CMB.1.raw
  modified_base (504)..(504): a, c, t, g, unknown or other
  misc_feature (504)..(504): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaaccaggaaaagcccctaagctgcagatgattggtccgtccagtttccaagatggggccccatcgagattccgcgtcagtggatctgggacagatttcactctcacatcagcagcctgcagcctgaagtatttgactaacttactaattgtcagcaggcgcacaactttcccgctctactttcggcggaggaccgaaggtggagatacgaaacgactgtgctagcacatctgtctntac

SEQ ID NO: 57535 - DNA, 504 bp, Homo sapiens
  misc_feature: GYAE6OF02F12PC.18.23.C01.1.454.CMB.1.raw
  modified_base (501)..(501): a, c, t, g, unknown or other
  misc_feature (501)..(501): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaaacctggttagtttggtatcagcagaaaccaggaaaagccccctaaagctgcagatgattggtccgtccagtttccaagatggggccccatcgagattccgcgtcagtggatctgggacagatttcactctcaccatcagcagcctgcagcctgaagtatttgcaacttactattgtcagcaggcgcacaatttcccgctcactttcggcggaggaccaaggtgagatacgaaacgactgtggctgcacatctgtcttntac

SEQ ID NO: 57536 - DNA, 534 bp, Homo sapiens
  misc_feature: GYAE6OF02IW69E.18.23.C01.1.454.CMB.1.raw
  modified_base (431)..(431): a, c, t, g, unknown or other
  misc_feature (431)..(431): n is a, c, g, or t
tcagtacgagtatgcacgaccggtgctcgatttagtacacgtgattagggattgggggcaggagtcagacccagtcaggacacagcatgacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagccccctaagctgcagatgattggtccgtccagtttccaagatggggccccatcgagattccgcgtcagtggatctgggacagatttcactctcaccatcagcacgcctgcagcctagaagtatttgactaactttactatttgtcagcaggcncaactaactttcccgactctacgtttcgggacggacgggaccgaagggtggagatacgaaacggtaacgtggtggccttgaccacctatctcgttcttctacc

SEQ ID NO: 57537 - DNA, 525 bp, Homo sapiens
  misc_feature: GYAE6OF02H5J8T.18.23.C01.1.454.CMB.1.raw
  modified_base (521)..(521): a, c, t, g, unknown or other
  misc_feature (521)..(521): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcacgcctgcagcctgaagtatttgactaactttaacttatttgtacagcaggccgacactaactttcccgctctacgtttcgggcggagggaccaagggtggagatacgaaacgaactggtcggctgcacctatctgtcttntacg

SEQ ID NO: 57538 - DNA, 510 bp, Homo sapiens
  misc_feature: GYAE6OF02G62EO.18.23.C01.1.454.CMB.1.raw
  modified_base (442)..(442): a, c, t, g, unknown or other
  misc_feature (442)..(442): n is a, c, g, or t
  modified_base (499)..(499): a, c, t, g, unknown or other
  misc_feature (499)..(499): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcacatcagcagcctgcagcctgaagtatttgactaacttactattgtcagcaggcgacactaactttcccgnttccacgtttcggcggaggaccaagggtggagatacgaaacgactggtgctgacacntctgtctctac

SEQ ID NO: 57539 - DNA, 515 bp, Homo sapiens
  misc_feature: GYAE6OF02GOOU5.18.23.C01.1.454.CMB.1.raw
  modified_base (512)..(512): a, c, t, g, unknown or other
  misc_feature (512)..(512): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagatttgactaacttactatttgtcagcaggcgcacaactttcccgctctacgtttcggcggtacgggaccaggtggagagtacgaaacgactggtgctgcaccgtatcgtcgttctntac

SEQ ID NO: 57540 - DNA, 517 bp, Homo sapiens
  misc_feature: GYAE6OF02JVT24.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatgacccattccccttcttccgtgtctgcgtctgtaggagaccgagtcaccatcacttgtcggcgaatcaggatattaaaacctggttagtttggtatcagcagaaaccaggaaaagcccctaagctgcagatgattggtccgtccagtttccaagatggggccccatcgagattccgcgtcagtggatctggacagatttcactctcacatcagcagcctgcagcctagaagtatttgactaacttactattgtacagcaggcgacactaacttcccgactctacgtttcgggcggaacggaccgaaggtcggagtagtacgaaacgaactgtcgctgacacatctcgtcttctac

SEQ ID NO: 57541 - DNA, 573 bp, Homo sapiens
  misc_feature: GYAE6OF02G84UK.18.23.C01.1.454.CMB.1.raw
  modified_base (445)..(445): a, c, t, g, unknown or other
  misc_feature (445)..(445): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcaagaaaccaggaaaacgcccctaagctgcagatgattggtccgtccagtttaccaaggacgtcggggccccagtcgagacttcccgcgtcagtggatcgtgggacagtatttcactctacaccatcagcagcctgcacgcctagaagtatttgacctaaacttacttattgtcagcaggcncaactaactttcccgcttctacgtttcgggacggtacgggaaccgaagggtcggagtacgtaccgaaaacggtaaccgttggtacggactcggaccaaccgtagttccgttacgttcctttctaaccg

SEQ ID NO: 57542 - DNA, 521 bp, Homo sapiens
  misc_feature: GYAE6OF02GMT36.18.23.C01.1.454.CMB.1.raw
  modified_base (435)..(435): a, c, t, g, unknown or other
  misc_feature (435)..(435): n is a, c, g, or t
tcagtacgagtatgcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcgccctgtagggtttctaatcgcttctctggctccaagtctggcaacgcggcctccctgaccatctcgtgggctccaggctggaggacgaggctgtattattactgcagtctcatanacagcacagcactctctatcgtcttacggacgtgggaacctaaggtccaccgttcgtacggtccacgcccgaaggcccaaccctcg

SEQ ID NO: 57543 - DNA, 503 bp, Homo sapiens
  misc_feature: GYAE6OF02H4TQ4.18.23.C01.1.454.CMB.1.raw
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (500)..(500): a, c, t, g, unknown or other
  misc_feature (500)..(500): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagtatttgactaacttactattgtcagcaggcncactaatttcccgntcactttcggcggaggaccagggtgagatcgaaacgactgtagctgcacatctgtcttntac

SEQ ID NO: 57544 - DNA, 542 bp, Homo sapiens
  misc_feature: GYAE6OF02HTNS6.18.23.C01.1.454.CMB.1.raw
  modified_base (396)..(396): a, c, t, g, unknown or other
  misc_feature (396)..(396): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtcccttcttccgtgtctgcgtctgtaggagaccgagtcaccatcacttgtcgggcgaatcaggatattaaaacctggttagttgtatcagcagaaaccaggaaaagcccctaagctgcagatgattggtccgtcagtttccaagatcggggccccatcgagattccgcgtcagtggatcgtgggacagatttcactctcacatcagcagcctgcagcctagaagtntttcgactaacttactattgtcagcaggcactaacctaactttcccgctccgtacgtttcgggaccggtaggaaccaagggtggaacgtataccgaaacgacgttggtcggtaccgtagcctaaccagttcctgtaccttctaccg

SEQ ID NO: 57545 - DNA, 536 bp, Homo sapiens
  misc_feature: GYAE6OF02IPOMA.18.23.C01.1.454.CMB.1.raw
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
  modified_base (522)..(522): a, c, t, g, unknown or other
  misc_feature (522)..(522): n is a, c, g, or t
  modified_base (533)..(533): a, c, t, g, unknown or other
  misc_feature (533)..(533): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaaccaggaaaagccccctaagctagcagatgattcgggtccgtcctagtttccaaagtactcgggggcccccagtcgagtacttccgcgtcagtgatctgggacagattcactctcacatcagcagcctgcagcctagaatatttgactaacttacttattgtacagcaggcncaactaactttcccgnttccgtacgtttcggcggacgggaccaagggtggagatacgaacgactggtggtctaggccacctnttctgttcctntac

SEQ ID NO: 57546 - DNA, 514 bp, Homo sapiens
  misc_feature: GYAE6OF02HD7Q8.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagtatttagactaacttacttaatttgtcagcaggcgcacaactttcccgctcctacgtttcggcggaggaccgaagggtggagatacgaaacgaacgtgtgcgtgcacatctgtctctac

SEQ ID NO: 57547 - DNA, 525 bp, Homo sapiens
  misc_feature: GYAE6OF02HEQNF.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagcccctaagctgcagatgattggtccgtcagtttccaagatcggggccccatcgagattccgcgtcagtggatcgtgggacagatttcactctcacatcagcagcctgcagcctagaagtatttgactaacttacttattcgtcagcaggcacactaactttcccgcttctacgtttcggcgggtacggaccgaagggtggagactacgaaacgtacgtggtcggctgacaccatctcttcttctacc

SEQ ID NO: 57548 - DNA, 502 bp, Homo sapiens
  misc_feature: GYAE6OF02HIFLX.18.23.C01.1.454.CMB.1.raw
  modified_base (499)..(499): a, c, t, g, unknown or other
  misc_feature (499)..(499): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaaatcaggatattaaaaacctggttaagttggtatcagcagaaaaccaggaaaagcccctaaagctgcagatgattggtccgtcagtttccaagatggggccccatcgagattccgcgtcagtggatctgggacagatttcactctcaccatcagcagcctgcagcctgaagatttgctaacttactattgtcagcagcgcacaatttcccgctcactttcgcggaggaccgaagtggagatacgaaacgaactgtgctgcacatctgtctntac

SEQ ID NO: 57549 - DNA, 518 bp, Homo sapiens
  misc_feature: GYAE6OF02I9BUX.18.23.C01.1.454.CMB.1.raw
  modified_base (515)..(515): a, c, t, g, unknown or other
  misc_feature (515)..(515): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatcggggccccatcgagattccgcgtcagtggatctgggacagatttcactctcaccatcagcagcctgcagcctagaagtatttgactaacttacttattgtcagcaggcgcactaactttcccgcttctacgtttcggcggacgggaccaagggtggagagtacgaaacgtaacgtgtggctgcacatctgtctntac

SEQ ID NO: 57550 - DNA, 598 bp, Homo sapiens
  misc_feature: GYAE6OF02III3C.18.23.C01.1.454.CMB.1.raw
  modified_base (320)..(320): a, c, t, g, unknown or other
  misc_feature (320)..(320): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggataattaaaactggttagttggtatcagcaagaaaccaggaaaacgcccctaagctagcagatgattcggtccgtcagtttccaagngtcggggccccagtcgagacttccgcgtcgagtggatcgtgggacagtactttcactctacaccatcagcacgcctgcagcctagaagtatttacgactaactttacttatttcgtacagcgacggcactaactaactttcccgacttaccgtaccgtttccgggaccgggtaacggaccgtaagggtggaacgtaacgtaaccgaaaacggtaacgttagggtacggtacctacggaccctaacgtacgttaccgttcggttaccttaccgtacccg

SEQ ID NO: 57551 - DNA, 552 bp, Homo sapiens
  misc_feature: GYAE6OF02JB1JF.18.23.C01.1.454.CMB.1.raw
  modified_base (180)..(180): a, c, t, g, unknown or other
  misc_feature (180)..(180): n is a, c, g, or t
  modified_base (343)..(343): a, c, t, g, unknown or other
  misc_feature (343)..(343): n is a, c, g, or t
tcagtacgagtatgcacgaccggtgctcgatttagtacacgtgattagggattgggggcaggagtcagaccccagtcaggacacagcatggacacgagggtccccgctcagctcctggggctcctgctgctctggctcccaggttccagatgtcgacatccagatgacccagtccccttnttccgtgtctgcgtctgtaggagaccgagtcaccatcacttgtcgggcgaatcaggatattaaaacctgttagttggtatcagcagaaaccaggaaaagcccctaagctgcagatgattggtccgtccaggtttccaagagtggggccccatcgagattccgngtcagtggatcgtggactagtatttcactctcaccatcagcagcctgcagcctgaagtatttgactaactttacttactttgtacagcaggcgacactaactttcccgcttaccgtacgtttccgggcggtaacgggaacctaagggttgagtactaccgaaacgaactggtcggaccttcgaccacctatccgttcgtccttctaccg

SEQ ID NO: 57552 - DNA, 710 bp, Homo sapiens
  misc_feature: GYAE6OF02JEWFL.18.23.C01.1.454.CMB.1.raw
  modified_base (251)..(251): a, c, t, g, unknown or other
  misc_feature (251)..(251): n is a, c, g, or t
  modified_base (385)..(385): a, c, t, g, unknown or other
  misc_feature (385)..(385): n is a, c, g, or t
tcagtacgagtatgcacgaccggtgctcgatttagtacacgtgatttagggtaggttgggggcaggacgtcagacccgagtcaggacacagcatggacgaccgagggtccccgctcacgcgtcctcggggctcctgcctgcgtcctcggctcccaggttaccagatgcgaccagtccagactgaccctcgttccccttcttccgtgtctgcgttctggtaggagaccgagtcaccatcacgttgtcggcancagatagttaaactggttagttggtatcgagcagaacaggaaacgaccctaagacctcgacacgtactgtacttcggtaccgtaccgtagttaccaagtacgtcgggaccctagtcgagtactaccgtcgacgnggtagacgtcgtacggactaggtacttcgactcctacgtaccactcgtaacgcgtaacgcccgtagccgtacgaccgttaggtaccgttagtttacgtacgtaacttttacgtaacgttttacgtaccgtaacgtcgtaacgtaccgaccgttaaccgttactttaccccgtattaccgttacgttacccggggtacggaaaccggtaaccggaagggttacggaacgtaacgtaaccggtaaacggtaaccttgggtaaccggtacgttaccggaacccgtaccgttaccgttaccgtttacggttcccgttaccttaccccgg

SEQ ID NO: 57553 - DNA, 588 bp, Homo sapiens
  misc_feature: GYAE6OF02IBJ7V.18.23.C01.1.454.CMB.1.raw
  modified_base (172)..(172): a, c, t, g, unknown or other
  misc_feature (172)..(172): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
tcagtacgagtatgcacgaccggtgctcgatttagtacacgtgattagggagttgggggcgaggagtcagacccagtcaggacacagcagtggacacgagggtccccgctcagctcctggggctcctgctgctctggctcccaggttccagatgcgacatccagatgacccngtccccttcttccgtgtctgcgtctgtaggagaccgtagtcaccatcacgtttggcgggacgaaatcaggtattaattaaaaacctggtttaagtttggtaatcagcaagaaaccaggaaaacgcccttaagctgcagatgacttggtcctccaagtttccaanagtcgggccccagtcgagnttccgntcagtggatcnggacagattcactnacacagcagcagtcctgaccaggtctaggaatattttnctaaacctttataagttttgaccaggaccaaggcgttacaacctaaattttcccccgctaccgttacggttccgggaacgggtaacggaaccgtagggtagacgtacgtaaccgaaacgtacgtggtcgtaccgacgtaccactattcctcgttacttctaccg

SEQ ID NO: 57554 - DNA, 564 bp, Homo sapiens
  misc_feature: GYAE6OF02IAQAL.18.23.C01.1.454.CMB.1.raw
  modified_base (280)..(280): a, c, t, g, unknown or other
  misc_feature (280)..(280): n is a, c, g, or t
  modified_base (445)..(445): a, c, t, g, unknown or other
  misc_feature (445)..(445): n is a, c, g, or t
  modified_base (560)..(560): a, c, t, g, unknown or other
  misc_feature (560)..(560): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaacncccctaaagctgcagatgattggtccgtccagtttccaagagtcggggccccagtcgagtacttccggcgtcaggtggatcgtgggacagtatttcactctcaccatcagcacgcctgcagcctagtaagtatttgaccttaaacttacttattgtcagcaggcncaacctaactttcccgcttacctacgtttcgggccgggtagggaaccgtaagggtcggagacgtacgaaaacgtacgtaggtcggtacctggaccaccgtattccgtgttccttntacc

SEQ ID NO: 57555 - DNA, 517 bp, Homo sapiens
  misc_feature: GYAE6OF02HDKN6.18.23.C01.1.454.CMB.1.raw
  modified_base (425)..(425): a, c, t, g, unknown or other
  misc_feature (425)..(425): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtcagtttccaagatggggccccatcgagattccgcgtcagtggatctgggacagatttcactctcacatcagcagcctgcagcctagaagtatttgactaacttactattgtcagcaggcncactaactttcccgcttcctactttcggcggacggaccgaagggtggagagtacgaaacgacgttagtggctagcacatctcgtcttctacg

SEQ ID NO: 57556 - DNA, 539 bp, Homo sapiens
  misc_feature: GYAE6OF02ITKOL.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgcgggcgaatcaggatattaaaacctggttagtttggtatcagcagaaaccaggaaaagcccctaagctgacagatgattggtccgtcctagtttccaagatcggggccccagtcgagattccgcgtcagtgggatcgtgggacagtatttcactctcaccatcagacacgcctgccagcctagaagtatttgactaacgttactattgtcagcagcgcactaacttcccgactcacgttcggacggacggaccgaaggtggagtagtaccgaaacgacgttaggtaggtctacggacacctactcgtgtccttctaccg

SEQ ID NO: 57557 - DNA, 545 bp, Homo sapiens
  misc_feature: GYAE6OF02HWGZT.18.23.C01.1.454.CMB.1.raw
  modified_base (402)..(402): a, c, t, g, unknown or other
  misc_feature (402)..(402): n is a, c, g, or t
  modified_base (539)..(539): a, c, t, g, unknown or other
  misc_feature (539)..(539): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaacgcccctaagctgcagatgattggtccgtccagtttccaagagtcggggccccagtcgagacttccgcgtcagtgatcgtgggacagatttcactctcaccatcagcagcctgcagcctgaagtntttgactaacttactatttgtcagtcgaggcgacacctaactttcccgcttctaccgtttcgggacgggaacggaccgaagggtggagacgtacgaaacgtaactggtcggtactgccaccgtattccgtgttcctnttaccg

SEQ ID NO: 57558 - DNA, 527 bp, Homo sapiens
  misc_feature: GYAE6OF02FYW2Y.18.23.C01.1.454.CMB.1.raw
  modified_base (124)..(124): a, c, t, g, unknown or other
  misc_feature (124)..(124): n is a, c, g, or t
tcagtacgagtatgcacgaccggtgctcgatttagtacacgtgattagggattgggggcaggagtcagacccagtcaggacacagcatggacacgagggtccccgctcagctcctggggctccngctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaacgcccctaagctgcagatgattggtccgtccagtttccaagatcggggccccatcgagacttccgcgtcagtggatcgtgggacagatttcactctcaccatcagcagcctgcagcctagaagtattttgactaactttaacttattgtcagcaggcgcactaatttcccgctcctacgtttcgggcggtacgggaccaagggtggagatacgaaacgaactggtggctagcacctatctgtcttctac

SEQ ID NO: 57559 - DNA, 606 bp, Homo sapiens
  misc_feature: GYAE6OF02HWANI.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagtttggtatcagcagaaaccaggaaaacgcccctaagctgcagatgattggtccgtcagtttccaagagtcggggccccatcgagacttccgcgtcaagtggatcgtgggacagtactttcactctacaccatcagcagcctgcagcctgaaagtatttgctaacgttactatttgtcacgctaggccgacaacctaactttccccgacttaccgtaccgttttaccgggaccgggtaacgggaacccgtaaggggttacggaacggtaacgttaaccgaaaaacggtaacgttcggtacggtaccgtacggacctaacccgtaacttccgtttacggttcctttaccgttaaccg

SEQ ID NO: 57560 - DNA, 687 bp, Homo sapiens
  misc_feature: GYAE6OF02GA8TC.18.23.C01.1.454.CMB.1.raw
tcagtacgagtatgcacgaccggtgctcgatttagtacacgtgattagggattgggggggcaggagtcagacccagtcaggacgacagccactggacgaccgaggggtccccgctcagctcctgggcctcctgctgcgtcctggcgtccccagggttcccagatgccgacatccagactgacccacgtccccttcttccggtgtcctgccgtctgtaggcgaccgatcaccatcacttggaccggcgaatcaggtatattaaacctggttagtttgtatctagcagaaaccgaggaaacgcccctaagctacgacagattgtattggtcctctagttaccgaaggtacgtccggggacccctagtcggacgtacttccgacgtcaggtcggactcgtgggacctacgtactttccgaccttctaccaacctatccgacggtccagtccctgaccgaacggccctaggaacttagtttacgaccttaacgtttacgttaactttcggtacaacgtaccgaacggtccgactaaaccgttaaccgttttcccgggacctttaccggtaccggtttcggggaccgtacgggtaccgaaggggttcgacgtacgtaccgaaacggtacctacgggtcggtaccctaccggactacccgtacgttaccgttcggttacccttacctaacccg

SEQ ID NO: 57561 - DNA, 522 bp, Homo sapiens
  misc_feature: GYAE6OF02HWIU0.18.23.C01.1.454.CMB.1.raw
  modified_base (314)..(314): a, c, t, g, unknown or other
  misc_feature (314)..(314): n is a, c, g, or t
  modified_base (425)..(425): a, c, t, g, unknown or other
  misc_feature (425)..(425): n is a, c, g, or t
  modified_base (517)..(517): a, c, t, g, unknown or other
  misc_feature (517)..(517): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgcggcgaatcaggatattaaaacctggttagtttggatcagcagaaaccaggaaaagcccctaagctgcagatgattggtccgtcagttccaagngtcggggccccatcgagattccggcgtcaggtggatctgggacagatttcactctcaccatcagcagcctgcagcctgaagtatttgactaacttacttattgcagcagcncactaacttccgcttcactttcgggcggaggaccgaaggtggagtacgtacgaaacggaacgtggtcggctgcaccattccgtcgttccttntaccg

SEQ ID NO: 57562 - DNA, 607 bp, Homo sapiens
  misc_feature: GYAE6OF02I1OET.18.23.C01.1.454.CMB.1.raw
  modified_base (317)..(317): a, c, t, g, unknown or other
  misc_feature (317)..(317): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttggtatcagcagaaaccaggaaaagcccctaaagctgcagatgattggtccgtcagtttccaagntcggggccccatcgagcttccgcgtcaggtggatcgtgggacagtatttcactctcaccatcagcagcctgcacgcctagaagtatttagactaactttacttattcgtacagctaggccgactaacctaacttttccccgacttccgtaccgttttccgggacgggtaacgggtaaccgtaaggggtcggaacgtaacgtaaccggtaaaaacggtaaccgttagggtaacggtaccgtacggtaccgtaaccgtacgttaccgttacgtttaccgttacctaacccgg

SEQ ID NO: 57563 - DNA, 537 bp, Homo sapiens
  misc_feature: GYAE6OF02HP19I.18.23.C01.1.454.CMB.1.raw
  modified_base (418)..(418): a, c, t, g, unknown or other
  misc_feature (418)..(418): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcaatcaggatattaaactggttagttgtatcagcagaaaccaggaaacgccctaagctgcagatgattggtccgtcagtttccaagagtcggggccccatcgagacttccgcgtcagtggatcgtgggacagtatttcactctacacatcagcagcctgcagcctgaagtactttgactaacttactattcganagcaggcgcaactaacgtttcccgactctacgtttcgggaccgggtaaggaccgtaagggtcgagacgtacgaaacggactggtaggctaggcctaaccgagttccgtcgtcttctacg

SEQ ID NO: 57564 - DNA, 521 bp, Homo sapiens
  misc_feature: GYAE6OF02HIWTU.18.23.C01.1.454.CMB.1.raw
  modified_base (518)..(518): a, c, t, g, unknown or other
  misc_feature (518)..(518): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtcagtttccaagagtcggggccccagtcgagattccgcgtcagtggatcgtgggacagtatttcactctcaccatcagcagcctgcagcctagaatatttgactaacttacttattgtcagcaggcgacactaacttcccgctcctacgtttcggcggtacggaccgaaggtggagatacgaaacgtactggtagctgacaccatctcgtctntac

SEQ ID NO: 57565 - DNA, 515 bp, Homo sapiens
  misc_feature: GYAE6OF02G651P.18.23.C01.1.454.CMB.1.raw
  modified_base (502)..(502): a, c, t, g, unknown or other
  misc_feature (502)..(502): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtcgtccagtttccaagatggggccccatcgagattccgcgtcagtggatctgggacagatttcactctcaccatcagcagcctgcagcctgaatatttgctaacttacctattgtcagcaggcgcacaatttcccgcttcctacgtttcggcggacgggaaccaagggtggagagtacgaaacgaactgtcggctgcaccntcctgttctctac

SEQ ID NO: 57566 - DNA, 561 bp, Homo sapiens
  misc_feature: GYAE6OF02H6BPB.18.23.C01.1.454.CMB.1.raw
  modified_base (441)..(441): a, c, t, g, unknown or other
  misc_feature (441)..(441): n is a, c, g, or t
  modified_base (535)..(535): a, c, t, g, unknown or other
  misc_feature (535)..(535): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttggtcgggcgaaatcaggattaattaaaacctggttagtttggtatcagcaagaaaccaaggaaaacgcccctaaagctagcagatgattggtccgtcagtttccaagacgtcggggccccatcgagtacttccgcgttcagtggatcgtgggactagtactttcacctctaccaccatcacgcacgcctgcacgcctagaagtatttcgacttaacttactntttgcagcacggcgactactaactttcccgcttctacgtttccggacggaggaccgaaggtggacgtactacgaaacgtacgtggtacggtccncgacacctattctcgttcctctaccg

SEQ ID NO: 57567 - DNA, 529 bp, Homo sapiens
  misc_feature: GYAE6OF02IQY1C.18.23.C01.1.454.CMB.1.raw
  modified_base (317)..(317): a, c, t, g, unknown or other
  misc_feature (317)..(317): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagcccctaagctgcagatgattggtccgtcagtttccaagntcggggccccatcgagacttccgcgtcaggtggatcgtagggacagtatttcacttctcaccatcagcagcctgcacgcctgaatatttgactaacttacttattgtacagcaggcgacactaactttcccgctccgtacgtttcggacgggacggaccgaaggtgagagtacgaaacgaactggtaggctagactacatctgttctctacc

SEQ ID NO: 57568 - DNA, 565 bp, Homo sapiens
  misc_feature: GYAE6OF02FP3RM.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcaagaaaccaggaaaacgcccctaagctgcagatgattggtccgtccagtttccaagatcggggccccatcgagtattccgcgtcaggtggatcgtgggacagtactttcactctcaccatcagcagcctgcagccgtagaacgtatttagactaacttacttattcgtcagcgaggcgacaactaactttcccgacttccgtacgtttcgggacggtaacgggaaccgtaagggttaggagaactacgaaaacggtaacgttaggtcggtactaggaccacctacttcctcgttccttctac

SEQ ID NO: 57569 - DNA, 568 bp, Homo sapiens
  misc_feature: GYAE6OF02HZJXL.18.23.C01.1.454.CMB.1.raw
  modified_base (464)..(464): a, c, t, g, unknown or other
  misc_feature (464)..(464): n is a, c, g, or t
  modified_base (504)..(504): a, c, t, g, unknown or other
  misc_feature (504)..(504): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggtataattaaaaccttggtttagtttggtatcagcaagaaaccaaggaaaacgcccctaaagctgcagatgattggtccgtcagttttccaagagtcggggcccctagtcgagtacttccgcgtcagtggatctgggacagtatttcactctcaccagtcagcagcctgcagcctagaagtatttgactaacttatatttgtacagcgtagccgtacactaactttccccgnttcctacgtttccgggcggaacgggaccgtaagggtgganacgtacgaaacgtcgttaggtcgggactggacccacctaattccgttagttacccttatacccg

SEQ ID NO: 57570 - DNA, 521 bp, Homo sapiens
  misc_feature: GYAE6OF02HADOB.18.23.C01.1.454.CMB.1.raw
  modified_base (455)..(455): a, c, t, g, unknown or other
  misc_feature (455)..(455): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcaagaaaccaaggaaaacgcccctaagctgcagatgattggtccgtccagtttccaagatcgggggccccagtcgagtacttccgcgtcagtggactcgtgggacagtatttcactctcaccatcagcagcctgccagcctagaagtatttgactaacttacttattgtacagcaggcgcactaactttcccnctctactttcgggcggacggacaaggtggagatacgaaacgactggtgctgcacatctgtcttcac

SEQ ID NO: 57571 - DNA, 558 bp, Homo sapiens
  misc_feature: GYAE6OF02F5ZWP.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttggtatcagcagaaaccaggaaaagcccctaagctgcagatgattggtccgtcagtttccaagatggggccccatcgagattccgcgtcagtggatcgtgggacagatttcactctcaccatcagcacgcctgcagcctagtaacgtatttcgactaacttacttattgtcagcaggccacacactttcccgacttcgtaccgtttcgggacggacgggaaccgtaagggtggagaacgtaccgaaaacggtaacgtggtacggcgttcggacctaccgtacttccgttcggttccttcttacccg

SEQ ID NO: 57572 - DNA, 538 bp, Homo sapiens
  misc_feature: GYAE6OF02HPAL9.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctccaggttccagatgcgacatccagatgacccagtccccttcttccgtgtctgcgtctgtaggagaccgagtcaccatcacttgtcggcgaatcaggatattaaaacctggttagttggtatcagcagaaaccaggaaaacgcccctaagctgcagatgattggtccgtctagtttccaagactcggggccccatcgagactccgcgtcagtgatcgtggacagattcactcacacatcagcagcctgcagctagaagtatttgactaacttatattgtctagacacggcacactaacttcccgacttcctacgtttcggacgggtaacggaccgtaagggtgagtactacgaaacgtaacgtagtcggcttacggactaccgacttcgtcgttcgttctaacg

SEQ ID NO: 57573 - DNA, 594 bp, Homo sapiens
  misc_feature: GYAE6OF02JGD4Y.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagtttggtatcagcagaaaccagaaacgccctaagctgcagatgattggtccgtactagtttaccgaagtacgtcggggacccctagtacgagtacttccgcgtccgaagtcggactcgtagggactagtatttcgactactccactactcagcagcctgcacgctagaactatttcgactaacttatattagtcagcaggccgactacgtaactttcccgacttacgtaccgtttcgggaccggtagggtaaaccctagggtagacggtaactaaccgaaaccggtaacgtcggtagggaccgttacgaccaacccgttgtaccttcggttacctcgtaacccg

SEQ ID NO: 57574 - DNA, 654 bp, Homo sapiens
  misc_feature: GYAE6OF02GHRVR.18.23.C01.1.454.CMB.1.raw
tcagtacgagtatgcacgaccggtgctcgatttagtacacgtgattagggtagttgggggcaggagtcgagtaccctagtcaggtaacacagcatggacacgagggtcccgctcagctcctggggctcctgctgctctggctcccaggttccagatcgcgacatccgagatggaccctagtaccccttattccgtgtactgccgtctgtaggagaccggagtcaccatcacgttggtcgggcgaatcgaggatagttaaaacctggtttaacgttggtatcgagtcaaagaaaccaggtaaaacgccccgtaaagctgacgagatagtagttcggtccgtcctacgtttccgaagacgtaccggggacccagtcgagacttccgcgtcgagtcgatcgtgggactagatttcgactctccaccatcagcacgtctgcacgccgtcgaactgtttagacctaacttacgttagttaggtacagtcgacggtcgacaacgtaccgtttcccgacgttaccgttaccggtttcgggacccggtacggtacccgtaagggtcggaacgtaccgtaaccggaaaaccggtaccttacgggttacggacccgttccggtacctaccctaccgttccgtacgtttaccgtaccttaacccg

SEQ ID NO: 57575 - DNA, 678 bp, Homo sapiens
  misc_feature: GYAE6OF02IL09S.18.23.C01.1.454.CMB.1.raw
tcagtacgagtatgcacgaccggtgctcgatttagtacacgtgattagggattggggggcaggagtcacgacccagtaccaggacacagccatggacaacgacgggtcccgctcagctcctgggctcctggctgctcgtggctcccaggttcctaggagtgcggacagtcccaggatcgacccacgtccccgttcttccgtagtcgtgcgtctgtagggagaccgagtcaccatcacttggtcggcaatcaggatacttaaacctggttacgttaggtattcagctaggaaaccctagggaaaacgccccctaaagcttagacacgagtgattcgggtcccgtccgacgtttccgaagacgtcggggtccccaagtcggagtacttccggcgtcacgtcggaatcgtgggacagtatttacactctacaccgtatcaggcaggtcctagcgaacgccgtagtaacgactttgacctaactttactactttgtactagcgaggtcgtacgacgtaaccgtttccccggacttaccgaccgttttacgggacggggtaacgggaacccgtaaggggttccggtacgtaacggttaccgtaaaaccggaccgttaggggtaccggtaccgtttacggtacccgtaccgtaacgttacccggtacgttccgtaccttacccg

SEQ ID NO: 57576 - DNA, 530 bp, Homo sapiens
  misc_feature: GYAE6OF02H9RTB.18.23.C01.1.454.CMB.1.raw
  modified_base (397)..(397): a, c, t, g, unknown or other
  misc_feature (397)..(397): n is a, c, g, or t
  modified_base (525)..(525): a, c, t, g, unknown or other
  misc_feature (525)..(525): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtcagtttccaagatggggccccatcgagattccgcgtcagtggatcgtgggacagatttcactctcaccatcagcagcctgcagcctgaagtntttgctaacttactattgtcagcaggcgcactaactttcccgacttcctacgttttcgggcgggtacgggaccaagggtgagactacgaaacgaactggtcggtctgaccaccagttcgtgttccttntaccg

SEQ ID NO: 57577 - DNA, 577 bp, Homo sapiens
  misc_feature: GYAE6OF02IV9SV.18.23.C01.1.454.CMB.1.raw
tcagtacgagtatgcacgaccggtgctcgatttagtacacgtgattagggattgggggcgaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaacgcccctaagctgcagatgattggtccgtccagtttccaagatcggggccccagtcgagacttccggcgtcgagtggatcgtgggacagtatttcacttctcaccatccagcacgcctagcacgtcctagtaagtatttcgactaacctttactatttcgtcagctaggccactactaactttcccgcttctaaccgtttcgggacggtacgggaaccgaagggttggacgtacgtacgaaacggtaacttggtcggtctacgactaccctacgttcgttcgtttaccttcctaaccg

SEQ ID NO: 57578 - DNA, 536 bp, Homo sapiens
  misc_feature: GYAE6OF02I1OGZ.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatcggggccccatcgagacttccgcgtcagtggatcgtgggacagatttcactctcaccatcagcagcctgcagcctagaaagtatttcgactaactttactattgtcagcgaggcgacactaactttcccgcttcctacgtttcgggcggacgggtaccgaagggtggagacgtacgaaacggaactggtggctgcaccgtatctagttccttctac

SEQ ID NO: 57579 - DNA, 783 bp, Homo sapiens
  misc_feature: GYAE6OF02JVHEV.18.23.C01.1.454.CMB.1.raw
  modified_base (167)..(167): a, c, t, g, unknown or other
  misc_feature (167)..(167): n is a, c, g, or t
  modified_base (229)..(229): a, c, t, g, unknown or other
  misc_feature (229)..(229): n is a, c, g, or t
tcagtacgagtatgcacgaccggtgctcgatttagtacacgtgattagggattgggggcaggagtcagacccagtcaggacacagcatggacacgaggtcccgctcagctcctgggctcctgctgctctggctcccaggttccagatgcgacatccagatcgacccngttccccttcttccgtgtctgcgtctgtacggagaccgagtcaccagtccacgtttggtccnggggtaccgaaatcgaaagggtattaacgtttaaaaccgttgggtttaagtttggtatacgaagacgaagaaaccgaggaaacgtcccctaaaggcttgacaggatgacgtttcgggtaccgtacaaggttttaccgaaaggacgttcgggggacccctagttaccggagtacgttccggacgtacgaggttggaagttcgtaggggaactaaggtactttacgaacgttctaccaccgatcgacgtcaacggtcccttagacctaacggtaccgttaggtaaacgttacttttacggaccttaaacgtttacgtatttacggtaccaacgggtaccgaaacgggtaccgttaccaaccgttaaacgtttttccccggtaacgttacccggttaaccgggttttaccggggaccggggtaacggggtaacccgtaaagggggttacgggaaacggtaaccgtttaaccgaaaacggtaaccgttacgggtacgggtaccgttaacggacccgtaacccgttagttaccccgtttaggtttaccctttaacccgg

SEQ ID NO: 57580 - DNA, 505 bp, Homo sapiens
  misc_feature: GYAE6OF02HC87E.18.23.C01.1.454.CMB.1.raw
  modified_base (424)..(424): a, c, t, g, unknown or other
  misc_feature (424)..(424): n is a, c, g, or t
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaaagctgcagatgattgtccgtccagtttccgagatggggccccatcgagattccgcgtcagtggatctggacagatttcactctcaccatcagcagcctgcagcctgaagatttgctaacttactattgtcagtcaggcncacaatttcccgctcactttcggcggaggaccaaggtgagatacgaaacgaactgtggctgacaccgatctgttcttctac

SEQ ID NO: 57581 - DNA, 551 bp, Homo sapiens
  misc_feature: GYAE6OF02IG1X6.18.23.C01.1.454.CMB.1.raw
  modified_base (280)..(280): a, c, t, g, unknown or other
  misc_feature (280)..(280): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcaagaaaccaggaaaacncccctaagctgcagatgattggtccgtccagtttccaagatcggggccccagtcgagtacttccggcgtcaggtggatcgtgggacagtatttcactctcacctatcagcacgcctgccagcctgaagtagtttcgacttaacttacttaatttgtacagcaggaccgactaacctaactttcccacttcctacgtttcgggcggacgggaccgaagggtggacgatacgaaacgacgtagtcggctgaccacatcgtacgttccttctac

SEQ ID NO: 57582 - DNA, 589 bp, Homo sapiens
  misc_feature: GYAE6OF02JUV1W.18.23.C01.1.454.CMB.1.raw
  modified_base (327)..(327): a, c, t, g, unknown or other
  misc_feature (327)..(327): n is a, c, g, or t
  modified_base (384)..(384): a, c, t, g, unknown or other
  misc_feature (384)..(384): n is a, c, g, or t
  modified_base (430)..(430): a, c, t, g, unknown or other
  misc_feature (430)..(430): n is a, c, g, or t
  modified_base (508)..(508): a, c, t, g, unknown or other
  misc_feature (508)..(508): n is a, c, g, or t
tcagtacgagtatgcacgaccggtgctcgatttagtacacgtgattagggattgggggcgaggagtcagacccagtcaggacacagcatggacacgagggtcccgctcagctcctgggctcctgctgctctggctcccaggttccagatgcgacatccagatgacccagtccccttcttccgtgtctgcgtctgtaggagaccgagtcaccatcacttgtcgggcaatcaggatattaaaacctggtttagtttggtattcagtcagaaaccaggaaagcccctaagctgcagatgattggtctccagtttccaagatcggggcccntacgagtacttccgcgtcagtcggatccgtaggactacggatttcgactctcaccgnttcgagtcacgcctgccagcctgaagtctttagcctaactttaatntttacgtctaacgtcaggcgactacgtaactttcccgtcttacaccgttttcgggccggtacgggaaccgtaacgggnggtacgtacgtaccgaaacgttaacgttggtaacggccgttagacccgacgtacgttcgtttcggttacccttcgtaaccg

SEQ ID NO: 57583 - DNA, 567 bp, Homo sapiens
  misc_feature: GYAE6OF02H9GYT.18.23.C01.1.454.CMB.1.raw
  modified_base (456)..(456): a, c, t, g, unknown or other
  misc_feature (456)..(456): n is a, c, g, or t
  modified_base (562)..(562): a, c, t, g, unknown or other
  misc_feature (562)..(562): n is a, c, g, or t
  modified_base (566)..(567): a, c, t, g, unknown or other
  misc_feature (566)..(567): n is a, c, g, or t
tcagtacgagtatgcacgaccggtgctcgatttagtacacgtgattagggattgggggctttgcctgggtcctgggcccagtctgccctgactcagcctgcctccgtgtctggggtctcctggacagtcgatcaccatctcctgcactggaaccagcagtgacgttggtggttataactatgtctcctggtaccaacagcacccaggcaaacgccccaaactcatgatttatgatgtcactaatcggcctcaggggtttctaatcgcttctctggctccaagtctggcaacacggcctccctgaccactctctcgggcctccaggctggaggacgaggctgattattactgcagctcatatacaagcaccagcactctctatcgttcttacggaactgggaacccaaggtaccaccgttaccgtaggtacctacgacccgaacggcccaaaccccnctcgtacccaacgttcctaccgttcccccacccgttccctcccaacttaccctaccgttacctcggacggccgggctcgggacgtaaccggccgacgacgtagcancgann

SEQ ID NO: 57584 - DNA, 746 bp, Homo sapiens
  misc_feature: GYAE6OF02HB45E.18.23.C01.1.454.CMB.1.raw
  modified_base (293)..(293): a, c, t, g, unknown or other
  misc_feature (293)..(293): n is a, c, g, or t
tcagtacgagtatgcacgaccggtgctcgatttagtacacgtgatttagggtagttgggggcaggagtcagtacccagtcaggactaactagcatggacacgagggtcccgctcagctccgtggggctcctgctgctcgtggctcccaggttccacgatgcgacatccagatgacccagtccccttcttccgtgtctgcgtctgtaggacgaccgagtccaccatcacgttggtcggcgaatcgaggtatattaaaacctggttagttgtatcagacagaaaccaaggaaacnccccaagctgcagagtcgattcggtccgtcagttccaacgacgtacggccgacacgacgacgtacctccgtcgacgtaggacgtacgtacggtacgatagttactacctacgtacctaaccacgtacctacgtacgactaccggtggtacaaccggtaccgtacgttaagggtaaacgttttcggaaccgtaaaccgttaaccggtttaacggttaacgtttcccgaacgtaccgtaacccggtccggtaccgtaaacctaacccgttttacccccgaccgttaaccgttacccggttttacccgggtaccggggacccgggttaaacccggttaacgggtaccgggttaccggaacccgtaaccgtaaaacccggaaaccggttacgttacggggtaccctaccgggtaccgacccgtaacgtccgtttacggttcccggttcttaacccgg

SEQ ID NO: 57585 - DNA, 502 bp, Homo sapiens
  misc_feature: GYAE6OF02F1M8W.18.23.C01.1.454.CMB.1.raw
  modified_base (499)..(499): a, c, t, g, unknown or other
  misc_feature (499)..(499): n is a, c, g, or t
tcagtacgagtatgcacgaccggtgctcgatttagtacacgtgattagggattgggggcaggagtcagaccccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaaagctgcagatgattggtccgtccagtttccaagtatggggccccatcgagattccgcgtcagtggatctgggacagatttcactctcaccatcagcagcctgcagcctgaagatttgctaacttactaattgtcagcaggcgcaccaattcccgctcactttcggcggacggacaggtgagatacgaaacgactgtgctgcacatctgtctntac

SEQ ID NO: 57586 - DNA, 565 bp, Homo sapiens
  misc_feature: GYAE6OF02F6YWR.18.23.C01.1.454.CMB.1.raw
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttggtatcagcagaaaccaggaaaacgcccctaagctgcagatgattggtcctcctagtttccaagtagtcggggccccagtcgagtacttccgcgtcaggtggatcgtggactagtactttcactctacaccatacagcagcctgcngctgaagtntttcgactaacttnttattgtcagcaggcactactaacttcccgacttccgtacgtttcgggacggtacgggaaccgtaagggtacgagactaaccgaaacggtacgttgggtacgtcgtacggacctaccgtattccgtacggttcctactacccg

SEQ ID NO: 57587 - DNA, 673 bp, Homo sapiens
  misc_feature: GYAE6OF02G1QLH.18.23.C01.1.454.CMB.1.raw
  modified_base (303)..(303): a, c, t, g, unknown or other
  misc_feature (303)..(303): n is a, c, g, or t
tcagtacgagtatgcacgaccggtgctcgatttagtacacgtgattagggattgggggcgaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaaccttggttagtttggtatcagcaagaaaaccaaggtaaaacgcccctaagctgacaganagattggtccgtctagtttccaagagtcggggcccatcgagtacgttcgcgtcaggtcgatcgtgggacaggtattcacgtctcacctatcaagcagctgctacgctagtaaagtactttacgactaacgttaacttagttcgtacagaccgagggcctagaaccgttaacgtttccccgtaactttcccgtaaccggtttttaccgggaccgggtaaaccggggtacccgtaaacggggttaccgggtacggtaacgttaaaccggtaaaaacccggtaacgttacggggttaacgggtacccgtttaggggaaccccttaaccgtaacggttcccggtttttacgttacccgttttacttaaccccgg

SEQ ID NO: 57588 - DNA, 529 bp, Homo sapiens
  misc_feature: GYAE6OF02HAEU9.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttggtatcagcagaaaccaggaaaagcccctaagctgcagatgattggtccgtccagtttccaagatcggggccccatcgagattccgcgtcagtggatcgtgggacagatttcactctcaccatcagcagcctgcagcctagaatatttgactaacttactattgtcagtcaggcacactaactttcccgcttcgtacgtttccgggcggtacgggaccaagggtcggagactacgaaacgtacgtggtacggctagccacatctcgtcttctacc

SEQ ID NO: 57589 - DNA, 577 bp, Homo sapiens
  misc_feature: GYAE6OF02HJEJL.18.23.C01.1.454.CMB.1.raw
  modified_base (176)..(176): a, c, t, g, unknown or other
  misc_feature (176)..(176): n is a, c, g, or t
  modified_base (279)..(279): a, c, t, g, unknown or other
  misc_feature (279)..(279): n is a, c, g, or t
  modified_base (419)..(419): a, c, t, g, unknown or other
  misc_feature (419)..(419): n is a, c, g, or t
  modified_base (467)..(467): a, c, t, g, unknown or other
  misc_feature (467)..(467): n is a, c, g, or t
tcagtacgagtatgcacgaccggtgctcgatttagtacacgtgattagggattgggggcaggagtcagacccagtcaggacacagcatggacacgagggtcccgctcagctcctgggctcctgctgctctggctcccaggttccagatgcgacatccagatgacccagtccccttnttccgtgtctgcgtctgtaggagaccgagtcaccatcacttgtcggcgaatcgaggatattaaaacctggttagtttggtatcagcaagaaaccaggaaaacncccctaagctgcagatgattggtccgtcctagtttaccaagacgtcgggccccagtcgagattccgcgtcagtggatcgtgggactagactttcacgtctaccacactcgacgcacgtcctgaccagacctagtaaagtntttagaccttaactttactattcgtcagcgagcgtacactactttccncttctacgtttcggacggtacggaaccgtaggtacggagacttaacggaaacgtaacgttgggtaacgtcgtacgaccaccgtacttccgttaggttaccttacgtaccg

SEQ ID NO: 57590 - DNA, 573 bp, Homo sapiens
  misc_feature: GYAE6OF02HHYV3.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaaccgtggttagtttggtatcagcaagaaacccaggaaaacgcccctaagctgcagatgattggtccgtccagtttccaagtagtcggggccccatcgagacttccgcgtcaggtgatcgtggacagatttcactctacaccatccagcagcctgcacgccgtagaagtattttgacctaacttacttattcgtacagcaggcgctaactacctttcccgcttccgtacgtttcccggcgggtaacggaccgtaagggtcggagtactacgaaaaccggtacgtaggtacggcgttacgactaacctacgttacgtcgttccgttctacccg

SEQ ID NO: 57591 - DNA, 556 bp, Homo sapiens
  misc_feature: GYAE6OF02HT2H9.18.23.C01.1.454.CMB.1.raw
  modified_base (379)..(379): a, c, t, g, unknown or other
  misc_feature (379)..(379): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcaatcagatattaaacctggttagttgtatcagacagaaaccaagaaacgcccctaagctgacagatgagttggtccgtcagtttccaagagtcggggcccagtcgagacttccgcgtacagtgatcgtggacagtattcactctcacatcagcngcctgacagtcctagaagtactttgacctaacttacttattgtactagcgtagaccgactaactaccgtttcccgcttccgtaaccgtttccgggacgggaaacgggacgtaaggtaggtagtacacgaaacgtacgtgtacggctacgaccacgtattccgtcgttcttacctacg

SEQ ID NO: 57592 - DNA, 609 bp, Homo sapiens
  misc_feature: GYAE6OF02IMCX1.18.23.C01.1.454.CMB.1.raw
  modified_base (279)..(279): a, c, t, g, unknown or other
  misc_feature (279)..(279): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaaggataattaaaactggttagttggtatcagcagaaaccaggaaaancccctaagctagcagatgattggtccgtcagtttccaaagatcggggaccccatcgagtacttccgcgttcagtggatcgtgggacagtatttccactctacaccatcagacagcctgcagcctagaagtatttgactaacttactaatttcgacagccgtaggccactaacctaaactttccccggtacttacctaaccgttttaccgggaccgggtaaccgggaacctaacggggtaggaacggtaactaaccgaaaaccgtaaccgttaggtacgggtacctaggtacccaccgtaagttccgttacggttaccttaccttaacccg

SEQ ID NO: 57593 - DNA, 1003 bp, Homo sapiens
  misc_feature: GYAE6OF02H9NNX.18.23.C01.1.454.CMB.1.raw
tcagtacgagtatgcacgaccggtgctcgatttagtacacgtgatttaggggtaggttgggggcgtaggagtaccagacccgaagtctaggacacggacgccgtatcggaccacggacggtccccgctcacgctctggactctgtctgctctggctccctaggtccaggatcgcgacatccacgacctcggacccgcgtccctttcgtcccgtaggtacgtcggccgttcgtcgtaacggtaacgaccggtagtaccggaaccaactacctaaacgttttaacggaacgggaactaaacgttcgaacggtaacttttaaacggtttaaaaacccgtgggtttaaacggttttacggtaacgtacccgtaacggaccgtaaacggtaaaaccccgtaagggtaaaacccgtacccccggttaaaggtccgtttacggtaaccgtaaggtaattacgggttaacggtttaccccggggttccccgttaaccgtaaacgggtttttcccgaaacggttaaccggttaccgggggtaccccctaagttaccgggtaacgttaccggtttacccgaccggttaaccgtacgggttaccgggtaacgttcccgggtacgggtaaaccgtacggttaactttacccgtacgttacccgtaaccgggtaaccgtaacggtaccggtaacgtaccggtacggtacccgtttacggttaccctaacggtacccgttaacggttaaacgtttaccgttttacgggaaccgtttaaaccttttaaccggtttaacgttacggttacgaacggttccgggtaaaggggtaccgtaaccgtttaaccggttaaccgggttccccaacgggttaccgttaacgggtttacccgacgggtaaaccggtacccgtaagggttaccgaaccgtaaccggtaacgaaccggtaaccgttccggtaaccgtacgtccgtaacccgtaccgtaccgttacccgtttcttaccgttaagtacccg

SEQ ID NO: 57594 - DNA, 623 bp, Homo sapiens
  misc_feature: GYAE6OF02JI2BI.18.23.C01.1.454.CMB.1.raw
  modified_base (277)..(277): a, c, t, g, unknown or other
  misc_feature (277)..(277): n is a, c, g, or t
  modified_base (410)..(410): a, c, t, g, unknown or other
  misc_feature (410)..(410): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatattaaaacctggttagttgtatcagcagaaaccaggaaaacncccctaagctgcagatgattggtccgtacagtttccaagagtcggggccccagtcgagtacttccgcgtcgagtggactcgtgggacagtatttcactctcaccatcagcacgcctgcacgccgtagaaagtntttacgaccttaactttaacgttatttcgtacgtagccgtaggccgtactaacgtaaccttttccccggacttaccgtacgtttccggggacgggtaacggtaccgtaagggttacgggaacgtaacgtaacccgaaaacggttaaccgtaggtacggaccgttacggaccctaaccgtacgttaccgttacggttacctttaccgttacccg

SEQ ID NO: 57595 - DNA, 530 bp, Homo sapiens
  misc_feature: GYAE6OF02JE7GE.18.23.C01.1.454.CMB.1.raw
  modified_base (510)..(510): a, c, t, g, unknown or other
  misc_feature (510)..(510): n is a, c, g, or t
  modified_base (525)..(525): a, c, t, g, unknown or other
  misc_feature (525)..(525): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtcaccttcttccgtgtctgcgtctgtaggagaccgagtcaccatcacttgtcgggcgaatcaggataattaaaacctggttagtttggtatcagcaagaaaaccaggaaaacgcccctaagctgcagatgtattggtccgtcctagtttccaagagtcggggccccagtcgagacttccgcgtcagtggatcgtgggacagtatttcacttctacacatcagcagcctgcacgcctagaagttatttcgactaacttactattgtcagcaggcgacactacttcccgctcacgtttcggcggaggaccgtaggtgagacgtacgaaacgacgtgtacgcncgacaccgtatcgtntctac

SEQ ID NO: 57596 - DNA, 561 bp, Homo sapiens
  misc_feature: GYAE6OF02IGUZ7.18.23.C01.1.454.CMB.1.raw
  modified_base (319)..(319): a, c, t, g, unknown or other
  misc_feature (319)..(319): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggataattaaaacctggttattggtatcagcaagaaccaaggaaaacgcccctaagctagcagatgattggtccgtcagtttccaagngtcggggccccagtcgagtacttccgcgtcgagtggatcgtgggacagtactttcactctcaccatcagcagcctgcagcctgaatatttcgactaacttactattgacagcaggcacacctaatttcccgctacgtaccgtttcggcgggtaacggaccgtaagggtcgagtacgtaccgaaaacggtaccgttggtacggtactcgaccaaccgtatccgttcgttacccttactacccg

SEQ ID NO: 57597 - DNA, 601 bp, Homo sapiens
  misc_feature: GYAE6OF02I58ZR.18.23.C01.1.454.CMB.1.raw
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttcccgtgtctgcgtctgtaggagaccgagtcaccatcacttggtcggcgaatcgaggtaatattaaaaccgtggttagtttggtatcagcaagaaaccaaggaaaacgcccctaaagctagcagatgattcggtccgtcacgtttcaagacgtcggggacccagtcgagtacttccgcgtacgaggtggatcgtggacagtatttcactctacnccatcagcacgctgcacgctgaagtntttacgactaacttactattgtcacgcgaggctacctactaacgttcccgcttaccgtacgttaccgggacgggtaacgggtaaccgaaggggtacggagtaacgtaaccggaaacggtaaccggtggtacggtaccgttgaccgtaacctacgttccgtactttaccgttacgttaacccg

SEQ ID NO: 57598 - DNA, 534 bp, Homo sapiens
  misc_feature: GYAE6OF02FL6JR.18.23.C01.1.454.CMB.1.raw
  modified_base (451)..(451): a, c, t, g, unknown or other
  misc_feature (451)..(451): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctagcagatgattggtccgtccagtttccaagatggggccccatcgagattccgcttcagtggatctgggacagatttcactctcacccatcagcagcctgcagcctagaagtatttagcaaacttacttattgttcagtcaggccgactacctaagtttcccncttcctacgtttccggcggtaggaccgaaggtcgagactacgaaacgactggtacgcgtagcactactcgtcgtcttactacg

SEQ ID NO: 57599 - DNA, 716 bp, Homo sapiens
  misc_feature: GYAE6OF02GL1GV.18.23.C01.1.454.CMB.1.raw
  modified_base (303)..(303): a, c, t, g, unknown or other
  misc_feature (303)..(303): n is a, c, g, or t
tcagtacgagtatgcacgaccggtgctcgatttagtacacgtgattagggattgggggcaggagtcagacccagtcaggacacagcatggacacgagggtccccgctcagctccgtggggctcctgctgctctggcctcccgaggttccagatgcgacatccagatcgacccacgttccccttcttccgtgtctgccgtctgtaggacgaccgagtccaccatcacgttggtcgggacaatcgaggaattaacttaaaaccgttggtttagtttggtatcagcaagaaaaccgaaggaaaacncccctaagctagcaagtataggattcgggtccctaccgtacgtttaccgaaaggtcgttccgggggaccccctagtaccggacgttacgttcccgcggttacgaggtgggattccggtaggggacaaggttactttccaaccgttctaccaacctagtacacgtacgacgtcctaggaccacgtccgtaagtacgttatttcgaacctaactttaacttagttgtacagacgacggactacctaacctaaccgtttccccgactttacccgtaccggttttccggggaaccgggtaacggtaaacccggtaagggtacggtacgtaacgtaacccggtaaaacggtaacgttcgggtacggacgttacggacccgtacgttaccgttccgttacgttaccgttaccttacccg

SEQ ID NO: 57600 - DNA, 712 bp, Homo sapiens
  misc_feature: GYAE6OF02H289I.18.23.C01.1.454.CMB.1.raw
  modified_base (334)..(334): a, c, t, g, unknown or other
  misc_feature (334)..(334): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccgtagtccagtatgcgacactccgagtatcgaccctaccgttccccttcgttccgtgtcgtcgtcgttctaggtaggacgaccgtagtaccacatactcgttcggcggacgtactacgaagtaattaaaccgttaaacgttggtttagttgtatcgagtacgaaacgaacgaaaggaaccacctaagctgacagtntagtagttcggtccttacgtacgttacaaggtcggtaccggaccctagtcgtagttaccgtccgtgtacgtaggtacgtacgttggacggtactaagtttacttaccaccttactaccaacgtacgtacgaacgtacgaccgtccgtacggaccgtacggtaccgtaagttaacgtttacgttacgtaacctttaaacgttttacgtacgtttcgacgtaggaccgtacggacctaacgtaaccgttacccgtttccgacctttacgttaccggttcgggacgggtaaccggaacgtaggtacgacgtaaccgtaacggtaacgtacggtcggtacgacgtaccgactataccgtcgttaccttcgtacgttaccccg

SEQ ID NO: 57601 - DNA, 646 bp, Homo sapiens
  misc_feature: GYAE6OF02HI4K2.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttggtcgggcgaatcgaggattaattaaaacctggtttagtttggtatcagcaagaaaccaaggaaaacgcccctaagctgacagatgagttcggtccgtccagtttccaagcgtcggggccccagtcgagtacttccgacgtcagtggatcgtagggactagtactttcactctacaccatcagcacgcctgcacgccgtagaagttactttacgacttaaactttacttagtttcgtacacgtacgacggacctacctaacgtaacctttccccggacttccgttaacccggttttcggggaccggggtaaacgggtaacccgtaaggggttacggaacggtaaccgtaaccgaaaacggtaccgttcgggtaccggtaccgttacgacctaaccgtacgttccgtacgtttccttaccgtaacccg

SEQ ID NO: 57602 - DNA, 517 bp, Homo sapiens
  misc_feature: GYAE6OF02FXNSY.18.23.C01.1.454.CMB.1.raw
  modified_base (429)..(429): a, c, t, g, unknown or other
  misc_feature (429)..(429): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatcggggccccatcgagattccgcgtcagtggatctgggacagatttcactctcaccatcagcagcctgcagcctgaagtatttgactaacttacttattgtcagcaggcncactaactttcccgcttctacgtttcggcggagggaccgaaggtggagatacgaaacgactggtgctgacaccatctcgttcttctac

SEQ ID NO: 57603 - DNA, 560 bp, Homo sapiens
  misc_feature: GYAE6OF02HV3AB.18.23.C01.1.454.CMB.1.raw
  modified_base (447)..(447): a, c, t, g, unknown or other
  misc_feature (447)..(447): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccattccccttcttccgtgtctgcgtctgtaggagaccgagtcaccatcacttgtcgggcaatcaggatattaaaacctggttagtttggtatcagacagaaaccaggaaaacgcccctaaagctgcagatgattcggtccgtcctagtttccaagacgtcggggccccatcgagacttccgcgtcagtggatcgtgggacagtatttcactcctacaccatcagcacgcctgccagcctagaacgttatttcgactaacttacttattcgctagcaggcncaactaacttcccgctctaccgtttcggcggacggaccgtaaggtcggagagtaccgaaacggtaactggtcggtactcgacctacctacgttaccttcggttcttcgtaccg

SEQ ID NO: 57604 - DNA, 593 bp, Homo sapiens
  misc_feature: GYAE6OF02HAUF9.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaaccaggaaaacgcccctaagctgcagatgattggccgttccagtttccaagactggggccccatcgagattccgcgtcagtggatcgtgggacagtactttcactctcaaccatcacgcacgcctgacacgccgtagtaaacgtagttttcgacctaaactttaaccttagtttcgtacgacgcgacggcgacaaccgtaactttccccgcttcgttacgtttccgggcggtacgggaacccgagggtacggagtaactaaccgaaacggaacgttgggtacggccgttagaccctaccgtattccgttcgttcctacttacccg

SEQ ID NO: 57605 - DNA, 551 bp, Homo sapiens
  misc_feature: GYAE6OF02I76DR.18.23.C01.1.454.CMB.1.raw
  modified_base (340)..(340): a, c, t, g, unknown or other
  misc_feature (340)..(340): n is a, c, g, or t
  modified_base (389)..(389): a, c, t, g, unknown or other
  misc_feature (389)..(389): n is a, c, g, or t
  modified_base (486)..(486): a, c, t, g, unknown or other
  misc_feature (486)..(486): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagtttggtatcagcagaaaccaggaaaacgcccctaagctgcagatgattggtccgtcctagttccaagactcgggcccatcgagattccgngtcagtggatcgtgggactagtactttcactcacacatcaacgcagccngcgacgctagaagtatttcgactaacttacttattcgtacagcgaggcacactaactttccgctctacgttcggacggtacggtaacgaggtcgganacgtacgaaaacgtacgtggtcggtacgtacgaccgtaactacgttcgttcgtaccttatacccg

SEQ ID NO: 57606 - DNA, 620 bp, Homo sapiens
  misc_feature: GYAE6OF02JQA1Z.18.23.C01.1.454.CMB.1.raw
tcagtacgagtatgcacgaccggtgctcgatttagtacacgtgattagggagttgggggcaggagtcagacccagtcaggacacagcatggacacgagggtccccgctcagctcctggggctcctgctgctctggctcccaggttccagatgcgacatccagatgacccagtcccttcttccgtgtctgcgtctgtaggagaccgagtcaccatcacttggtcgggcgaatcgaggaacttaattaaaaccgtggttagttggtatctacgacaagaaaccaaggaaaacgacccctaaagactaggacaagatagattcggtaccgtccgtacgtttccaagtacgtacgggaccccagtcgagtacgtccgcgtacgaggtcgatacgtggaacgtagtactttcacctctaccaacctactcaagcacgtcctgcacgctagtaattatttagactaacttattattcggtactacgacgtacggaccgacctaactaccgttacccgtctaccgttaccgttcggaccggacggaaccgtagggtaggacgtagtaaccgaaccggtaagtcggtacggacttacgacctacgtactcgtacgtacttactacccg

SEQ ID NO: 57607 - DNA, 613 bp, Homo sapiens
  misc_feature: GYAE6OF02G7MJS.18.23.C01.1.454.CMB.1.raw
  modified_base (357)..(357): a, c, t, g, unknown or other
  misc_feature (357)..(357): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagacgagtcaccatcacttgtcggcaatcgaggtatattaaaacgtggttagtttggtatcagtcagaaaccaaggaaacgccctaagctgcagatgattggtcctctagttccaagtagtcggggacccagtcgagtactccgcgtcagtcgatcgnggacagtacttcactctacactatcagcacgtcctgcacgcctagtaatgtttacgactaacttacttattcgtacgagaccgaggaccgctaacctaaccgttttcccggctttacccgttaccgtttacgggaccggggtaaacggaccggtaagggtcgggtaacgtaactaaccggtaaaaacggtacgttagggtaccgtacgttaggacccgtaaccgtaagttccgtttcgttaccttacgttaacccg

SEQ ID NO: 57608 - DNA, 598 bp, Homo sapiens
  misc_feature: GYAE6OF02HSNHQ.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcaagaaaccaaggaaaacgcccctaagctagcagatagattcggtccgtctagttttccaagacgtcggggaccccagtcgagacttcccgcgtcagtggatcgtggactagtattttaccgacttcctacacctagtcagcagcctagcacgcctagtaagtactttgactaactttactatttgactagcaggcacaccttaacttcccgacttccgtacgtttcgggccgggaacgggtaccgtaagggtcggacgtaagtaaccgaaaacggttaccgtaggtcggtcctacggtacaacccgtagttaccgttacgtttccttacgtacc

SEQ ID NO: 57609 - DNA, 790 bp, Homo sapiens
  misc_feature: GYAE6OF02FQUTH.18.23.C01.1.454.CMB.1.raw
tcagtacgagtatgcacgaccggtgctcgatttagtacacgtgattagggattgggggcgaggagtcagacccagtcaggacacagcatggacacggacgggtcccgcctcagcctccgtgggctcctcgctcgctctggcctcccgtacggttccagatgcgacactccagatcgacccacgttccccttcttccgtgtctgcgtctaggtaggacgaccgagtccaccatctacgttggtccgggacaatcgaaggtattaaacttaaaaccgtggtttagtttggtactcgagacaaacgaaaccgaaaggaaaaccgtaccccgtaagctgacgagtatggtagttcggtcccgtcctacgttaccgagacgtccggggccctatcgagtacgttccgcgtacgaggtggactcggtagggaacctagttactttaccacgtcctacacctattccgaacgcgtacgtcctcgacgacgtcccgttagtaacgtttacgtttcgaacccgttaacctttaacgttacgtttacgttacgaaccgtcgtaaccggaccgtaaccgtaacccgttaaacccgttttccccgtaccgtttacccgttaccgggttttacccggggacccggggttaaaccgggtaaacccggtaacgggggttacgggtaacggtaaccgttaaacccggaaaacccgggttacccgttacggggttaccggaccggttaccgacccgtaacccgttaacgtttacccggttacggttttacccttacgtttaaccccg

SEQ ID NO: 57610 - DNA, 630 bp, Homo sapiens
  misc_feature: GYAE6OF02GA2UW.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatgacccagtccccttcttccgtgtctgcgtctgtaggagaccgagtcaccatcacttgtcggcgaatcaggatattaaacctggttagttgtatcagcagaaaccaggaaaacgcccctaagctgcagatgagttcggtccgtacctagtttccaaggtacgtcggggccccagtcgagtacttccgcgtcaggtgactcgtagggactagtactttcacgtctaccacctatccagcacgtcctgacacgtcctagtaagttactttacgacctaacttacgttattacgtacgagacgtacggaccgtactaaccgtaacctttcccgacttaccgtacggtttccgggacgggtaacgggaaccgtaacgggtacggtacgtaacgtaaccgtaaaacggtacgttacgggtacggtaccgtacggacctaccgtaccgttccgttcgttaccttaccgttacccg

SEQ ID NO: 57611 - DNA, 657 bp, Homo sapiens
  misc_feature: GYAE6OF02IIOZS.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttggtcgggcaatcaggtataattaaaacctggttagtttggtatcagacaagaaaccgaaggaaaacgcccctaagctgacagatgattcggtccgtactagtttccaagtcgtcggggccccagtcgagacttccgcgtgaggtggactcgtagggactagtactttccactctaccaacctataccacgtaccacgtcctgcgacgcctagtaaacgttatttacgacttaaactttacttagtttacgtactacgtacgacggaccgtacaaccgttaacgtttccccgtacttaccgtaccggttttacgggacgggtaacgggtaaccgtaaggggtacggaacggtaacgtaccgaaaacggtaccggtagggttacgggtaccgtacggtaccctaaccgtacgttaccgttcggttacccttacgttaccc

SEQ ID NO: 57612 - DNA, 711 bp, Homo sapiens
  misc_feature: GYAE6OF02HORXI.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggacgaccgagtcaccatcacttggtcggcaatcgaggattaattaaacctggttagtttgtatcagcaagaaaccaggaaaacgcccctaagctgcagatgacgttggtccgtacctagtttaccaagtacgtcggggccccagtcgagtacttccgcgtgagtggatgtaggactagtagtttcactactaccacctactcagcagtccctagcacgtccctaggtaactagtttacgaaccttaacgtttaacttacgtttcgtacgtacgaccgtacgggtacccgtaccgtaaaccgttaaccgttttaccccccgatttacccggttaaccgtttttccgggggaacccggggttaaaccggggtaaaccccggttaaagggggtacgggtaacggtaacggtttaacccggaaaaaccggggttaaccgttcggggtacgggtacccgttacggacccgtaacccgttaaggtttccccgttacggttaccctttaccgttaccccg

SEQ ID NO: 57613 - DNA, 520 bp, Homo sapiens
  misc_feature: GYAE6OF02HJSU6.18.23.C01.1.454.CMB.1.raw
  modified_base (517)..(517): a, c, t, g, unknown or other
  misc_feature (517)..(517): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcaagaaaccaggaaaagcccctaagctgcagatgattggtccgtccagtttccaagatggggccccatcgagattccgcgtcagtggatctgggacagatttcactctcacatcagcagcctgcagcctagaagtattttgactaacttacttatttcgtctagcaggcgacactaactttcccgctcctacgtttcggcggaggaccgaaggtcgagactacgaaacgactgtcgctcgacacatcgtatctntac

SEQ ID NO: 57614 - DNA, 657 bp, Homo sapiens
  misc_feature: GYAE6OF02G1M67.18.23.C01.1.454.CMB.1.raw
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
  modified_base (475)..(475): a, c, t, g, unknown or other
  misc_feature (475)..(475): n is a, c, g, or t
tcagtacgagtatgcacgaccggtgctcgatttagtacacgtgattagggagttgggggcgaggaggtcagacccagtcaggacacagcatggacacgagggtccccggctcagctcctggggctcctgctgctctggctcccaggttccagatgcgacatccagatgacccagtccccttcttccgtgtctgcgtctgtagganaccgagtcaccatcacttggtcgggcaaatcaggtataattaaaacctggtttagtttggttatcagcaagaaaccgaaggaaaactaccccaagctagcagatnatggtccgtcagtttccaagatcggggccccaattcgaacgtacgttacgccggttcagtggacttcgaggtaacgaggtaactttcactactaccactactacacgacacgcctagcacgcttaacgaagtactttagaccttaacgttattaactttcgttanacgtacgtaacggccgaaccttacgaaccttttacccggtacttaccgttaaccgtttccgggaccgtaaacggggacccttaaagggggcgtaaggaacttaacgaaaacccggtaaacttcgggttaacggtcgttaaggacccttaaccaacggtttactcggttcccgttactaaccg

SEQ ID NO: 57615 - DNA, 537 bp, Homo sapiens
  misc_feature: GYAE6OF02G701P.18.23.C01.1.454.CMB.1.raw
  modified_base (438)..(438): a, c, t, g, unknown or other
  misc_feature (438)..(438): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaaacctggttagttggtatcagcagaaaccaggaaaagcccctaaagctgcagatgattggtccgtccagtttccaagtatcgggggccccagtcgagattccgcgtcagtggatcgtgggacagtactttcactctcaccatcagcagccctgcagcctagaagtatttgactaactttacttattgtcagacaggcncaactactttccgcttacctcgtttcggcggtacggaccgaagggtgagatacgaaacgtactggtacgctagaccacgtatccgtgtccttacgtacc

SEQ ID NO: 57616 - DNA, 525 bp, Homo sapiens
  misc_feature: GYAE6OF02F9JM8.18.23.C01.1.454.CMB.1.raw
  modified_base (279)..(279): a, c, t, g, unknown or other
  misc_feature (279)..(279): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (502)..(502): a, c, t, g, unknown or other
  misc_feature (502)..(502): n is a, c, g, or t
  modified_base (521)..(521): a, c, t, g, unknown or other
  misc_feature (521)..(521): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaanccccctaagctgcagatgattggtccgtccagtttccaagagtcggggccccagtcgagtattccgcgtcagtggatcgtgggacagatttcactctcaccatcagcagcctgcagcctgaagtatttcgactaacttacttattgtcngcaggcncactactttcccgctcctacgtttcggacggacgggaccgtaggtggagactacgaaacggactggngtctgcactatctgtcttntacc

SEQ ID NO: 57617 - DNA, 746 bp, Homo sapiens
  misc_feature: GYAE6OF02GO8L9.18.23.C01.1.454.CMB.1.raw
  modified_base (347)..(347): a, c, t, g, unknown or other
  misc_feature (347)..(347): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcaatcagatattaaaactggttagttgatcagcagaaacaggaaaacgcccctaaagctgacagatgtattcggtacctctagtttaccaagtacgtcggggacccagtcgagtacttcccgngtcaggtaggatcgtagggactaggtactttcactctaccaccataccagtccaacgtcctacgacacgtccctaggtaaagttacgtttacgacctaaacttttacgttaattttacggtacgtaagaccgaacgggtaccgtaccgtaaacgtttaaaccttttcccccggacgtttacccgttaaccgggtttttaccggggaacccggggtaaaccgggtaaaccggtaaacggggtttacgggaaccgttaacggttaaaccccggtaaaaaacgggttaacccggtttcggggttaaaccgggttacccgtttaacgggaacccccgtttaaaccccgttaacggttttaccccggtttacccgttttacccgttaacccgtttaacccccgg

SEQ ID NO: 57618 - DNA, 556 bp, Homo sapiens
  misc_feature: GYAE6OF02FONWV.18.23.C01.1.454.CMB.1.raw
  modified_base (178)..(178): a, c, t, g, unknown or other
  misc_feature (178)..(178): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttnttccgtgtctgcgtctgtaggagaccgagtcaccatcacttgtcggcgaatcaggatattaaaacctggttagttggtatcagcagaaaccaggaaaacgcccctaaagctgcagatgattggtccgtccagtttccaagtatcggggccccatcgagacttccgcgtcagtggatcgtggacagtatttcactctcaccatcagcagcctgcacgcctagaagtatttcgactaaacttacttaattcgttacagcaggcgacgactaacgtttcccgcttctaccgttttcgggcggaacgggtaccgaagggtggagacgtacgaaacggtaactcggtaggctacgtacgacctatcgtacgttcttactaccg

SEQ ID NO: 57619 - DNA, 750 bp, Homo sapiens
  misc_feature: GYAE6OF02HNFZL.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacatccagatgacccacgtccccttcttccgtgtctgctctgtaggacgaccgagtcaccatcacgttggtcgggacgaatcgaaggtaacttaaacgttaaaaaccgtgggtttaagttttggtaattccgagacaaacgaaaaccgaaacggaaaaccgacccctaaagcctagacagtataggtagttcggtacccgttacgtaacgtttaccaaaggtcggtccggggtaccccaagtacgaacgtacgttccggtaccgtacgaaggtcggagtcgtagggactagtacttccactcctaccaaccactacgacgacgacgtccgtacgccgtacgtacttaagtaagtttacgtttcgaacctaactttaacgttacgttcgtaacgacggtacgtacggaccgtaactaaccgttaccctttacccgtaccgttacccgttaaccggtttaccggggaaccgggtaaacggaaccggtaacggggtacggtaaggtaaccgtaaaccggtaaacgtacggtttacggtaccggtacgtcggtaacctacgtaacccgtttcgttaacggtttaccttacctttaccccg

SEQ ID NO: 57620 - DNA, 648 bp, Homo sapiens
  misc_feature: GYAE6OF02G6HQ5.18.23.C01.1.454.CMB.1.raw
  modified_base (272)..(272): a, c, t, g, unknown or other
  misc_feature (272)..(272): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcaatcaggatattaaactggttagttgatcagcagaaacaggaaacncccctaagctgacagatgattcggtccgtcctagtttccaagagtcgggccccagtcgagtacttccgcgtcagtggatcgtagggacagtactttacactctacacctatacacgcacgccgtgaccgacgtaccctaggtaaagttacttttacgaaccttaaactttacttaagtttcgtacagcgtacggacctaccgtaacttaaccgtttccccgtacgttacccgttaccgttttaccgggaaccgggtaacgggtaaccgtaacgggtacgggaacgtaacgtaacccgtaaaacggtacgttacgggtacggtacccgttacggaaccctacccgttaacgttccgttacgttaccttacctacccg

SEQ ID NO: 57621 - DNA, 727 bp, Homo sapiens
  misc_feature: GYAE6OF02GX87R.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcaagaaaccaaggaaaacgcccctaagctgcagatgagttcggtccgtcctagtttcccaagtacgtcgggggaccccagtcgagtacttcccgcgtcaaggtggacttcgtagggactagtactttccgacttcctcaccaatcagcacgtcctgacctacgccgtaggtaagttactttagaccgttaactttaacttaacgtttcgttaacacgggtacgtaccgggtaccgtaccgtaaaccgttaaccgtttttcccccgtacctttacccggttaacccgttttttaccccgggggaaccggggttaaccggggaaaccccggttaagggggttaccgggtaacgggttaaccgttaaccggtaaaacccgggtaaaccgtttcggggttaaccgggtcgttacgggacccctaaccgtacgtttacccgttacggtttaccgtttaccttaccccgg

SEQ ID NO: 57622 - DNA, 631 bp, Homo sapiens
  misc_feature: GYAE6OF02GSY3J.18.23.C01.1.454.CMB.1.raw
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggcctcccaggttccagatgcgacatccagatcgaccctacgttccccttcttccgtgtctgcgtctgtaggacgaccgagtccaccatccacttggtcgggacgaatcgaaggtattaactttaaaaccgttggtttaagtttaggtatcgagacaagaaaaccgaaggaaaaccgcccctaagctgacagatgagttcggtcctacctacgttacaagacgtccgggacccagtcgagtcttccgcgtcaggtggactcgtggactagttacttcactctacacatcancacgcctnccgagtcctagtattcgtttacgaacttaacttattagttcgtacgagcgtacggtccaacttaaccgttaaccgtttcccgcgttaccgttacgttaccggggacggaacgggtaacgtaagggtcggactaacgtacgaaaccggttatcgggtacgtcgtacggacctacgtacttccgttcttaccttactacccg

SEQ ID NO: 57623 - DNA, 683 bp, Homo sapiens
  misc_feature: GYAE6OF02IFZ2F.18.23.C01.1.454.CMB.1.raw
  modified_base (284)..(284): a, c, t, g, unknown or other
  misc_feature (284)..(284): n is a, c, g, or t
  modified_base (370)..(370): a, c, t, g, unknown or other
  misc_feature (370)..(370): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgcgggacgaatcaggataattaaaacctggttagtttggtatcagacaagaaaccaaggaaaacnccccgtaagctgcagatgtattcgggtcctcctagtttccaagcgtcggggaccccagtcgagtacttccggcgtcagtggatcgngggacagtactttacgacctctaccaacctactaccgagccacgccgttcgacctaggcccttaaggtaaagttacgttttacggaaccttaaacgtttactttaacgtttaggtacctaggtaccgacgggaccgtactaaccgttaaaccttttccccgacgtttaccgttaccgttttccggggaccgggaacgggtaacccgtaaagggggtcggtaacggaactaaaccggtaaaacgtaaccggttacggtacggacttacggacctaacccgtaaccgttcgtttcggttaccttcccgtaacccg

SEQ ID NO: 57624 - DNA, 605 bp, Homo sapiens
  misc_feature: GYAE6OF02GBO3C.18.23.C01.1.454.CMB.1.raw
  modified_base (280)..(280): a, c, t, g, unknown or other
  misc_feature (280)..(280): n is a, c, g, or t
  modified_base (413)..(413): a, c, t, g, unknown or other
  misc_feature (413)..(413): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatcgacccacgtccccttcttccgtgtctgcgtctgtaggagaccgagtcaccatcacttgcgggcaatcaggatattaaaaccgtggttagttggtatcagcaagaaaccaaggaaacncccctaagctgcagatgtagttcggtccgtacctaggtttaccaaggtacgtcggggcccctagtcgagtacttccgcgtcaggtggactcgtgggactagtactttcactctacacatcagcacgcctgacncgtactagattatttacgactaacttacttattgtacgagcgtacggacactaacgtacctttcccgacttccgttacgttccggggacggacgggtaaccgtaagggtggtacgtacgtaaccgaaacggtacggttcgggtacggtactacggacctaccgtacgttacttcggttaccttacttacccg

SEQ ID NO: 57625 - DNA, 551 bp, Homo sapiens
  misc_feature: GYAE6OF02I2F1E.18.23.C01.1.454.CMB.1.raw
  modified_base (462)..(462): a, c, t, g, unknown or other
  misc_feature (462)..(462): n is a, c, g, or t
  modified_base (536)..(536): a, c, t, g, unknown or other
  misc_feature (536)..(536): n is a, c, g, or t
tcagtacgagtatgcacgaccggtgctcgatttagtacacgtgattagggagttgggggcaggagtcagacccagtcaggacacagcatggacacgagggtcccgctcagctcctgggctcctgctgctctggctcccaggttccagatgcgacatccagatgacccagtccccttcttccgtgtctgcgtctgtaggagaccgagtcaccatcacttgtcggcaatcaggatattaaaacctggttagtttggtatcagcaagaaaccaggaaaagcccctaagctgcagatgattggtccgtccagtttaccaagacgtcggggaccccagtccgagtacttccgcgtcagtggatcgtggacagtattcactctcaccatcagcacgcctgacacgcctagaaagttatttagactaactttactattgtacagcgtaggcgacacttaacgtttcccnctacctacgtttcgggcggtacgggaaccgtaagggtggagacgtaccgaaacgtaactggtaggctcgcacgngttctcgtcttctac

SEQ ID NO: 57626 - DNA, 667 bp, Homo sapiens
  misc_feature: GYAE6OF02JTGUN.18.23.C01.1.454.CMB.1.raw
  modified_base (285)..(285): a, c, t, g, unknown or other
  misc_feature (285)..(285): n is a, c, g, or t
  modified_base (364)..(364): a, c, t, g, unknown or other
  misc_feature (364)..(364): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgctctagtaggagaccgagtccaccatcacgttcgtcgggcaatcaggataattaaaccgtggttaagttggtatctagcaagaaaccaaggaaacncccctaagctagcagatgattcggtaccgtcctagttaccaagtacgtcggggccccagtacggagtaccgttcccggngtacgaggttggaacttcgggtacggaactacgtacttttccgaacttccgtaccaaccctagtcgaacgcacgtccctacggcctaacggtacccgtaaggtaaacgttacgtttacgaaccttaaacgtttacttaactttcgtacgtagtccgacggtaccgtacgtactaacccttccgtacttaccgttaccggtttcggaccgggtaacggtaccggtaaggtggacgacgtaacggtaaccggtaacgtggtacggacgttacggacctacctactcgttctaccgttacgtaccc

SEQ ID NO: 57627 - DNA, 620 bp, Homo sapiens
  misc_feature: GYAE6OF02GP1BF.18.23.C01.1.454.CMB.1.raw
  modified_base (282)..(282): a, c, t, g, unknown or other
  misc_feature (282)..(282): n is a, c, g, or t
  modified_base (382)..(382): a, c, t, g, unknown or other
  misc_feature (382)..(382): n is a, c, g, or t
  modified_base (422)..(422): a, c, t, g, unknown or other
  misc_feature (422)..(422): n is a, c, g, or t
tcagtacgagtatgcacgaccggtgctcgatttagtacacgtgattagggattgggggcaggagtcagacccagtcaggacacagcatggacacgaggtccccgctcagctcctgggctcctgctgctctggctcccaggttccagatgcgacatccagatgacccagtccccttcttccgtgtctgcgtctgtaggagaccgagtcaccgatcgacgttgtcggacgaatcaggatattaaaaccgtggttagttgtatcagcaagaaaccaaggaaaacnccccgtaaagctagcaagatgacttggtccgtaccgtaggtttacccaaggtacgtacggggcccctaagtccggagtacttccgcgtacagtggatcgnggactagtctttacacttctacactatcaacgcacgtccngacagccctagaagttatttacgaccttaaacgtacgttaattcgtacgaacgtctaagggccaacctacgttaaccgtttcccgacttcgtaaccgtttcgggaccgggtaacggaccgaaggtagacgtagtaaccgaaacggtacgttggtagaccgtaggacctaaccgtgtaccgtcgttaccgtactacccg

SEQ ID NO: 57628 - DNA, 690 bp, Homo sapiens
  misc_feature: GYAE6OF02I0PB5.18.23.C01.1.454.CMB.1.raw
  modified_base (285)..(285): a, c, t, g, unknown or other
  misc_feature (285)..(285): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagttccccttcttccgtgtctgtcgtctgtaggagaccgagtcaccatcacttgtcggacgaatcaggataataaaaccgtggttattggtatcagacaagaaaccaaggaaaacncccctaagctgacagatgattcggtaccgtcctagtttaccaaggatcggggaccccagtcgagtacttccgcgtactaggtagactcggtcgggaactagtaactttccactctaccacctagtaccagacaacggtccctaggctaacggacccgttagaaacgttattttacgaaccttaaactttaacttatttcgacgtaagcgtaacgggcctaactaaccgttaaccgtttccccgacgtttacctaccgtttacgggaccgggtaaagggtaacccgtaaaggggttcggtaaacgtaacgttaacccggtaaaaaccggttaacgttacgggtacgttaaccgtcgggtaacctacccgttaacgttccgtttaaccgtactttaccgttaacccg

SEQ ID NO: 57629 - DNA, 688 bp, Homo sapiens
  misc_feature: GYAE6OF02FJRSW.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagtccccttcttccgtgtctgcgtctgtaggagaccgagtccaccatcacttggtcgggacgaatcaggtaataattaaaaccgttgggtttagtttggtactcgagacaagaaaaccgaaggaaaacgccccgtaagctgcagatgagttggtccgtcctagtttaccgaaggtcgtccgggacccctagtcggactacgttccgccgttacgacgttggtactcgtaggactaggtactttacacctctaccacctactacacgtacacgccgtcgcgacgtaccgtagtaaacgttacgtttacgaaccttaacgtttaacgttaagtttacgttacgtacgacgtacggtccgtacgtaaccgttaccgtttcccgtaccgtagttacccccccccgttagggtaccggacgggtaaccggtaacggtacggtacgtaacgtaacgtaaacggaaccgttaggtacggtacgtcgtaccgtacgtacgttacgttaccgttacgttcgttacccg

SEQ ID NO: 57630 - DNA, 649 bp, Homo sapiens
  misc_feature: GYAE6OF02FOJ4N.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgtcgtctgtaggagaccgagtcaccatcacttgtcgggcgaatcgagataattaaaaccgttggtttagtttggtatcagcaagaaaccaaggaaaacgcccctaagctgcagatgtagttcggtccgttcgtacgtttaccaagtacgtcggggcccctagtccgagtacgttccgcgtacgaggtgtatcgtagggaactagtactttcactctacacctatccgagcgtacgccgtgaccgacgccgtagtaagttacgtttacgtactaaacctttacttagtttacgtacgtacgccgtaaggccgtactaccttaacgtttcccgtacttacgtaccggttttaccgggaccgggtacgggaaccgtaaggggtacggtagtaacgtaccgaaaacggtcgttaggtacggtacgtacggacctaacgtacgttcgttcgttacttacgttaccc

SEQ ID NO: 57631 - DNA, 670 bp, Homo sapiens
  misc_feature: GYAE6OF02F2J5M.18.23.C01.1.454.CMB.1.raw
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccacgtccccttcttccgtgtctgcgtctgtaggagaccgagtcaccatcacttggtcgggcgaatcaggataattaaaacctggttagttgtatcagcaagaaaccaaggaaaacgcccctaagctagacagatgagttcggtcccgtacgtacggttaccaaggtagtccggggacccagtcgagtacgttccgcgtcgaggtaggtactcgtagggactagtacttcactctccaacatcgancacgcctncgacgtcctagtaacgttactttacgaaccttaactttaacttacttcgtacaggccgaggccgactaacctacctttcccgtacttaccgtaccggtttacgggaccgggtaacgggtaaccggtaagggtacgggtaacgtaaccggtaacggtaaaaccggtaacggttacggttaccgggtacgttaccggtacccgtaacccgttaacgtttcccggttaccggtttaccttacccgttaccccg

SEQ ID NO: 57632 - DNA, 612 bp, Homo sapiens
  misc_feature: GYAE6OF02FPGYG.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcacatcacttgtcggcgaatcaggatattaaaacctggttagttgtatcagcagaacaggaaacgccctaagctgcagatgtattggtccgtcctagtttccaagactcggggccccagtcgagtacttccgcgtcaggtggatcgtggacagtactttcactcctaccaccatacagcacgcctgcacgtcctagaagtactttgaccttaaaccttattaattcgtactacgacgacggcgacctactacgtttccccggacttacccgttaccggtttccggggaccggtaaccgggtaaccgtaaggggtcgggtagtacgtaaccgtaaaccgggtaacgtcgggttacggtccgtacgaccgtaccgtacgttccgtcggttaccttaccggttaccc

SEQ ID NO: 57633 - DNA, 546 bp, Homo sapiens
  misc_feature: GYAE6OF02GYQEC.18.23.C01.1.454.CMB.1.raw
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
  modified_base (527)..(527): a, c, t, g, unknown or other
  misc_feature (527)..(527): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctggtaggagaccgagtcaccatcacttgtcgggcgaatcaggattattaaaacctggttagttggtatcagcagaaaccaggaaaacgcccctaagctgcagatgattggtccgtcctagtttccaagtcgtcggggccccagtcgagattcccgcgtcagtggatcgtgggacagtatttcactctcaccatcncgcacgtccngcacgctaggaagtatttcgacctaactttactatttgtacagcaggcacactacttcccgctcgtacgtttcggacggacggaccgtagggtcggagactacgaaacgtacgtggtgtcgtacgaccncgtatcgtcttctactccg

SEQ ID NO: 57634 - DNA, 689 bp, Homo sapiens
  misc_feature: GYAE6OF02HSXK5.18.23.C01.1.454.CMB.1.raw
  modified_base (285)..(285): a, c, t, g, unknown or other
  misc_feature (285)..(285): n is a, c, g, or t
  modified_base (379)..(379): a, c, t, g, unknown or other
  misc_feature (379)..(379): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccgggttccagatgcgacatccagatgacccagtccccttcttccgtgtctgcgtctgtaggagaccgagtcacatcacttggtcgggacgaatcaggattaattaaaacctggtttaagttggtatcagcaagaaaccaggaaaacnccctaagctagcagatgtattcggtccgtcctagtttaccgaagacgtcggggacccctagtaccggacgtacttacccgcgtacaggttaggntcgtacgggaacagtaactttccgaaccttacgtaccgaaaccctagtacctacgacctaacgccgttacgccgtaacgtccgtaaggtaaacgtgttttacgaccttaaaccttaacgttagttagttaccgagtactacggcctaccgtactaacgttttcccgacttaccttacggttaccgggaccggtaacggggaaccctaaaggggttccggaagtaccgtaacccgaaaaggtaccgttaggtcggtaactaccggacctaaccgtattacccgttggttaacccttacgtccttaaccccg

SEQ ID NO: 57635 - DNA, 767 bp, Homo sapiens
  misc_feature: GYAE6OF02IAMYF.18.23.C01.1.454.CMB.1.raw
  modified_base (205)..(205): a, c, t, g, unknown or other
  misc_feature (205)..(205): n is a, c, g, or t
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatcgacccagtccccttctccgtgtctgcgtctgtaggagaccgngtcacatcacttggcggacaatcgaggtataacttaaacgtggtttagttggtatcagacaagaaacgaagaaacgccctaagctagacgaagatgtaacgttcggtacccgtaccgtacgtttaccgaagtacggtccgggaccccctagtaccgtacgtacgttccggacgtcgtaaggtcggtagttcggtacgggaactacggttaactttaccgtaccttccgtaacctacccgagttaccgacggtacgtaccgtacccgttaccggtacccgtaacgttcccgttaaaggttaacggttacgttttacggaaaccgtttaaaccgtttaaccgtttacgtttacggttaacgaccgggtacgtaacgggtaccgtaccgttaacccgttaaccgtttcccgtaccgttaccgttaccggtttaccggggaaccgggtaaccggtaaaccggtaacgggtaacggtaacgtaacggtaaccgtaaaccggttaacggtagggtaccggtacgtacgacctaacgttccgttacgttcggttaccctacgttacccg

SEQ ID NO: 57636 - DNA, 709 bp, Homo sapiens
  misc_feature: GYAE6OF02I5BMW.18.23.C01.1.454.CMB.1.raw
  modified_base (647)..(647): a, c, t, g, unknown or other
  misc_feature (647)..(647): n is a, c, g, or t
  modified_base (672)..(672): a, c, t, g, unknown or other
  misc_feature (672)..(672): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgaccctacgtccccttcttcgtgtctgcgtctgtaggagaccgagtcacctatccacgttgtacgggactaatacgaaggtacttaaacgtttaaaaccgttggtttaaggtttaggtactacgagacaacgtaaaaccgaaggtaaaaccgtaccccgtaagccaggtacaggtaactaggttagttacggtcccgttaccgtaacgtttaccgaaaggtacgtccggggacccctagtaccggtacgtaccgttaccgcggttaccgtaggtacggtaacgttcggtacgggaactagtaactttcgaaccgttactaccactactacgagtccgacgtccagccgtaacgtccctaggttaaacgttcggtttacaaccgttaaacctttacgttaagtttacgtacgaagtccgtacggacctacgtaacctaccgttccgacttccgtaacgttcgggaacgtacggaacgagtagtntaacgtacggaacgtatcggtacgngttaacgcctacgtcttacggttcttcctattacccg

SEQ ID NO: 57637 - DNA, 656 bp, Homo sapiens
  misc_feature: GYAE6OF02HR7J0.18.23.C01.1.454.CMB.1.raw
  modified_base (456)..(456): a, c, t, g, unknown or other
  misc_feature (456)..(456): n is a, c, g, or t
  modified_base (630)..(630): a, c, t, g, unknown or other
  misc_feature (630)..(630): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgaccccagtccccttcttccgtgtctgcgtactggtaggagaccgagtcaccatcacgttgtcgggcaatcaggattataaaacctggttagttgtatcagcaagaaaccaaggaaaacgccccaagctgacagatcgattggtccgtccagtttaccaagactcggggccccatcggatacgttccgacgttcgaaggtgggactcgtagggactaaacggtacttttaccgaacttcctaccaaccgtacttacgacgtacaacgcccttgaccacgccgtagtaaacgtntttacggacctaaacgtttactatttacggtacagtaccgtacgggacctaccgtaaaccgttaaacgtttccccgtacttccgtaaccgtttttaccggggacgggtaacgggaaacggtaacggggtaggaatacggtaacgaaacggtaccgtaggtacggcgttacgacncctagttctacgttccgttctaaccg

SEQ ID NO: 57638 - DNA, 667 bp, Homo sapiens
  misc_feature: GYAE6OF02FL8W7.18.23.C01.1.454.CMB.1.raw
tcagtacgagtatgcacgaccggtgctcgatttagtacacgtgattagggtagtttggggggggacaggagtcagtacccagtcaggacacagacatgggactacgagggtccccgactcacgctcctggggctccgtgcctgctctggcctcccaggttccagatgcgacagtccagactgacccagtccccttcttccgtgtctgccgtcctgtaggagaccgaggtcccgaccatcacttgtcgggctaatcgaggataattaaaacctggtttacgttaggtatcagacaagaaaccaaggaaaacgcccctaaagctagacagatcgaacttacggtaccctacctacgtttccaagtacgtacgggaccccagtcgacgacttccgcgtacaggtcggtactcgtacgggactacgtatttccacttacctcaccgtagtccagccacgtccctcgcgacgtacctagtaaagttcgtttacgaccgtaaccgtttacgttaatttcgtacgacgtacgtacggtacgtactaacgtaccgttttcccgacgttaccgtacgtttccgggacggtacggaccgtaaggtcggacgtacgtacgtaaacgacgttcggtcggtacgtacgaccaccgtacgttacgtcgttcctactacccg

SEQ ID NO: 57639 - DNA, 600 bp, Homo sapiens
  misc_feature: GYAE6OF02ILU9T.18.23.C01.1.454.CMB.1.raw
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
  modified_base (397)..(397): a, c, t, g, unknown or other
  misc_feature (397)..(397): n is a, c, g, or t
  modified_base (437)..(437): a, c, t, g, unknown or other
  misc_feature (437)..(437): n is a, c, g, or t
tcagtacgagtatgcacgaccggtgctcgattttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttggtcgggcaatcgaaggtattaacttaaaaccgtggtttacgtttggtactcagcaagaaaccaaggaaaacgcccctaagctgacagatgtnttcggtccgtctagtttaccaagcgtcgggacccagtcgaagcttccgngtacgagtgacgtcgtggacagtactttcactccncaacctatcacgcgacgtccgtgccgagcctagtaacgtntttacgactaactttattattcgactacgagccggacacacttaacgttcccgtacctcttacgttccgggaacgggtacggaaacccgtggtacggagtaacgtaaccggtaaacgtacgttcggtagcgtacgccaacgtactcgtacgttccttctaccg

SEQ ID NO: 57640 - DNA, 544 bp, Homo sapiens
  misc_feature: GYAE6OF02GMOID.18.23.C01.1.454.CMB.1.raw
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (539)..(539): a, c, t, g, unknown or other
  misc_feature (539)..(539): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaacgcccctaaagctgcagatgattggtccgtccagtttccaagacgtcggggccccagtcgagattccgcgtcagtggatcgngganagatttcactctcacatcagcacgctgcacgcctagaagtatttcgactaacttacttattgtcagacgacgcgacactaactttcccgactccgtacgtttcggcggtacgggaaccctagggtcgagacgtacgaaacggtaactggtgacgtgaccacgtactctcgtcctntaccg

SEQ ID NO: 57641 - DNA, 724 bp, Homo sapiens
  misc_feature: GYAE6OF02IGVAN.18.23.C01.1.454.CMB.1.raw
tcagtacgagtatgcacgaccggtgctcgatttagtacacgtgattagggagttgggggcaggagtcagacccagtcaggacacagcatggacacgagggtccccgctcagctccgtggggctcctgctcgcgtctggtcctcccgtacggttccagatcgacgacactaccagtactacggaccctacggtccccttcttccggtgtctcgtccgtacgttcggtaggacgtaccgacgtaccaaccgatctacgttaggcggtacgtaatacgaggtaacttaacgttaaaaccgttggtttagttaggtactactagtaacaaacggtaaaccgaaggtaaaaccgacccgtaacgcgtacgactacggtaagtcgtaacggtttcggtaccgttaccgttaacggtttaaccaacgggtacggttacccggggaccctacggtacggtaacgtaccttaccggacgtacgaggttcggtaaacttcggtaacggtactacgtttactacgtacctcgtaccacgtactacgactacgcgtcgtacgtcacgtacgtagtaacgttgttctaactacgttaattacggtcactacggtcgtagactacgactactacccgtatccgtacggtcgacgggtaagtacgaaggcgtataccggaacgtaacggtactcgggtacgtacctagccctaacgtctacggtttcctagtcctaccg

SEQ ID NO: 57642 - DNA, 568 bp, Homo sapiens
  misc_feature: GYAE6OF02IVP0V.18.23.C01.1.454.CMB.1.raw
  modified_base (386)..(386): a, c, t, g, unknown or other
  misc_feature (386)..(386): n is a, c, g, or t
  modified_base (428)..(428): a, c, t, g, unknown or other
  misc_feature (428)..(428): n is a, c, g, or t
  modified_base (547)..(547): a, c, t, g, unknown or other
  misc_feature (547)..(547): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcggcgaatcaggatataaaacctggttattggtatcagcaagaaaccaggaaaacgcccctaagctgcagatgattcggtccgtcagtttccaagacgtcggggcccagtcgagtactccgcgtcagtgatctgggactagtactttcactctcacatcagcacncctgcagtcctagaagtatttcgactaacttattattcgtanacgtcgaggccgactaccgtaacgtttcccgaccttcgtaccgtttccggggacggtacggaaccgtagggtacgagactaacggaaacgttaacgtaggtcgactagaccgaaccgtntacgtcgttacctacgtaccg

SEQ ID NO: 57643 - DNA, 790 bp, Homo sapiens
  misc_feature: GYAE6OF02HQKMK.18.23.C01.1.454.CMB.1.raw
  modified_base (310)..(310): a, c, t, g, unknown or other
  misc_feature (310)..(310): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggcctccaggttccagatgcgacatccgagatcgacccacgtccccttcttccgtgtctgcgtctgtacggagaccgagtcaccatcacgttgtcgggacgtaatcgaaggattattaaaaccgttggtttagtttaggtatcgagacaagaaaccgaaggaaacctacccgtaagcngacagataggtacgttcggtaccgttaccgtacgtttaccaaggtacgtccggggacccctaggtaccggacttccgttccggccgttacgtacggtggtacgttacggacgggactaaggttactttaccgtaccttcccgttaaccctaaccgtacgtacctacggtaccgtacgtacccgtacgtacccgaacggtacccgttaaggtaaacgttttaccgtttacggtaacccttttaaacctttacggtttaacgtttaccggttacgtacgtaccgggtacggtacccgtacttaacccgttaaacccttttcccgaccgttaccgttaccggttacccggggacggggtaacggtaaccggtaagggtacgggacgtaaccggtaaccggtaaaccggtaaccggttacgggtccggttaccgtacgtaaccgtaccgtaccgtttccgttacgttccctttacgttaccccg

SEQ ID NO: 57644 - DNA, 636 bp, Homo sapiens
  misc_feature: GYAE6OF02F072O.18.23.C01.1.454.CMB.1.raw
  modified_base (262)..(262): a, c, t, g, unknown or other
  misc_feature (262)..(262): n is a, c, g, or t
  modified_base (630)..(636): a, c, t, g, unknown or other
  misc_feature (630)..(636): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctggtaggagaccgagtcaccatcacttgtcgggcgaatcaggataattaaaacctggttagttggtatnagacagaaaccaggaaaacgcccctaagctagcagatagtacgttcggtccgtcctagtttaccgaagtacgtcggggaccccctataccggagtacttccggcgtcgaggtaggattcgagggactagtactttcacttcacctaccatcacgcacgtccgtcgacacgaccgtagaacgttatttacgtaccgttaactttacttattagtactacgacgtacgacgtactaacgtaaccgtttccctaccgttacgttaccggtttaccgggtaccgggtaaacgggtaaccggtaacgggttacgggtaacgtaacggtaaaccgtaaaaccggttaaccgtacgggttacgggtaccgttaannnnnnn

SEQ ID NO: 57645 - DNA, 808 bp, Homo sapiens
  misc_feature: GYAE6OF02FTRC2.18.23.C01.1.454.CMB.1.raw
  modified_base (295)..(295): a, c, t, g, unknown or other
  misc_feature (295)..(295): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagttccccttcttccgtgtctgcgtctggtaggagaccgagtccaccatcacttggtccgggacgaatcgaaggtattaattaaaaccgtggtttagtttggtatcagcaagaaaccaggaaaacncccctaagctgcagatgattcggtcctctagtttaccaagcgtccgggacccagtcgagtacgttccgcgttcaggtcgacgtcgtacggggaactaggtacttttacgaccgttcctactaacccgtattcccgaacggtaccctaccggtacccgttaccggaccgtaaccggttacccgttaagggttaaaacggtttaacggtttttacggaacccctttaaaaccgttttaaaccgtttaacggttttaccggttacccgtaaacggtaccggttaacggggtacccgtaaccgttaaacccgttaccgtttttcccccgtacccgtttaccgttaacccgggtttttcccgggggaaccgggtaaaccggggtaacccgggttaaaacggggttccgggtaacggtaacgttaaacccggtaaaacggtaaccgggttacggttaccggtaccgttacggacccgtaaccgtacgtttccgtttacgttacccgttacgttaccccg

SEQ ID NO: 57646 - DNA, 578 bp, Homo sapiens
  misc_feature: GYAE6OF02IN5UZ.18.23.C01.1.454.CMB.1.raw
  modified_base (559)..(559): a, c, t, g, unknown or other
  misc_feature (559)..(559): n is a, c, g, or t
tcagtacgagtatgcacgaccggtgctcgatttagtacacgtgattagggattggggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttggtcggcaatcaggataattaaaacctggttagttagtatcagacaagaaaccaaggaaaacgcccctaagctgacagatgagttcggtccgtccagtttaccaagtacgtcggggaccccagtcgtagtacgttccgacgtcgaggttaggattcgtgggacagtatttcactcacaccatcagcagcctgccagacctagtaatactttagacctaacttatattcgacagtcaggacactactacttcccgacttacgtacgttacgggacggtaacggtaccgtaaggtacgagtacgtaaccgaaacggtacgtggtagcgtacgacctacgtntacgttcgttctactaccg

SEQ ID NO: 57647 - DNA, 743 bp, Homo sapiens
  misc_feature: GYAE6OF02GSQV4.18.23.C01.1.454.CMB.1.raw
tcagtacgagtatgcacgaccggtgctcgatttagtacacgtgattagggattgggggcaggagtcagacccagtcaggacacagcatggacgaccgaggtcccgctcagcgtcctgggctcctgctgctctggctcccaggttccagatgcgtaccagtccagatcgaccctacttccccttcttccgtgtctgccgtctgtaggagaccgagtcaacactcacgttcgtcggtacgaacgtcgaaggtacttaacgttaaaaccgttggttagtttaggtacttacgtaagtacgaacgaaaaccgaacggtaaaacgcccccgtaaaggcgtacgacgtagtagtagtacgttcggtccgtaccgtagttaccgaagtacggttacgggcccctaaggtacgtacgtacgttccggtcgtcgaggtggatcgtggactagttcgttaccacgttacctaccaacctactccaacgacgtacgtacctcggtaccgaaccgtccgtaagtaacgttaacgtttacgtaaccttaaacgttttaacgttaacgttagttaccgtaacggaccgtacggtactaacccgtaacgtttaaccttccccgagttaccgttaccgggtttaccgggaaccgggtacggtaacgacgggtacgaaggtacgtaacgaaaccggttagttacgggccgtaccgtacggaccctactacgttaccgtttaccgttccttacccgtaccg

SEQ ID NO: 57648 - DNA, 842 bp, Homo sapiens
  misc_feature: GYAE6OF02FM57A.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatcgacccagtccccttcttccgtgtctgcgtctgtaggagaccgagtcaccatctacgttggtcgggcgaatcaggtattaacttaaaaccgttggtttagtttggtatcagcaagaaaccgaggaaaacgcccctaagctgacagtatgtagtttccggtccgtaccgtaacggtttaccaaggtacggttccggggacccctaggtaccggtaacgtacgtttcccggacggttaccgacggttacggggtaacgtttacggtacgggggtaactaacggttaccgtttttacccaaccgttttacccgttaccctaaacccttaccggtacccgtaacggaccgtaaccggtacccgtacgacccgtaaacggttcccgttaacggttaaacggttaacgtttttaccggaaccgtttaaaaccgtttttacgtttaaacgtttccggtttaaccgaccgttaacgggtaccgggtacccgtaaccgttaacccgttaaaccgtttttcccccgaccgttttaccgtacccgggttttaccgggaaccgggtaaacggggttaaccgtaaggggtccgggtaacgtaccgtaacggtaaaccggtacggttacggttacgggtaccgttcgggacctaccggttaacgttccgtttaaccggtttcccttactacccg

SEQ ID NO: 57649 - DNA, 678 bp, Homo sapiens
  misc_feature: GYAE6OF02IF9E0.18.23.C01.1.454.CMB.1.raw
  modified_base (178)..(178): a, c, t, g, unknown or other
  misc_feature (178)..(178): n is a, c, g, or t
  modified_base (201)..(201): a, c, t, g, unknown or other
  misc_feature (201)..(201): n is a, c, g, or t
  modified_base (441)..(441): a, c, t, g, unknown or other
  misc_feature (441)..(441): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttnttccgtgtctgcgtctgtagganaccgagtcaccatcacgtttcggcgggactaatccgaaggtattaacttaaaccgtggttagttgtatcagcaagaaccgaggaaacgcccgtaagctagacgtagatgtagttcgggtccgtaccgtacgtttaccgacgtcgtacggggcccctagtcgagtacttcgtgtacgagttgatcgtagggactacgttagttacactactactaccgtataccgacgtacacgccgtacncgtacgtacgtagtaagtactttacgaccttaacttacgttattacgacttacggcgaggtacctacgtaaccttaacccgtttcccgtaccttaccggttaccgttttaccggggacgttaaccggggaacgttacggggacggtagttaaaccgaaccgtaacggtaacgttacgggttccggactaccggtaccgaaccgttaccgttcgttaaccggttccttaccgtacccg

SEQ ID NO: 57650 - DNA, 1020 bp, Homo sapiens
  misc_feature: GYAE6OF02ITYIX.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccagtccccttcttccgtgtctgcgttctcgtaggacgaccgagtccaccatctacttggtcggcgaaatcgaaggtaacttaacgttaaaaaccgttggtttaacggtttagggttaactcgtaagtacgaaacggtaaaacccgaagggaaaaacgtaccccccgtaaaaggccgttaggaaccgtaacggtaacttacgggtaacggttttacggggtaccccggtttaccgtaacggtttttaaccccgaaaaggggtaaccggttacccgggggggtaaccccccctaaggttacccgggaaaccgggttaaccgtttccccgggtacccggttacgtaaacggtttacgggggtaaaccgttaccgggttaccgggggtaaccttaacggttaaggtttttaccctaaccgtttaccctaacctaaacccgttaaccttaccggtaacgaccggttaaccgtacccggtaccggaacccgttaaacggtacccggttaaacgggttaaaacggtttaacgttttaaccggtaaacccgttaaaccctttttaaacggtttaacgttttaccggttaacgtaaccgggttacccggtaaacgggtccgtaaacccgttaacccgttaaacccgtttttcccccgtaccgttttaacccgggtaacccggttttccgggggaaccggggtaaacgggtaacccggttaaacgggggtacgggttaaccggtaacgtttaaaacccgggaaaccggttaaaccgttacggggttaacccggttcgttaccggtaacccgtaaccgttaacgtttaccccgggttaacgtttacccggttacccttaacccgg

SEQ ID NO: 57651 - DNA, 620 bp, Homo sapiens
  misc_feature: GYAE6OF02IN1Q6.18.23.C01.1.454.CMB.1.raw
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (477)..(477): a, c, t, g, unknown or other
  misc_feature (477)..(477): n is a, c, g, or t
  modified_base (612)..(612): a, c, t, g, unknown or other
  misc_feature (612)..(612): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgaccctagtccccttcttccgtgtctgcgtctgtaggagaccgagtcaccatcacttcggcggacaatcgaaggtataattaaaaccgtggtttaagtttggtatacgagacgaagaaaccgaagaaaacgccccgtaagctgacgagatgtaacttcggtccgttacgagtttaccaaggtacgtcgggacccctaagtcgtaagtcgttccgcgtcgaggtgacgtcgtaggacaggttacttacacgtctaccactatacacgacacgccgtgacncgactagaagttcttnactaacttctatttcacgngcgacggccactacctaccttcccgtactccgtaccgtttgggacccgggtaagggtaccgtaagggtcggagtacctacggaaaccggtagtcggtacggaccgttcgactaccgtagttcgttcgttaccttntaacccgg

SEQ ID NO: 57652 - DNA, 804 bp, Homo sapiens
  misc_feature: GYAE6OF02ILBMO.18.23.C01.1.454.CMB.1.raw
  modified_base (293)..(293): a, c, t, g, unknown or other
  misc_feature (293)..(293): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgaccccagtcccccttcttccgtgtctgtcgtctgtaggagccgagtccaccatcacgttgtacggacgaatcgaaggaattaacttaaaacgtggtttattaggtatcagcaagaaaccaaggaaaacncccctaagctaggacagatgtaacgttcggtccgtactaagtttaccaaggtacggtcccggggacccccaagttcccggaagtacccgtttacccggaccggttaccgagggttacgggtaacgttacgggtacgggggtaacctaagggtttaacctttaccgtaaccccgttaccttaacccgaacctaacgttaccgaacggtaccctaaccggtccccgtacggtacccgtaaccgtacccgttaaagttaaacggtttaagtttaaccggtaaccttaaaccggttttaaacgtttaacgttttaacggtaccgtaacggtaccgttaacgggaccttaaacccgttaaacccgtttaaccgttcccccgtaacgttacccgttaaccgggtttaccgggaaccggggtaaacgggaccgttaaggggacgtacgtaacgtaccgaaacggtacgtcgtaagtacgtacgaccgtaactccgttagtaccgttcttacctaccgg

SEQ ID NO: 57653 - DNA, 721 bp, Homo sapiens
  misc_feature: GYAE6OF02JXVZG.18.23.C01.1.454.CMB.1.raw
  modified_base (169)..(169): a, c, t, g, unknown or other
  misc_feature (169)..(169): n is a, c, g, or t
  modified_base (691)..(691): a, c, t, g, unknown or other
  misc_feature (691)..(691): n is a, c, g, or t
tcagtacgagtatgcacgaccggtgctcgatttagtacacgtgattaggagttgggggcaggagtcagacccagtcaggacacagcatggacacgagggtcccgctcagctcctgggctcctgctgctcgtggctcccaggttccagatcgcgacatccagatcgaccngtcccttcttccgtagtctcgacgtctaggtagacgaccgagtcaccatacctcgttggtccgggctaactccaaggtactaacttaaaaccgtgtttagtttggtatctagcaacgtaaccgaagggtaaaaccgccccttaagcccgttgtacggaactaatggtaacttcggttcccgtaccgtaacgttttccaaacggtcggtacccgggaccccctaatacggtacgtaacgtttccccgcggtaccaaggttcggtacttacgttaccggggactttaacgggtaccttttaccgaacttcctacgaaacccgtgttaccacggtacgtaacgtcccgttacgaccgtacggtacctaagtaaccggttaatttacggtaaccttaacgttaacttacgtagttacacgacgtacgtacggactaccgtacgttaccgcgttactccgttacggaccggtagacccggtaagtacgacgtaacgtacgtaaccgtaacgttcggtacgtacgttnaaccgtctacgtcgtacgttactactcccg

SEQ ID NO: 57654 - DNA, 649 bp, Homo sapiens
  misc_feature: GYAE6OF02FIGW5.18.23.C01.1.454.CMB.1.raw
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagttgtatcganagaacgaacgaagaacctacctagcgtcacganatgtagtcgtcctacgtacttacgagtcggcccggacctagtacgagtcgtcgcgtacgaggtagtctggtacganagttctacnctcgtaccactactacgcgacaccgtcgtcgacgtactccgtaaagtacgtttacgttacaaccgtttaacctttattacgttcgacgtaccgacgacggtaacgaccaaccgtttacccgttaccgtcttaacccgttggtttaccgggacgggaaccggtacgggttaagggcggtaacgacgtaaaccggaaaccggtttcacgggttaaccggcgttaccggaccctacggttacttccggtacgtttaccaccgtttaaccccg

SEQ ID NO: 57655 - DNA, 723 bp, Homo sapiens
  misc_feature: GYAE6OF02H19UN.18.23.C01.1.454.CMB.1.raw
  modified_base (178)..(178): a, c, t, g, unknown or other
  misc_feature (178)..(178): n is a, c, g, or t
  modified_base (401)..(401): a, c, t, g, unknown or other
  misc_feature (401)..(401): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttnttccgtgtctgcgtctgtaggagtaccgagtccaccatcacttggtcggcgaatcgaagtattaacttaaaacgtggtttagttgtatcagacaacgaaacaaggaaacacccctaagctagcgaatatagtagttcggttcccgtactacgtttaccaaagtcggtaccgggacccctagtcgacgttacgttccgcgtacgaacggttcgtacgttacggnggtaactagttactttaccacttcctaccgaacctatacgacgactacgtaccctcgccgaacgtaccgtagttaacgttacgtttacgacttaaacgttaactttacgttacgttaacgaacggtcgaacggtacctaccgttaaccgtaaccctttcccgtaccttaccgttaaccgggttttccgggaaccgggttaacggaaacccggttagggtacggtaacgttaccgtaaccgtaaaaccggttacgtcgggtacgttccgaccgtaacctaaccgtacgtttaaccgtttcggtttaccttacgttaacccccg

SEQ ID NO: 57656 - DNA, 740 bp, Homo sapiens
  misc_feature: GYAE6OF02IPVVO.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccagtccccttcttccgtgtctgtcgtctaggtaggacgaccgagtccaccatctacgttgcgggtacaatcaggtaattaaacttaaaactgggtttaacgtttggtatcgaagacaagaaaaccaaggaaacgcccctaaaggctagacagagtagtaacttcgggttacccgtaccgtaagttaccaaagcggttccggggacccctaatacgacgtacgtccggtcgtacgcggagtagccgtaggacgttatacgttacacgtctaccgacctagtaccgagtacacgtactagaccgtaaccgtactaacggtaaagttactttacgtaaccgttaaaccttaacgtttacgtttaggtacctaacggtaacgaccggtaccgtaacgtaacccgtttaactttacccccggtacctttacccgtaacgggttttacccgggaacggggtaaaccggaaccggttaacgggtaacgggacgttaaacgttaacccgaaacggttacggttacggttcggaccgtctaaccgtacctacgttaccgtaggttaccttaccttacccgg

SEQ ID NO: 57657 - DNA, 773 bp, Homo sapiens
  misc_feature: GYAE6OF02HYGY9.18.23.C01.1.454.CMB.1.raw
  modified_base (626)..(626): a, c, t, g, unknown or other
  misc_feature (626)..(626): n is a, c, g, or t
tcagtacgagtatgcacgaccggtgctcgatttagtacacgtgattagggattgggggcatgagtcagacccagtcaggacacagcatggacacgagggtccccgctcagctcctggggctcctgctgctctggctcccaggttccagatgcgacatccagatgacccagtccccttcttccgtgtctgcgtctgtaggacgaccgagtccaccatccacgttcggtcggggactaaatccgaggtaattaacttaaaacccgtggggtttacggttaggttaactcgaaggtccaacgaaaacccgtaagggaaaaaccgacccccgttaaaggtcctagacgaaggacttaggtacttttccggggtacccgttactaaccggttttacaaacggtacggtccggggacccctatcggtacgtaccgttaccgcgttacgacggtgaacttcgggtacgggaactacggttacttacgtacttccgtaacccaaccgattccgaaagtccgaccgttccgtacgaccgacgtccgtagtaacgtttacgttacgtacttaaacctttactagttaacgtccgacggaaccggtcgaccggtacctaaccgttactttaccccgngttaacccgtccggggtttaaccggaccggggtaacggtaacccggtaaagggttcgaacggaaccgtaaaccggtaaaccggtacggtttaacggaccggttcgtaacgcccaaccttaccgtacgttaccggttactttaccccg

SEQ ID NO: 57658 - DNA, 614 bp, Homo sapiens
  misc_feature: GYAE6OF02IKARK.18.23.C01.1.454.CMB.1.raw
  modified_base (187)..(187): a, c, t, g, unknown or other
  misc_feature (187)..(187): n is a, c, g, or t
  modified_base (266)..(266): a, c, t, g, unknown or other
  misc_feature (266)..(266): n is a, c, g, or t
  modified_base (357)..(357): a, c, t, g, unknown or other
  misc_feature (357)..(357): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagactgcgacatccaggatgacccagtccccttcttccgtntctgcgtctgtaggagaccgagttcaccatcacttgtcggcaatccaggattattaaaacctggttacgttggtaactnagtcacgaaaccgagaaaacacccctaagctagcagactgagttcggtccgtccagtttccaagacgtggggccccagtcgagacttccgntcagtgatcgtaggcacgactttcactcacaccatacagacacgccgttgcctagccctagtaacgtatttacgacttaacttacttactttagtacagtcgtacggacgtacaacgtaacgtttcccacgttcctaaccggtttaccggacggtaacgggaaccctaagggtacggactaacgtaccgtaaaccggtaacgtcggtacgtaccgtaccgaccaccgttagttccgtacggttccttacgttacccg

SEQ ID NO: 57659 - DNA, 695 bp, Homo sapiens
  misc_feature: GYAE6OF02IWBVF.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacaatccagatgacccagtccccttcttccgtgtctgcgtctgtaggagaccgagtcaccatcacgttggtcgggcaatcaggataacttaaaaccgtggttagtttgtatcagacaagaaaccaggaaaacgccccgtaagctagacagagtgtaagttcggtaccgtcctacgtttcaaggacgtcgggaccccagtcgagcttccgcgtcgagtggtacttcggtacggtacgtagttacgtttctaccgttcacctaccactcgaacggtcctacggtcctaggaccgacgtacgtacgtaaacgttaacgtttactaacctaacgtttacgttactttacggtactacggaccgtacggccggacttaaccgttaccgttttaccccgtacttcccgttaaccggtttaccggggaaccgggtaacgggaacccggttaagggtacggaacggtaacgtaaccggaaacggttaaccggttcgggtaccggtcttacgacccgtaacgtacgtttaccgtcgttaccttaccgtaccc

SEQ ID NO: 57660 - DNA, 648 bp, Homo sapiens
  misc_feature: GYAE6OF02G17MM.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtcctgcgtctgtaggagaccgagtcaccatcacttgtcgggcaatcaaggattaacttaaaaccgtggttagttggtatcagtcaagaaaccaggaaaacgccccgtaaagctacgacagtatgtagttggtcccgtctagtttaccaagtacgtcggggaccccagtcggagtacttccgcgtcaggtcgatcgtaggactagtactttcgactcgtacactagtcagcaacgtcctgcacgtcctagtaagttactttcgactaactttagtactttacgtacagtacgacggtacactaacgttaaccttccccgtacttaccgtaccggtttccgggaacgggtaaccgggtaaccgtaaggggtacacggtacgtaacgtaaaacgggtaccttaggggtccgtaccgttacgaccgttacccgatttacccggttacttacccgttacctaacccgg

SEQ ID NO: 57661 - DNA, 787 bp, Homo sapiens
  misc_feature: GYAE6OF02HW9KR.18.23.C01.1.454.CMB.1.raw
  modified_base (308)..(308): a, c, t, g, unknown or other
  misc_feature (308)..(308): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggcctcccgaggttcccagatggcgacataccagatcgacccctacgttcccccttcttccgtgtctcgcgtactgtagggagaccgagtccaccatcacgttgtcgggcaatcgaggtataacttaaacgtggtttagttggtatcgacgacgtaacgaaaccgaaggaaaaccncccgtaagctagacaacgatagtacgttcggtaccttacgtactttaccgaagtacggtaccgggaccctagtacgaacgtacgtccggtacttacgaacgttggaacttcgggtacggtaactagttaacgtttaccaccgttacctaccgtaacccgtagtaccgacgacgtacgtacccgtagtaccgtaacgtacggtaagtaagttacgtttacggaacctttaaaccgtttattaacggttacgtacggtaacgtcgtacggaccgtaacgttaacccgtaaccgttcccgtaccgttacccggtaaccgtttaccggggccgggtaaaccggtaaccgttaacgggcggttaacgtaaccgttaaaccggaaaccggttaaccggttcggtaaccgggtaccgttaccgggtaaccgtacccgtttaaccggttaccgggtttaaccctttacccgttccgtttaaccccgg

SEQ ID NO: 57662 - DNA, 659 bp, Homo sapiens
  misc_feature: GYAE6OF02IHRL5.18.23.C01.1.454.CMB.1.raw
  modified_base (458)..(458): a, c, t, g, unknown or other
  misc_feature (458)..(458): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggcctccaggttccagatggcacatccagatcgacccacgtccccttcttccgtgtctgcgttctaggtaggagccgacgtcaccatctacgttcggtacgggacgaactcgaaggtataacttaaaccgtggtttagttggtatcagtcaacgaaaccgaaggaaacgcccctaagctagcagtatcgtagttcggtccgtctacgtttaccaaggtacgtcggggaccccagtacgagtacttccgacgtcgaggttcgacgtcgtacggggactacgttactttccaccgttctaccactagtacgacgactacgtccgtacnccagtacctagtaacgttcttacgacttaacttacgttagtttcgacaggtcgaggacctacgtaaccgttacgttcctaccgttacgtacgttcccggggaggtaaccggtaaccgtaggggtcgaacgtacgtaacgaaaccgtacggttcgggtcgacgtacgcctacgtacttggttacccttacgttcctaaccgg

SEQ ID NO: 57663 - DNA, 881 bp, Homo sapiens
  misc_feature: GYAE6OF02I3E1C.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctggggctcctgctgctctggctcccaggttccagatgcgacatccagatgacccacgtccccttcttccgtgtctgcgtctgtaggagaccgagtcacatcacttgtcggcaatcaggattaacttaaaaccgtggttagttggtatcagcaagaaaccgaggtaaaacgcccctaagcctgacagtatgtacgttggtcccgtacgtacgttaccaaggacgtcggggaccccagtccggtagtacgttccgacggttacaggttggacgttcggtacgggactaggttaactttcgaactccgtaccaacctactaaccctaaccgtacgtacccgttacggaccctaaccgggttacccttacgggtaaaagtttacgttttttaaccggaaacccgtttaaaacccgtttttaaaacctttaacggttttacggttaaacctacgggtaaacggttaacccgggacccgtaaaacctaacccggtttaaacccgttttcccccggttacccgtttaaccccgttttaacccggggtttttaacccggggggaaccccggggtaaaaccgggggggtttaaaccccgaaaaggggggttttaaacccggggaaacggttaacccggttaaaacccgtaaaaaccgggggtttaacccggttaagggggtaccgggttaacccgttaccgggttaacccctaccggtttaaccgtttaccccggttacgttttacccgttttaccggaaccctttttccccccggg

SEQ ID NO: 57664 - DNA, 789 bp, Homo sapiens
  misc_feature: GYAE6OF02INL22.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagactcgaccctacgttccccttcttccgtgtctgcgttcgtggtaggacgaccgacgtccaccatcctacgttcggtcgggtacgaatcgaaggtaattaacgtttaaaacgttgggttttagtttggtaatcgaagacaaacgaaaacgaaggaaaaccgccccgtaagtcctagaccgagtattggtacgtttccgggttcccgtacgttacgtttacccgaaggtacgtcccggggcccctaagtaccgtaacggtcctttccggccgtacggtaggtcggtacttaccggggtagggtaactaacggttacttttacccgacttaccttaccctaaccctacttacgaccgtcgtaccgtccgttacaccgtacggtacgttagtaaacgtttacgtttacgtactttaaacgtttacttagtttctaacgtaggaccgtacgcccgtaacgtaaccttaaccggtttcccaccgtttaccggttacccgggttaccgggaccggggtaacggtaaccggtagggttacggaccgtaacggtaacccgaaaggttaccggtacgggtacgtacgtaccgaaccgtacgtttacctacgtttccgttacccttacgttaaccccgg

SEQ ID NO: 57665 - DNA, 987 bp, Homo sapiens
  misc_feature: GYAE6OF02HPZHG.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctggtaggagaccgagtcaccatcacttggtcgggacaaacgtcgaaggtattaaacttaaaacctgggtttaagtttaggtaatccgtaagaccgtaaagaaaaacccgaaagggtaaaaaaccgtcccccgtaaaggtaccgtacggtacctaaaggtaacttaggtaaaccgttttcgggggttaccccggtttacccggttaaacggtttttaccccgaaaaagggttaccgggttaccggggggtaccccccctaaagggttaccggtaacggttaaccggtttacccgggaccggtttcccggaaagggtttcggggtaacttaccgggttacgggggaaacctaaggtttaaccttttaccgaacccgtttccgtaacccgtaaccctaacgtaccgtaagacccgttaacggccccgttaagggtaacccgtacgggtaccccgttaaggttaaaaccggtttaacggtttttaaccaaaccggttttaaacccgttttaaacgttttaacgttttaacgggtaacctaaccggggtaccgttaccgggaacccggtaacccttaaacccggttaaaacccgttttccccccgggaaactttaccccgttaacccgggtttttccggggaaacccgggggtttaaaccgggaaacccggttaaacggggttaccggggtaacgttaacgtaacccggtaaaaaacgggtacccggttacgggtacgggttacgtaaccgaacgtaacccgtaacgtttcggtacggttacccttacgttaaccccgg

SEQ ID NO: 57666 - DNA, 771 bp, Homo sapiens
  misc_feature: GYAE6OF02F4W7H.18.23.C01.1.454.CMB.1.raw
  modified_base (178)..(178): a, c, t, g, unknown or other
  misc_feature (178)..(178): n is a, c, g, or t
tcagtacgagtatgcacgaccggtgctcgatttagtacacgtgattagggattgggggcaggagtcagacccagtcaggacacagcatggacacgaggtccccgctcagctcctgggctcctgctgctctggctcccaggttccagatgcgacatccagatcgacccacgtccccttnttccgtgtctgctctgtagagaccgagtcaccatctacttggcggacaatcgaggtattaacttaaaaccgtggttagttgtactcgagacaagaaaccgaacggaaaactccccgtaagcgtagcagtatagtacgttcggtacccgttccgtacgttaccgaagtaccggtccggggacccctagtacggagtaccgttcccgtacgtacgaggtcggtactcggtacgggtaactacgttacttttaccgaccgttacgttaccaacctacgttccgaacgtcgaaccgtccctacggacctaacgtaccgtaacggttaactttacgtttaccggaaccttaaaccgttttcgtaaacgtttcggtaacggtaccgaaccggtaccggtacgttaacccgttaaccgttacccgtttaccccgtcgtttaaccggttaacccgggtttaccgaaacgggtaacccggttaaccgggaacgggtacgtacgtaaaccgtaccggtaaaccggtacgttacgggttacggaacttttaccggaccccgttaacgttcccgtaggtttccccgttactccccggtttaaccc

SEQ ID NO: 57667 - DNA, 701 bp, Homo sapiens
  misc_feature: GYAE6OF02GMHRV.18.23.C01.1.454.CMB.1.raw
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
tcagtacgagtatgcacgaccggtgctcgatttagtacacgtgattagggattgggggcaggagtcagacccagtcagtacacagcatggacacgagggtcccgctcagctcctggggctcctgctgctctggctcccaggttccagatgcgacatccagatgacccagtccccttcttccgtgtctgcgtctgtaggacgacgagtcactactcacttggtcggacaatcgaaggtaattaacttaaaaaccgttggtttaaggttttaggtactacgtaagacaaacgaaaaccgaaggaaaaccgtcccccgtaaagtcctagaccgaagtaacgtgtacgtttcggtcccgttaccgtacgttttaccgaaagtacgtccggggaccccagtacgagtaccttccgtacgtnaggtgactcggaggactagtctttcactctaaccacacncagacgacgtcctacgcaagtcccgtagtaagttacgtttacgacgttaaacctttagttaacttcgacgtaacgtacgacgccgaaccctaaacgtacccgttttacccgcttaccgtacggtttccggaaccgggaaacgggaacgtaacggggaggtacgtaacgtaaccgtaaaacggtacggtacggtacggaaccttacggaccgttacctaacgttcgttcgttaccttaaccgtcccg

SEQ ID NO: 57668 - DNA, 785 bp, Homo sapiens
  misc_feature: GYAE6OF02HKGK1.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagactgacccacgtccccttcttccgtgtctgcgtctgtaggacgaccgagtcaccatcacttggtcggacgaatcgaaggtattaacttaaaaccgttggtttagtttaggtatcgagacgaagaaaccgaacggaaaccaccccgtaaagcgtacgcaagtagtagtacgtttcggtcccgtaccgttaacggtttaccaaaggtacggtacccggggacccctaaggttaccggaacgttaccgttacccggtccggttacgtacggttaggaactttacggtacggggtaactaacgttacttttaccgaccttacgtaccaacccgtagtaaccgacggtaactacgacccgttacgaccgtaccgtaccgttagtaaacgtttacgtttacgtaaccgttaaacgtttaacttaagtttacgtactacgacgtacgaccgtaaccttaacttacccgtttacccgtaccgttccgttaacggtttaccgggaccgggtaaacggtaacccggtagggttacggaacgtaacgtaaaccggtaaacggtaccgttacgggttaccggtacgttaccggacccgtaacgtacgttaccgtttcgttaccgttaccgttacccg

SEQ ID NO: 57669 - DNA, 691 bp, Homo sapiens
  misc_feature: GYAE6OF02HOAH8.18.23.C01.1.454.CMB.1.raw
  modified_base (401)..(401): a, c, t, g, unknown or other
  misc_feature (401)..(401): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccacgtccccttcttccgtgtctgcgtctgtaggacgaccgagtccaccatcacttggtcggcgaaatcgaaggtattaacttaaaaccgtggtttagttggtaactcaagacaacgaaaaccgaaggaaaaccgccccctaaaggcctagacaacgaatgacgttcggtccgtcctacgttaccgaagacgtcggggaccccatccgagtacgttccgcgcaaggtgtatcgnggacagttaacttctacgtcctaccacgactcagccactccgtgccctaaggtacccttagtaagttactttacggaccttaactttacgttatttacgtccacggtctacggacccgttaactacccttaaccgttccccgtcttaccgttacgttccggtaaccggggtaaaccggtaacgggaaggtcggaacgtaacgtaacccgtaaaacggtcgttaacgggtccggtaccttaccggtacctaacccgtaccgttacgtaccggtttacttaccgtacccccg

SEQ ID NO: 57670 - DNA, 718 bp, Homo sapiens
  misc_feature: GYAE6OF02GJOTC.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctccgtgggctcctgctgctctggcctccaggttccagatcgcgacatccagatcgacccagtcctacttcttccgtgtctgccgtctaggtaggacgaccgatccacctatctacgttggtcgggacaagtcaaggtattaaacttaaaccgttggtttacgttgtaccccctagagacaacggaaaaccgaaggaaaaccgtcccctaaagctacggacaagtacgtaggtacgtttccggtcccgttactacggtttacgaaggtcggtaccgggacccctagtaccggtactacgttcccggacgtacgtaaggtggtactacggtagggtactaggttacttcaccgttctaccgacctagtaccagccgtacgcctgaccgtacgtaccgtaagtaacgttactttcgaaacctttaactttagttacttacgacacggacgtacgggccttaactaaccgttacccgttcccgtaccgtacggtttccggttaccgggaacgggtaacgaaccggtaggttcggaaactaccgaaccgtaaagtccggttaaggtcgttaccgacctaccgtaaccgttggtttacttacgtccttaaccg

SEQ ID NO: 57671 - DNA, 570 bp, Homo sapiens
  misc_feature: GYAE6OF02FSG2V.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatcgtgggacagtatttcactctcacatcagcagcctgcagcctagaagtattttacgctaaactttactagtttcgtacacgacacggcgtacaacctaattttccccgcttcctaccgttttccgggcggaacggggacccaagggttgggagactaccgaaaacggaacttggacggtccgtaggaccaccgtactttccgtcgttacctttctaccc

SEQ ID NO: 57672 - DNA, 685 bp, Homo sapiens
  misc_feature: GYAE6OF02G8IL3.18.23.C01.1.454.CMB.1.raw
  modified_base (169)..(169): a, c, t, g, unknown or other
  misc_feature (169)..(169): n is a, c, g, or t
  modified_base (180)..(180): a, c, t, g, unknown or other
  misc_feature (180)..(180): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
  modified_base (612)..(612): a, c, t, g, unknown or other
  misc_feature (612)..(612): n is a, c, g, or t
  modified_base (634)..(634): a, c, t, g, unknown or other
  misc_feature (634)..(634): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccncgttccccttnttccgtgtctgcgtctgtaggagaccgagtccaccatcacttgcggcaagtcaggtatacgttaaaacctggttagttgtatcgagcaagaaaccgagaaaaccncccctaagcgtgacgagntgagttcggtccgtaccgtagttaccgaaggtcgtaccggggcccagtacggtacgtacttcccggngttaccgagttacggacttcggtacgggactaggtactttaccgacttacctacgtaaccctatacgaacgccacgtacctcgggaccacgtccgtaaagtaacgttctttaccggacttaaacccgttttagtaacttcgttacgaacggtcgtaaccggaccgtacttaaccgttaacctttccccgtattcccgttaacggttcccgggaacgggtaacggacggtacggtacgggtanaccgttaacggaaacgttcggngtaccggtcgaacgtaccctacttacggtcctttacgaccttcgtaacccg

SEQ ID NO: 57673 - DNA, 743 bp, Homo sapiens
  misc_feature: GYAE6OF02H3K2T.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggacgaccgacgtcaccagtcctacttggtcgggcgaatcgaaggtattaacgttaaaaccgttggtttaagtttaggtactcatacaagaaaccaggaaaacgccctaagctgcaagatagagttcggtaccgtacaacgtttccaaggtacgtccggggtaccctagtacgtacgtaacgttccggcgttacgacggttcggtaacttcgggtagggtaacctaggttaacgtttacctaccgttcctaaccgtaccgtacgtacgacgtccgaacgtccgtacgaccgaccgtccgtaagtaacgtttagtttaccgaactttaaccgttaacgttacggtttactaacgttacgaccgtacggtaaccgtcttaaaccgttaacccgttttcccgaaccgtttccggtaacccggtttaccggggaccgggtaaacggtaccggtaagggtacggtaccgaacggttaaccgaaaggttaccggttcgacggttacccttaggacctaacctcggttacccgtcgtttaccacgttaccccg

SEQ ID NO: 57674 - DNA, 768 bp, Homo sapiens
  misc_feature: GYAE6OF02F25WH.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatgacccacgtccccttcgttccgtgtctgcgtctgtaggacgacgagtcacctactcacgttggccgggcgaatcgaggaattaacgttaaaaccgttggtttagttggtatcgagcaacgaaaccgaaggaaaacgcccctaagctagcgaagtataggacgttcggtccgtacctacggtttaccgaagtacgtccgggaccccagtacgacgtaccgttccgcggtacgtacggttggacgtcgtaggggtactaacggttactttaccgaacgttcctaccacctacgtactacgacgtacgtacccgtggaccgacggtccgttaggtaaacgttttacgtttaacgtacctttaaaaccgtttaccgttaagtttaccgtacgttaaacggcgtaacggaccgttaacctaaccgttaccgttacccgttaccttaccggttaaccgtttccggggaaccgggtaaaccgggtaaccgttacgggtaacgggtaactaaccggttaaaccgtaaacgggttacggttacggttaccggtaccggttacgaacccggttacccgttagtttaacccgtccgttttacctacggtttaccccg

SEQ ID NO: 57675 - DNA, 716 bp, Homo sapiens
  misc_feature: GYAE6OF02IEN9A.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagactgacccacgtccccttcttccgtgtctgcgtctgtaggagaccgagtcaccatcacgtttcggtcgggactaatcaaggattaacttaaaaccgtggttagtttgtatcagcaagaaaccaaggaaaacgcccctaagttcgacacgattgacgtttcgggttacccgttccgtaacggtttccaaaggtacgtccgggggccccctaagtcgagtacgttccgcgttccgaggtcggacgtcgtagggaactagtagtttccaacttcgtacactactcaacgtcacgtcctaggcccacgtcccgtagtaaagtttacgttttacgtaaccttaaacttttacgttaatttacggtactaggccgtaaggacgtaccgtaaacgtaaccgttttacccgccttaccgttaccggtttaccggggacgggtaaaccgggtaaccggtaacggggtacggtaacgtaacgtaacggtaaaccggtacggttacgggtccggacgttaccgactacccgttacgtacgttcccgttacttccctactttccccgg

SEQ ID NO: 57676 - DNA, 833 bp, Homo sapiens
  misc_feature: GYAE6OF02GWHW9.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccgaggttccagatgcgacatccagatcgacccacgtccccttcttccgtgtctgcgtctgtaggacgaccgagtcaccatcacgttgtcgggacgaatcgaggaattaacttaaaaaccgttggttaacgtttaggtattacgagacaagaaaaccgaaggaaaacgcccctaaagctagacagtatagtattcggtccgtacctagtttaccgaagtacgtcggggtacccctagtacggacgtaacgttccggtcgtacgtagtggacttacggtgggacctaggttactttcgactactacaccagtaccaactacgtcctacggtacacgtcgtaacggtaaagttacgtttacggtaaccttaaaccgtttaacgtttaacgtttacggttaaccgaaacggtaccgtaacggggtaccctaaccgtaaacccggttaaacccgtttttacccccgtacgtttaaccccggtttaacggttttacccgggggaaccggggttaaccgggaaacccggttaaaacggggttagggtaaacccggtaaacgtttaaacccggaaaacccggttaacccggttaggttaacccgggggtaccgttaaccggtaaaccgttaacccccggttacgtttaacccggtttaccggttttaacccgttttaccccgtacccggtttttacccccccg

SEQ ID NO: 57677 - DNA, 782 bp, Homo sapiens
  misc_feature: GYAE6OF02F5OXF.18.23.C01.1.454.CMB.1.raw
tcagtacgagtatgcacgaccggtgctcgatttagtacacgtgattagggagttgggggcgaggagtcagacccagtcaggacacagcatggacacgagggtcccgctcagctccgtgggctcctgctgctctggcctcccaggttccagatgcgacactccagatcgaccctcgtccccttcttccgtcgtctgcgtctgtaggagaccgagtcacctgtctacgttcgcgggactaatcgaaggtacttaagttaaaaccgttgggtttagtttaggtactcgtacgcaaacgaaaccgaaacggtaaacgacccgtaaggctagaccgagtagtagtacggttacggtccgttacctacggtttacccgaaggtcggtacccggggtacccctagtaacccggtacgttaccggttaccgtccgtacggtacgttagggacgttcggttacggaacgttcggttaaacttttccgtaacttacccgtaccgtaacctacgttaccgaagtaccgtacgtaccgttacgaccgtaccgtaccgttaacggtaacgtttacgtttaaccgaaccgtttaaaccgttacgtttaacttacggttacctaacggtcggtaccggtaccgaacgtttaaccgtaccgtttacccgtacgttacccgttaccggttacggggtaaccggtaccggtaaaccggtaagggtacggtaacgacgtaccggtaaacggaccgtggtaccggtcgtacacgacctacgttctacgttaccgtattccgg

SEQ ID NO: 57678 - DNA, 650 bp, Homo sapiens
  misc_feature: GYAE6OF02IOFPT.18.23.C01.1.454.CMB.1.raw
  modified_base (288)..(288): a, c, t, g, unknown or other
  misc_feature (288)..(288): n is a, c, g, or t
  modified_base (386)..(386): a, c, t, g, unknown or other
  misc_feature (386)..(386): n is a, c, g, or t
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgacccacgtccccttcttccgtgtctgcgtctgtaggacgaccgagtcaccatccacttggtcgggacaatcgaggataattaaacgtggttagttggtatcagcaacgaaaccaaggaaaacnccctaagcgtagcagatgacgttcggtccgtcctaggtttaccaaggtacgtcggggacccctagtaccgagtacttcccgcgtcaggtggtactcgngggactagtactttacactctacaccatacacgcacgcccgtgaccacgcctaagtacgttatttacgaaccttaactttacttacgttcgtacacggacgtacggtaccgacctaaccttaccgtttccccgtcttaccgtacggtttaccgggaccgggtacgggaaccgtaaggggtacggacgtaacgtaaccggaaacggtaacgtgggtaacgccgtacgtacccgtacttacgttccgttcgttaccttacgtaccg

SEQ ID NO: 57679 - DNA, 771 bp, Homo sapiens
  misc_feature: GYAE6OF02G4TIY.18.23.C01.1.454.CMB.1.raw
  modified_base (295)..(295): a, c, t, g, unknown or other
  misc_feature (295)..(295): n is a, c, g, or t
tcagtacgagtatgcacgaccggtgctcgatttagtacacgtgattagggattgggggcaggagtcagacccagtcaggacacagcatggacacgagggtcccgctcagctcctgggctcctgctgctctggcctcccaggttccagatgcgacatccagatcgaccctacgtccccttcttccgtgtctgcgtctggtagacgaccgagtcaccatcacttggcggacaagtcaaggtacttaagttaaaactgggttagtttcgtatcgagacaacgtaaacgaacggaaacnccccgtaagctgacctaagtatgtacgtttcggtccgtacctagttaccaaggtacgtcgggaccctagtacgacgtacttccggctagaggttgactcggacggtactaggtacttacgactcctacaacctagaccgacgcctacgtcccgtaggacccgtacggtaccttaggtaaacgtttacgtttacgaaacccttaaacgttttaccgtaacgttttaccggtacgaaacggtcgtaaccgggtaccgtacccgtaaaccgtttaaacccgtttccccggtacctttaacccgggtttaacccgtttccggggaaaacccgggggttacggaaacccggggtttaaggggaaccgggttaacaacgggtttaaaacccgaaaccgggtaacggtttacgggtaccgggttcctaacgggacccttaacgttaccgttccgtttaaccggttcctttaaaccgtccccgg

SEQ ID NO: 57680 - DNA, 812 bp, Homo sapiens
  misc_feature: GYAE6OF02G9EE9.18.23.C01.1.454.CMB.1.raw
  modified_base (92)..(92): a, c, t, g, unknown or other
  misc_feature (92)..(92): n is a, c, g, or t
tcagtacgagtatgcacgaccggtgctcgatttagtacacgtgattagggagttgggggcaggagtcagacccagtcaggacacagcatganacgagggtccccgctcagctcctggggctcctgctgctctaggcctcccgtaggttccagtatgaccgacactccagactcgaccctacgttcccccttgttccgtagttctcgtcgtccgttggtaacggacgaccgagtaccacctatccgttaacgttcggtacggacaagtccgaagtaacttaacgttaaacgttggtttaacgtttaggtactacgaagcaacgtaaaaccgaagaaaaccgtaccctaagctacggacaaggtactagtagtttccggtaccgttaccgttacgttaacgagtacgtacccggacctacgacgtataccgttcgtcgacgtaggtacgtagttacgacggtaactacggttacttaccgtactcctactaacccactacgagtacccgaacgtccgtacgtacctacggtaccgttaagtaaaccgtttacgttaccgtaaccgttaacctttaacgttaacgttacgtaccgtaaacgtccgggtaaaccgtacgtaaccgtaaacccgtttaacccggtttacccgtccgttaaccgtttaccgggttaacgggtaacccgggttaacggtaaccgggtaacgggttacgtaccgttaacgtaaaccgtaaacggtaacttacggggtaccttaccgaccgttacctaacggtacctttaccggtaccttttacggtaacccttacccccg

SEQ ID NO: 57681 - DNA, 854 bp, Homo sapiens
  misc_feature: GYAE6OF02I8P9O.18.23.C01.1.454.CMB.1.raw
  modified_base (582)..(582): a, c, t, g, unknown or other
  misc_feature (582)..(582): n is a, c, g, or t
tcagtacgagtatgcacgaccggtgctcgatttagtacacgtgattagggattgggggcaggagtcagacccagtcaggacacagcatggacacgagggtccccgctcagctcctgggtctcctgctgctctggctccctacggttccagagtcgacgaccacgttcccagagtcgtaacccacggttccccctttcttcccggtgtccgtcgtccggttcttcggtaggacggaacccgtagtccaacccaacttcctaacgtttcggaccgggccgtaaattcgaacgggtaactaaacgttttaaaaacccggttggttttaaggtttcggttaacttccgaacgttaccgaaaaacggtaaaacccgaaaggtaaaaaccggccccccgttaaagacccgtcggaaccgtaggtaacgtacggtacgttttccggtacccccgttcgtaacccgttttacgaaacggttaccgggtcccggggaaccccttaggtaaccggtaagttaccgttccccggtcgttaccgtacgggtaggtccgttacggttacgggaacgttacgtttaccgtttaccnccgtttaacccgttacgaaaccgtaccttacaccggactaccggtacccggtcctacgtaaccggtccgttaactaaggtttacgtttacgtaacgtaacctttagttacgttcgtaccgtggaaccgttcgaacctcgttaaacctccgttacccgtgtccgtttacggttaccgggcgggttacgaccgttaaggcgtaacgtcaacgttaacggtacctggtccgtacgaccgacgtaacctccgttcgtaacttcctttacccgtacg

SEQ ID NO: 57682 - DNA, 724 bp, Homo sapiens
  misc_feature: GYAE6OF02H32HY.18.23.C01.1.454.CMB.1.raw
  modified_base (708)..(708): a, c, t, g, unknown or other
  misc_feature (708)..(708): n is a, c, g, or t
tcagtacgagtatgcacgaccggtgctcgatttagtacacgtgattagggattgggggcaggagtcagacccagtcaggacacagcagtggacacgagggtccccgctcagctccgtggggctcctgctgctctggcctcccgaggttccagatgcgacactccaagactacgaccctacgttccccttcgtttcccgtgtctgcgtctagtaggacgaccgagtccaccactctacgttggtcggacaatacgaggtataacttaaaccgtggtttagtttaggtactcacgacaacgaaaccgaaggaaacacctaacgcgtacgacaagtatacgtacgttcggtacccgtacctaacgtttacgaaagccggttaccggggaccctacgtcggtacgtaccttccggtcgtaccaggtcggtactcgtagggtactaggttacttaccgacttccgtaaccactacgctaacgaccgtagcccgtcgacgtacgtaccgtagtaacgttactttcaaaccgtttaacttaacttacgttaccgtagcgtagacggtaccctacgtaccttaaccggttccctaaccgttaccgttacgtttaaccggacggtaacggtaccggtaaggggttagacgttaccggtaacgtaaaccgtaacggtgtaaccggttcaacgttacccacgttaaccgttcccgtttnttacccgttactaccg

SEQ ID NO: 57683 - DNA, 701 bp, Homo sapiens
  misc_feature: GYAE6OF02HQXGA.18.23.C01.1.454.CMB.1.raw
  modified_base (168)..(168): a, c, t, g, unknown or other
  misc_feature (168)..(168): n is a, c, g, or t
  modified_base (277)..(277): a, c, t, g, unknown or other
  misc_feature (277)..(277): n is a, c, g, or t
  modified_base (456)..(456): a, c, t, g, unknown or other
  misc_feature (456)..(456): n is a, c, g, or t
  modified_base (463)..(463): a, c, t, g, unknown or other
  misc_feature (463)..(463): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
  modified_base (532)..(532): a, c, t, g, unknown or other
  misc_feature (532)..(532): n is a, c, g, or t
  modified_base (654)..(654): a, c, t, g, unknown or other
  misc_feature (654)..(654): n is a, c, g, or t
  modified_base (689)..(689): a, c, t, g, unknown or other
  misc_feature (689)..(689): n is a, c, g, or t
tcagtacgagtatgcacgaccggtgctcgatttagtacacgtgattagggagttgggggcaggagtcagacccagtcaggacacagcatggacacggacgggtccccgctcagctccgtggggctcctgctgctcgtggctccccgtaggttccagactcgccgaacnctccagtactccggacccctcgttcccccttccgttccgtcggtcctcggtcgtacgttacggtagggacgtaccggacgtccacctactctacggttgggtccggganaacgttcgaaggtaacttaaccgttaaaaccgtgggttttaattggtactacgagactaacgaaaccgaagtaaacgccctaagctcggaactagtacttaggcgtttccggccttaccgtaacgttaaccgaggtaccggtccgggacccaggacgtacgtaccgtcggcgtaacggnaggtacnccggtaaggcctaaggtacctttcgtacgtcctaancgtaatacncgtaactacgaccgtcaccgtacncgtataacgttaggttataaccgtgttaacttacttcgtacttacggcgtaacgcgttaccgtattaccccgttactccgtaccgtaccgtcgtacgggacggaccgtaggacgtacggtanacggaacgtatggaccgacgtcgacacgacttctntaccttgtaccc

SEQ ID NO: 57684 - DNA, 720 bp, Homo sapiens
  misc_feature: GYAE6OF02JVRZV.18.23.C01.1.454.CMB.1.raw
  modified_base (431)..(431): a, c, t, g, unknown or other
  misc_feature (431)..(431): n is a, c, g, or t
  modified_base (707)..(707): a, c, t, g, unknown or other
  misc_feature (707)..(707): n is a, c, g, or t
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatcgaccctagttcccccttcttccgtgtctgtcgttacttggtaggacgaccgtagtccaacctatcctacgttttcgggccgggagtaaacttcgaaggtaacttaacgtttaaaaccgtggtttacgtttggtattcagtcaaacgaaacgaaggtaaaaccgccccttaaaggcgtcgacaggatacggtattccggtccgttacctgtttaccaaggtcgtccggggcccctaagtcggaatccgttccgacggtctacggtcggnttcgggtacgtaactagtacgtttcgaacctctaccgtacgtacgttccaagacctcgtcccgttagaccgacgtacgtagttaacgttactttcggaaccttacgtttaaccgttacgttagttcctaaggtcgtaccgaccgtacgtaaccttaccgttcgtaccgtcgttaccggttcggaccggtacggtacgtaggttacggtacgttacgtaaccgaaacggtacgttacggtcgtaccgttacgccacggttaccttcgttaccggttnttaccgttacccg

SEQ ID NO: 57685 - DNA, 936 bp, Homo sapiens
  misc_feature: GYAE6OF02FXUS5.18.23.C01.1.454.CMB.1.raw
  modified_base (133)..(133): a, c, t, g, unknown or other
  misc_feature (133)..(133): n is a, c, g, or t
  modified_base (191)..(191): a, c, t, g, unknown or other
  misc_feature (191)..(191): n is a, c, g, or t
tcagtacgagtatgcacgaccggtgctcgatttagtacacgtgattagggagttgggggcaggagtcagacccagtccaggacacagcatggacacgaggtcccgctcagctccgtgggactcctgctgctcnggctccgaggttccagatagcgacagtccagtatcgacctagtcccccttgttcccgngtacgtggccgttacgtaggtaggaccgtaccggacgttccacctaacgttccgtaacgttcggtaccggggtactaaacgtcgtaaagggtactttaaacgtttaaaaacccgggttgggttttaaggttttacgggttacgtaccgtaacggtaccgtaaaacggttaaaaccccggaaaagggtaaaaccccggtaccccctttaaaagggacccgttacggaaccggtaagttaaccgttagggttaaccggtttccgggtaccttaacgtttacccgttaacggtttaccgtaaaacgggtacggttcccggggtaacccctaacgggtaccggtaaggttaccgtttaccgggacgttaaccgtaggtacggggtacttaccggttagggaaccgtacggtttacctttacgaacccggttccttaaccgggaactcgtaccggtaaacgtccgggtaccgtaaccgttcggaaccgtaccggttacggtcgttaaaggtttacctttaccgggaaccttaaacgtttacggttaccgtttaacggaccgttaccggacggtaaccgtaaccgacccgttaacggtacccgtttaccgacccttacggttaaccggttcccgggaaaggtccgggtaacgaccggttacgggaactacgggttaaccccaaagggttcccgtaagggtaccctacggtaccgtaacgtaccgtttactacggttcccttagtaaccccg

SEQ ID NO: 57686 - DNA, 892 bp, Homo sapiens
  misc_feature: GYAE6OF02IMY19.18.23.C01.1.454.CMB.1.raw
  modified_base (300)..(300): a, c, t, g, unknown or other
  misc_feature (300)..(300): n is a, c, g, or t
tcagtacgagtatgcacgaccggtgctcgatttagtacacgtgattagggagttgggggcaggagtcagacccagtcaggacacagcatggacacgagggtccccgctcagctccgtggggctcctgctgtcctctggcctcccgtaggttcccagatcgacgtacatccgaaggtactcgtaccccgtcttcccccctttcgttcccggttagtcctggtaccgttccgtagggttaacgggacggaacccgtacgttcccaaacctaacttccgtaacggtttcggggacccgggtanaaaaccgtcggtaagggtaaacttttaaaaccgttttaaaaaccggtggggtttttaaacgtttgggttaacttaccgtaacggtaaccggaaaacggtaaaaccgaaacgggttaaaaacccggtaccccctaaggtacccgtgaaccgaggttaacgtaggtacgttacgggttaccctacgttaacgttaccgaaagtccgggtacccggacctacgtaccggtagtaacgttccccggagttccgtaggtacggtatccggtaacggtactacggtatttacctccgtacttaccacttacgactacggaccgaacgggtccctaggtacccgtaacggtcgtaacggtttaaaccgtaaagttttacccggaaacttactttaaacgttcgttaacgtacgttaccgaccgtagacccgtaaccttaaacgtacccgtttcgacgttaacccgttcggtacggggtaccggtaaaggtaaccgtaggtaacgagttaaccaaccgggtaaaagttccggtagtaccccggtagcccgtaaccgttaccgtaaagtttccggtttaccgttaccctttgtaaaccccg

SEQ ID NO: 57687 - DNA, 853 bp, Homo sapiens
  misc_feature: GYAE6OF02GH4HG.18.23.C01.1.454.CMB.1.raw
tcagtacgagtatgcacgaccggtgctcgatttagtacacgtgattagggattgggggcaggagtcagacccagtcaggacacagcatggacacgagggtcccgctcagctcctgggctcctgctgctctgctcccgaggttccagatcgcgacatccagatcgacccacgtccccttcgttccgtgtctgcgtctacggtaggacgaccgagtcaccagtcacgttggtcggacgaatcgaggtaattaacgttaaaaccgttggtttacgtttggtatcgagacgaaacgaaaccgaaggaaaaccgtccccgtaaagcgttacgacgagtatacgtacgttcggtacccgttaccgttaacgtttacccgaaaggtaccgtccggggaccccctagttaccggacgttacgttacccggcgttaccgaggttacggtacttaccggtacggaacgtaggttacctttacaaccttccgtacccaaccgtaacgtccgtaacggcctaacggtccctaggtacccgtaaccggtacccgttaaaggtaaaccgtttacgttttaaccgtaacccgttaaaccgttttaaccgtttaagttttaccgttaccgtaacggtaccggaacgggtacccgtaccgttaaaccgtttacccgttttaccccgacctttaccggtttaccgggtttacccggggaaccgggttaaaccggggaacccggttaaacggggtacggtaaccggttaaacgtaaacccgaaaaaccggttaccgttacggggtaaccggtaccgttaacgaacccgtacccgttaagtttacccggtacggttttacctactttaccccg

SEQ ID NO: 57688 - DNA, 727 bp, Homo sapiens
  misc_feature: GYAE6OF02JPMU9.18.23.C01.1.454.CMB.1.raw
  modified_base (222)..(222): a, c, t, g, unknown or other
  misc_feature (222)..(222): n is a, c, g, or t
  modified_base (548)..(548): a, c, t, g, unknown or other
  misc_feature (548)..(548): n is a, c, g, or t
  modified_base (687)..(687): a, c, t, g, unknown or other
  misc_feature (687)..(687): n is a, c, g, or t
  modified_base (696)..(696): a, c, t, g, unknown or other
  misc_feature (696)..(696): n is a, c, g, or t
  modified_base (717)..(717): a, c, t, g, unknown or other
  misc_feature (717)..(717): n is a, c, g, or t
tcagtacgagtatgcacgaccggtgctcgatttagtacacgtgattagggattgggggcaggagtcagacccagtcaggacacagcatggacacgagggtccccgctcagctcctgggctcctgctgctctgggtctcccaggttcccagatgcgacatccagatgacccacgtccccttcttccgtgtctgccgtctggtaggacgaccgagtccacctancgtacttggtcggtcgaactgaaggactacttaaaaccgttggttaggttttaggtacttacgacggtacaaaggaaaacccaacgggaaaacctaccccgtaacgtcgtacgacaggtaatagtagttcgggtaccccgttacgtacggttttaaccaggtacggtcccgggtaccccactacggtacggttaccttacccgtcgggtaccgtaggttacgtaacgtcgtacggggtaacctaggtttacgtttactaacctccgtaacaaccgtacttaccgaggcctaacgccgtcgaccgtaccggtactcggttaacgttntttacgaaccgtactttacgttactaggttacacggtcgaggtaccaccttaccgtaccgttaccctcgtaaccttggtacccggttcggaaacggaccgtagggacacgttacgtaacgaacggttacttggtaccgnggtaacccngttacccgatccggttcgttnccgttaaccg

SEQ ID NO: 57689 - DNA, 631 bp, Homo sapiens
  misc_feature: GYAE6OF02HSKDP.18.23.C01.1.454.CMB.1.raw
  modified_base (180)..(180): a, c, t, g, unknown or other
  misc_feature (180)..(180): n is a, c, g, or t
  modified_base (295)..(295): a, c, t, g, unknown or other
  misc_feature (295)..(295): n is a, c, g, or t
tcagtacgagtatgcacgaccggtgctcgatttagtacacgtgattagggattgggggcaggagtcagacccagtcaggacacagcatggacacgagggtcccgctcagctcctggggctccgtgctgctactggctcccaggttccagatgcgacatccagatgaccctagtccccttnttccgtgtctgcgtctggtacggagacccgtagtcaccactctacgttggtcggacaagtcagagctattagcagtcttaatttaaagttggtatcagacaagaaacgaggaacncccctaagcctcctgatcatcgctacatccgtagttcgacgtaaggtcgggtaccagtacgtaacggttcaggttgactagggtagtagtcgtaggggtactaggttacttccgacttccgtacaccgtatacgagtacctggtactcgaacgtaacctagtaaacgttactttacgaacgttacttacgtactacgtaacgtaagttacgtaacgtaccggtaccgtttaccgtttacgttacgttaccggacggtaaacgggtaacgcgtacgtaggaactcgttaaaccgaagtcgtacggtaccgctacgaccgtacgtactcgtcgttacg

SEQ ID NO: 57690 - DNA, 782 bp, Homo sapiens
  misc_feature: GYAE6OF02HVYLV.18.23.C01.1.454.CMB.1.raw
tcagtacgagtatgcacgaccggtgctcgatttagtacacgtgattagggattgggggcaggagtcagacccagtcaggacacagcatggacacgacgggtcccgctcgagctccgtggggctcctgctgctctcggcctccgtaggttccagacgtcggcgactactcaagtactcaacccgtaccgtttccctttcgttccggtcgtactcgtacgttcgtaggtacggaaacgaccggacgttaccaacctaactcctaacgtttcgggaccgggactaattaaccggaaggttaactttaaaaccggttaaacggtttcggtttacgttttacggtaactacgaacgaactaaaacggaaaccgtaaaacggaaccgtaaccccgtaagaccgtagaactaggtagtcgtacggttcgtaccgttacgtacgtacgaacgtacggtaccggtaccacgtacgtacgtacctcggtacgtacgtagtacgtacgtcggaggtacgtacttacgtctacgtcctctaactcaacgtcactcgtcacgtacgagacgttaaacgttacgtttaaacttaacttaaacgttattacgttacgttacgacgtacgcgtaaactcgttaactacgttcctaggttaccgttacggtaccgggaacggggtaaccgtaacggtaaggaactaccgtaacgtaacggtaacgtacggttacggtaccgactccgtaaggtcctttaacggtttacctaccgttttacgtacgtttaccctccccgg

SEQ ID NO: 57691 - DNA, 648 bp, Homo sapiens
  misc_feature: GYAE6OF02HWL3E.18.23.C01.1.454.CMB.1.raw
  modified_base (229)..(229): a, c, t, g, unknown or other
  misc_feature (229)..(229): n is a, c, g, or t
  modified_base (289)..(289): a, c, t, g, unknown or other
  misc_feature (289)..(289): n is a, c, g, or t
tcagtacgagtatgcacgaccggtgctcgatttagtacacgtgattagggattgggggcaggagtcagacccagtcaggacacagcatggacacgagggtccccgctcagcctcctggggctcctgctgctctggctcccaggttccagatgcgacatccagatgacccagtccccttcttccgtgtctgcgtctggtaggagaccgagtcaccatcacttggtcgggnaatcgaggaattacttaaaacgtggtttagttggtatcagacaagaaacgaaggaaaacncccctaagctgacagatgattcggtccgtacctagttaccaaggcgtccggggacccctagtcgagtacgtccgcgtacgaggtcggattcggtcgggactaagttactttaccactctaccaccatccagactacgcctggacacgcctagaacgttagtttcaacttaaactttacttagtttacgtacacgagtacggaccgtaccgtaacgttaaccgtttccccgtacgttaccgtaccgggtttccgggaaccgggtaacgggtacggtaaggggtccggaaggtaactaaccggaaactaccggtggacggttcgacgacctaccgtacgttcgttacgtccttactacccg

SEQ ID NO: 57692 - DNA, 571 bp, Homo sapiens
  misc_feature: GYAE6OF02GDFEV.18.23.C01.1.454.CMB.1.raw
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
  modified_base (480)..(480): a, c, t, g, unknown or other
  misc_feature (480)..(480): n is a, c, g, or t
  modified_base (492)..(492): a, c, t, g, unknown or other
  misc_feature (492)..(492): n is a, c, g, or t
  modified_base (521)..(521): a, c, t, g, unknown or other
  misc_feature (521)..(521): n is a, c, g, or t
  modified_base (539)..(539): a, c, t, g, unknown or other
  misc_feature (539)..(539): n is a, c, g, or t
tcagtacgagtatgcacgaccggtgctcgatttagtacacgtgattagggattgggggcaggagtcagaccccagtcaggacacagcatggacacgagggtccccgctcagctcctgggctcctgctgctctggctcccaggttccagatgcgacactccagatgacccagtccccttcttccgtgtctgctctgtaggcgaccgagtcaccatcacttggtcgggcaatcgaggtaataattaaaaccgttggttagtttggtactacagacaagaaaccgaaggaaaaccgcccctaaggcttcgacgagataggtgttacggtccgtcctacgtttaccaaggtacgtccgggacccctagtacgacgtactccgcgtcacgtggactcggtaggactagtactttcactctcgaccntacgngcacgtccagcgacgctagtaatnttacgacttaacttctatntcagtcaggcnctactacctccnctcgtcgttcggccggagtacgagtgtanacgtacaacgtaactggngaccgtgaccactagtcctcgtacttcgtacc

SEQ ID NO: 57693 - DNA, 861 bp, Homo sapiens
  misc_feature: GYAE6OF02ILRK9.18.23.C01.1.454.CMB.1.raw
  modified_base (156)..(156): a, c, t, g, unknown or other
  misc_feature (156)..(156): n is a, c, g, or t
  modified_base (203)..(203): a, c, t, g, unknown or other
  misc_feature (203)..(203): n is a, c, g, or t
tcagtacgagtatgcacgaccggtgctcgatttagtacacgtgattagggattgggggcaggagtcagacccagtaacaggacacagcatggacacgagggtcccgctcagctcctggggctcctgctgctctggctcccaggttccagatgcganatccagatgacccagtccccttcttccgtgtctgcgtctggtagganaccgatcacatctacgttcggcgggacaatcgaggtaattaacttaaaaccgtggtttagtttggtactcgagtacgaacgaaaccgtaaggaaaaccgtaccccgtaagccttgacgtaagtacgttggtaacgtttccggggtacccgttaccgttaacggtttacccgaaaggtccgggtccgggggtacccctaagtaccgggtaacgttaccgtttcccgggcgtacggtacggttacgggtaacgttccggtaacgggggtaacctaaggtttaacgttttaccaccgtttaccctaacccgtaaccttacgtaacgaccggtaccgtaccggtacccgttacgaccccggtaaggttaccgtaaggttaaacgttttacgtttacggaacctttaaaccggtttaacttacggtttaccggtaacgtaaccggtacggtaccgggtacctaaccgttaacccgttttaccggtcccccgtaagtttccggttaacccgggtttcgggaacccggggtaaacggtaacccggtaggggttaccggtacgtaaaccgtaccggaaaacccgggttacgtacccgggttacggaccttaacccgccttaaccgggttcttaacccgtttgtttaccccgttacgttacccccgg

SEQ ID NO: 57694 - DNA, 830 bp, Homo sapiens
  misc_feature: GYAE6OF02IJYVX.18.23.C01.1.454.CMB.1.raw
  modified_base (194)..(194): a, c, t, g, unknown or other
  misc_feature (194)..(194): n is a, c, g, or t
  modified_base (797)..(797): a, c, t, g, unknown or other
  misc_feature (797)..(797): n is a, c, g, or t
tcagtacgagtatgcacgaccggtgctcgatttagtacacgtgattagggattgggggcaggagtcagacccagtcaggacacagcatggacacgagggtcccgctcagctcctgggctcctgctgctctggactcccaggttccagatgcgacatcagatcgaccctagtccccttctccgtgtctgtcgttntacggtaggacgaccgtagtaccaccgtatccgtacgttcggtacggcgtaaatccgaaggtacttaaacgttaaaaccgttggttttacggtttaggtactcgatacgtaacgaaaaccgaaggaaaaccgaccccctaaggtcctacggacgtaacgtatacggtaacgttttccgggtacccggttacctacggttttaaccgaaaacgggttccggtaaccgggggtaacccccctaaggttacccggtaaacggttaccggtttaccgggaaccgttcgtaacgggtacgggttaattaccgggtaacgggtaacgtaaacgggtttaccttttaacgaccctttccgtttaacgacccctattcccggaataaccgacgtacccgtcgactaaaccggtctaacggttaaacttacgtttacgtaaacccgttaaactttaacgttcgttaagttaccgaagttaccgaacgtacgaccttaacgtaaccgttttaacccgccgttacgttacgggttacccggtcggaaacggtaacggtacgggttaaggacgttaacgaacgtaaacggaccgttaggtacgactacggttacncccgttataccgtcggttcctaccgttaacccg

SEQ ID NO: 57695 - DNA, 715 bp, Homo sapiens
  misc_feature: GYAE6OF02FKBOD.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctgggctcctgctgctctggctcccaggttccagatgcgacatccagatcgacccacgtccccttcttccgtgtctgcgtctgtaggagaccgagtcaccagtcacgttgtccgggactaattcgaaggtattaattaaaaccgtggttagtttggtatcagcaagaaaccaggaaacctcccctaagctagcgagactgtatcgtccgtctacgtttaccgaagtgtcggggacccctagtaccgagtacgttccgtacgtcgtaggtggtaacgtcggtggactacggttacttaccgactaccgttaccaacctacgtaccaggtaccgtacgtcccgtcgtaacccaacgttacgtaaacgtttactttacggaacccttaaaccgttacttaacgtttcgtaccgtagtaccgacgggtacctaaccgaacccgtttaacgtttacccccaccgtttacccttaacggttttccggggaccgggtaacgggaaaccgtagggtaccggaactacgtaaccgtaacggtaaccgtggtaaccggtctacggaaccttaccgtactaccgtttacgtaccctttacgtactttccccgg

SEQ ID NO: 57696 - DNA, 767 bp, Homo sapiens
  misc_feature: GYAE6OF02GXJIL.18.23.C01.1.454.CMB.1.raw
  modified_base (216)..(216): a, c, t, g, unknown or other
  misc_feature (216)..(216): n is a, c, g, or t
tcagtacgagtatgcacgaccggtgctcgatttagtacacgtgattagggagttgggggcaggagtcagacccagtcaggacacagcatggacacgagggtccccgctcagctcctggggctcctgctcgctcgtggctcccaggttccagatgcgacatccagatcgacccacgttcccccttcttcccgtgtcctgcgtctgtacggagaccgngtccaccatctacgttggtcggcaatcgaaggattaacttaaaaccgttggttaagtttcggtaagtctacgactaaacgaaaccaaaggaaaacctaccccgtaaagctagaccaaggtatggtaagttcgtacccgtaccgttagttaccgaaggtacgtccggggtacccccagtcgtaacggtcttacccggcgttacgaggttacggtacgtcgtaggggtaactaggtacttttacaccgtccttaaccgacctactacgtaaccagtaccgtacccgtacgggacctaccgggtaccgttacgggtaaacgttacggtttacgtaaccgtaaactttaaccttagtttaccgttacggaacgtacgtcgtaaccggtctaaaccgttaccttttaccccggaccttacccgtaaccgggtttaccgggtaccggggtaaacgggtaacccgaaggggtacctaggtaacgtaaccgaaacgttaccggtagggtacggccgttaaccggactaccgttataccgttcgttaccctaggttaccc

SEQ ID NO: 57697 - DNA, 797 bp, Homo sapiens
  misc_feature: GYAE6OF02GXIRH.18.23.C01.1.454.CMB.1.raw
  modified_base (561)..(561): a, c, t, g, unknown or other
  misc_feature (561)..(561): n is a, c, g, or t
  modified_base (765)..(765): a, c, t, g, unknown or other
  misc_feature (765)..(765): n is a, c, g, or t
tcagtacgagtatgcacgaccggtgctcgatttagtacacgtgattagggattgggggcaggagtcagacccagtcaggacacagcatggacacgagggtcccgctcagctcctggggctcctgctgctctggcctcccgacggttccagatcgcgacactccgagtatacgacccacgtccccttccgttccgtcgtctcgtccgtctcggtacggacgaccgacgtccgaacctacgtcgtacgtggttccgggacgtaaacgtccgaacggtaattaacgttaaaaacccgttgggtttacgtttacggtacttacgacgacgtaaacggtaaaaccgaaacgggtaaaaccgaccccgttaagccgtagaccgaagtacgtgtacgttccggtccgtacccttaagtttaccaaggaacgtcccggggacccctaggtaccgtaacggtaccgttaccggtccgtacgtaggtacggacttccggtagggaaccctagtacgttttacccgacttaccgtacctaccgacgttacaccggcgtaccggcgttaccgngaccgtaacggtcgttaaagtttccgtttgaacccttaaacgtttacttacgttacgacgtacgtcggtaacggtcccgaacttaccttaacggtttccccacgttaccgttttaccggacggggtcccgggaaacggtccgggttaagggacggttaactacaacccgggtaaacctacggttcggaccggtcgtggaacccnccggtttagacccgttttctaccgttatcccc

SEQ ID NO: 57698 - DNA, 684 bp, Homo sapiens
  misc_feature: GYAE6OF02IUKOM.18.23.C01.1.454.CMB.1.raw
tcagtacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatcgaccctacgtccccttcttccgtgtcgtgccgttctggtagggacgaccgagtaccacctatctacgttcggtcgggacctaagtccgaaggtaattaaacgttaaaaccgttgggttaagtttacggtattcgagacaacgaaaaccgaaggaaaacgtccccctaagcgtgacagtatgtaggttcggtccgtaccgtagtttaccaagtacggtccgggcccagtacgacgcttccggactcgaaggtcggtatcggacggacagtactttcaccgtctacgacatccgagctacgccagaccgacgtcgtagtacgtttacgttacgtacctaacgtttacgtactttcgacgtagtaccgcggtacctactaaccttacgtttaccccgacgttaccgtacgttacgggtaaccgggacggtaacccggaggtaccggtagtaacgtaacccggaaagtaaccggtgttccggtacgtacgacctacgtaccgttcgtaccttccgtactacccg

SEQ ID NO: 57699 - DNA, 1153 bp, Homo sapiens
  misc_feature: GYAE6OF02JIC48.18.23.C01.1.454.CMB.1.raw
tcagtacgagtatgcacgaccggtgctcgatttagtacacgtgattagggattgggggcaggagtcagacccagtcaggacacagcagtggacacgagggtccccgctcgaggctaccgtcggggctcctgccgttcgctctgggtcctcccgtaggttccagatcggacacacgtccagtatacgaccctacggttccccgttcgttaccggtgttccttacggtccggttacgttacggtacgggtaacgtaaccggtacggttaccgtaacccgagttaccctaaccgggtttacggtttacccgggggacgtaaactttacccggaacgggttaaaccttttaaacggttttaaaaaccccggtttgggggttttaacggtttttacgggttaaccttaccggtaacgggtaacgtaaaccggtaaaacccggtaaacgggtaaaaccccggtaccccgtaaacggtccggtacgtacggtagtacgttacggtacggttttccgggtaccggtttaccgtaacgttttaccgaagggttaccggtccgggtaaccccgtcgttaccggtacgttacgttacccggaccggttacgtacggttacggtaacgtcgggttaacggaccggtttaacgttacgtttaccgtaaccggttaccctttaaccgtaacccgttaacggtacccgtaacccggaccgggtaacccctttacccgggtacgtaacccgtttaacccgggtaaccggttaaaccgtttaaacgggttttacgtttaaaccggtacccgtttttaaaacccggtttaaccggtttacgtttacccggttaacggttaaccgggttacccgggtaaacccggttacccggtaaacggtttaaaccccggtttaacccggtttaacccggtttaccggtttaacccggtttaaccccggggttttacccgggggtaaacggggtttaaaccccgggtttaacccgggggaagggggttaaaccccgggttacggaaacccgggtttaaccggttaaaaccggggttaacgttcccgggttaaccgggttaccggtaacccgggttaccccgttaaccggtttcccgggtaaaccttttcccgggttaaacccggttttaccttaccccgg

SEQ ID NO: 57700 - DNA, 268 bp, Homo sapiens
  misc_feature: GYAE6OF01ER0UQ.1.67.G01.1.454.CMB.1.raw
  modified_base (263)..(268): a, c, t, g, unknown or other
  misc_feature (263)..(268): n is a, c, g, or t
tcagacgagtgcgtcacgaccggtgctcgatttagagtatacatattgggcagtgggtctgggacagagttcactctcaccatcaccagtctgcagtctgaagattttgcagtttattactgtcagcagtataatgactggcctccgatcaccttcggccaagggacacgactggatattagacgaactgtggctgcaccatctgtcttcatcttcccgccatctgaacgcactcgtctgagcgggctggcaaggcgcatagnnnnnn

SEQ ID NO: 57701 - DNA, 259 bp, Homo sapiens
  misc_feature: GYAE6OF01BEZGF.1.67.G01.1.454.CMB.1.raw
  modified_base (259)..(259): a, c, t, g, unknown or other
  misc_feature (259)..(259): n is a, c, g, or t
tcagacgagtgcgtcacgaccggtgctcgatttagagtatacatatcgcgggggagttgagcttcagcagctgacccaggactctgttcccctttggtgagaagggttttgttcagcaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatagn

SEQ ID NO: 57702 - DNA, 373 bp, Homo sapiens
  misc_feature: GYAE6OF01CSP3V.1.67.G01.1.454.CMB.1.raw
  modified_base (366)..(373): a, c, t, g, unknown or other
  misc_feature (366)..(373): n is a, c, g, or t
tcagacgagtgcgtcacgaccggtgctcgatttagagtatacatattgggtttgggggttgttcactggtaccagcaccttccaggaacaaccccaaactcctcatctatgttgacaccaatcggccctcaggggtccctgaccgattctctggctccaagtctggcacctcagcctccctggccatcactgggctccaggctgaggatgaggctgattatactgccagtcctatgacagtagcctgaatggttggtgttcggcggagggaccaagttgaccgtctaggtcagcccaaggctgcccctggtcactctcgttccgccctcctcacgactcgtctgagcggctggcaaggcgcatagnnnnnnnn

SEQ ID NO: 57703 - DNA, 762 bp, Homo sapiens
  misc_feature: GYAE6OF01CRZ5M.1.67.G01.1.454.CMB.1.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
tcagacgagtgcgtcacgaccggtgctcgatttagagtatacatattgggtttggggaggaactgctcagttaggacccagacggaaccatggaagccccagcgcagcttctcttcctcctgctactctggctcccagataccactggagaaatagtgatgactcagtctccagccaccctgtctgtctctccgaggggaagngcccaccctctcctgcgagggccagtcagagtgttagcgganaaattgcctggtaccagacagaacctggccaggcctcccgaggcctccctactacttctagtcggtcgaccacgtcccaccgacgggtccctacgtcggtactccccgaggacccgtaggttccaggtcgggcctagggtcggggttacctggggaactaggtaacgttcccaaccgttccgtacctaacccgtactacccgaacggcccgtaccgtacccgtcggtaccgtacggtttaccgttaacgggtaaaggtttacgttttacggaccgtttaaggttttttactttccgtttagttacgttacggttaaccgtaagtttaacgttaaccgttaccgtaaccggtttccgggtacccgtttaccgggttacctttacggttttaccgggaccggttaaccggggacccgtaaagggtccgttaacggggtaagttaccggttaaacccgaaacccgggttacgttacgggtacggttaccgacccggtacgtaaccccgttactttcccgg

SEQ ID NO: 57704 - DNA, 269 bp, Homo sapiens
  misc_feature: GYAE6OF02HP6KP.1.67.G01.1.454.CMB.1.raw
  modified_base (230)..(230): a, c, t, g, unknown or other
  misc_feature (230)..(230): n is a, c, g, or t
  modified_base (263)..(269): a, c, t, g, unknown or other
  misc_feature (263)..(269): n is a, c, g, or t
tcagacgagtgcgtcacgaccggtgctcgatttagagtatacatattgggcagtgggtctgggacagagttcactctcaccatcaccagtctgcagtctgaagatttttgcagtttattactgtcagcagtataatgactggcctccgatcaccttcggccaagggacacgactggatattagacgaactgtggctgcaccatctgtcttcatcttcccgcatctgaacncactcgtctgagcgggctggcaaggcgcatagnnnnnnn

SEQ ID NO: 57705 - DNA, 317 bp, Homo sapiens
  misc_feature: GYAE6OF02JXMWK.1.67.G01.1.454.CMB.1.raw
  modified_base (195)..(195): a, c, t, g, unknown or other
  misc_feature (195)..(195): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (302)..(317): a, c, t, g, unknown or other
  misc_feature (302)..(317): n is a, c, g, or t
tcagacgagtgcgtcacgaccggtgctcgatttagagtatacatattggcagtgggtctgggacagagttcactctcaccatcaccagtctgcagtctgaagattttgcagtttattactgtcagtcagtataatgactggcctcgatcaccttcgcaaggcacgactggatatagacgactgtgactgacaccntactgtcttcgattctcccgacattctcgaacgctactcgttctggagtccgggactgggactaaaggccggtccaaaggtncgtcngntcgncnangtnangtnannnnnnnnnnnnnnnn

SEQ ID NO: 57706 - DNA, 272 bp, Homo sapiens
  misc_feature: GYAE6OF02I14DK.1.67.G01.1.454.CMB.1.raw
  modified_base (263)..(272): a, c, t, g, unknown or other
  misc_feature (263)..(272): n is a, c, g, or t
tcagacgagtgcgtcacgaccggtgctcgatttagagtatacatatcgcgggggagttgagcttcagcagctgacccaggactctgttcccctttggtgagaagggtttttgttcagcaagacaatggagagctctcactgtggtggacgttcggccaagggaccaaggtgaaatcaaacgaactgtgctgcaccatctgtcttcatcttcccgccatctgaacgcactcgtctgagcgggctggcaaggcgcataaggctgnnnnnnnnnn

SEQ ID NO: 57707 - DNA, 452 bp, Homo sapiens
  misc_feature: GYAE6OF01D3NN9.37.33.C11.1.454.CMB.1.raw
  modified_base (449)..(452): a, c, t, g, unknown or other
  misc_feature (449)..(452): n is a, c, g, or t
tcagtagtgtagatcacgaccggtgctcgatttagagtgagctcgttgggtttgggggaagaggaagactgacggtccgccaggctccagggaaggggctggagtgggtggccaacataaagcgagatggaagcgagaaatactatgtggactctgtggaggggccgattcaccatctccacagacaacgccaagaaatcaatcttttgcaaatgaacagtctgagagccgaggacacggctatttattactgcgcgagagaaggactgggcggtttcgactactggggccagggaaccctggtcaccgtctcctcagcctccaccaagggcccatcggtcttcccctggcgccctgctccaggagcacctccgagagcacagcggccctggctgcctggtcaaggactactcatctacactactgagcgggctggcaaggcgcatagnnnn

SEQ ID NO: 57708 - DNA, 484 bp, Homo sapiens
  misc_feature: GYAE6OF01DKKXX.37.33.C11.1.454.CMB.1.raw
  modified_base (479)..(484): a, c, t, g, unknown or other
  misc_feature (479)..(484): n is a, c, g, or t
tcagtagtgtagatcacgaccggtgctcgatttagagtgagctcgttgggtttggggtccctgagactctcctgtgcaacctctggattcagttgtagtgattgttggatgggttggtccgccaggctccagggaaggggctggagtgggtggccaacataaagcgagatggaagcgagaaatactatgtggactctgtgaggggccgattcaccatctccacagacaacgccaagaaatcaaatctttttgcaaatgaacagtctgagagtcgaggacacggccatgtattactgtacgagagaacagacttggggccagggaaccctggtcaccgtctcctcagcctccaccaagggcccatcggtcttcccctggcaccctcctccaagagcacctctgggggcacagcggccctgggctgcctggtcaaggctacttccatctacactactgagcgggctggcaaggcgcatagnnnnnn

SEQ ID NO: 57709 - DNA, 535 bp, Homo sapiens
  misc_feature: GYAE6OF01BNGEG.37.33.C11.1.454.CMB.1.raw
  modified_base (375)..(375): a, c, t, g, unknown or other
  misc_feature (375)..(375): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttgcctggtatcaacagaaaccagggaaagcccctaaggtcctgagtctatgatgcctcactttggaaagcgggtcccatcaaggttcagcggcagtgtatcgtgggacagaattcactctcaccatcagtancctgcagcctagattgaattttgactaactttattactgtcagtcaactataagtgggagtacgttaccgggcggtaagggacctaggggttagaacgtatacgaaaacgtaacgtgtaggacttcgactacctatcttgtacttcagttccttaccccg

SEQ ID NO: 57710 - DNA, 421 bp, Homo sapiens
  misc_feature: GYAE6OF01D5CYY.37.33.C11.1.454.CMB.1.raw
  modified_base (416)..(421): a, c, t, g, unknown or other
  misc_feature (416)..(421): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggcgccctgctccaggagcacctccgagagcacagcggccctgggctgcctggtcaaggctactccatctacactactgagcgggctggcaaggcgcatagnnnnnn

SEQ ID NO: 57711 - DNA, 498 bp, Homo sapiens
  misc_feature: GYAE6OF01B8JDS.37.33.C11.1.454.CMB.1.raw
  modified_base (376)..(376): a, c, t, g, unknown or other
  misc_feature (376)..(376): n is a, c, g, or t
  modified_base (428)..(428): a, c, t, g, unknown or other
  misc_feature (428)..(428): n is a, c, g, or t
tcagtagtgtagatcacgaccggtgctcgatttagagtgagctcgttgggtttggggtcagactcagtcaggacacagcatggacatgagggtccccgctcagctcctggggctcctgctgctctggctcccaggagccaaatgtggacagtccaggatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcgcagtgtatctgggacagaattcactctcaccatcagtancctgcagcctgatgattttgctaacttattactgtcagcactataatggganagttcggacgaggaccgaggttgagatacaaacgacgtgtgctgcaccagtctgtcttcatccttacccg

SEQ ID NO: 57712 - DNA, 494 bp, Homo sapiens
  misc_feature: GYAE6OF01CPIGP.37.33.C11.1.454.CMB.1.raw
tcagtagtgtagatcacgaccggtgctcgatttagagtgagctcgttgggtttggggtcagactcagtcaggacacagcatggacatgagggtccccgctcagctcctggggctcctgctgctctggctcccaggagccaaatgtgacatccagatgactcagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcggggtcccatcaaggttcagcggcagtgtatctggacagaattcatctcaccatcagtagcctgcagcctgatgattttgctaacttattactgtcagtcactataatgggagtattcggacgagggaccaggggttgagatcgaaacgactgtggctgcacatactgtcttcgattcccg

SEQ ID NO: 57713 - DNA, 486 bp, Homo sapiens
  misc_feature: GYAE6OF01BDZVH.37.33.C11.1.454.CMB.1.raw
  modified_base (478)..(478): a, c, t, g, unknown or other
  misc_feature (478)..(478): n is a, c, g, or t
tcagtagtgtagatcacgaccggtgctcgatttagagtgagctcgttgggtttggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctcactttggaaagcgggtcccatcaaggttcagcggcagtgtatctgggacagaattcactctcacatcagtagcctgcagcctgatgatttgactaacttattactgtcagtcactataatgggagattcggcgaggaccagggttgagatcgaaacgatgtgctgcacatctgtctcntcgtcccg

SEQ ID NO: 57714 - DNA, 495 bp, Homo sapiens
  misc_feature: GYAE6OF01D87AZ.37.33.C11.1.454.CMB.1.raw
  modified_base (488)..(488): a, c, t, g, unknown or other
  misc_feature (488)..(488): n is a, c, g, or t
tcagtagtgtagatcacgaccggtgctcgatttagagtgagctcgttgggtttggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagtaaaaccagggaaagcccctaaggtcctgatctatgatgcctcactttggaaagcgggtcccatcaaggttcagcggcagtgtatctgggacagaattcactctcaccatcagtagcctgcagcctgatgattttgctaacttattactgtcagcactataatgggagattcggccgagggaccagggttgagatcgaaacgaacgtgtaggctgcacatctgtcttcntctcccg

SEQ ID NO: 57715 - DNA, 516 bp, Homo sapiens
  misc_feature: GYAE6OF01CB8GS.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcggcagtgtatcgtgggacagaattcactctcaccatcagtagcctgcagcctgacttgtattttgctaactttattactgtcagctactataatgggagtagttcggccggagggaccagggttgaagatacgaaaacgacttggtgcgtgaccacctattctgttcttcattccttccccg

SEQ ID NO: 57716 - DNA, 416 bp, Homo sapiens
  misc_feature: GYAE6OF01CP0E1.37.33.C11.1.454.CMB.1.raw
  modified_base (329)..(329): a, c, t, g, unknown or other
  misc_feature (329)..(329): n is a, c, g, or t
  modified_base (344)..(344): a, c, t, g, unknown or other
  misc_feature (344)..(344): n is a, c, g, or t
  modified_base (410)..(416): a, c, t, g, unknown or other
  misc_feature (410)..(416): n is a, c, g, or t
tcagtagtgtagatcacgaccggtgctcgatttagagtgagctcgttgggtccgccaggctccagggaagggctggagtgggtggccaacataaagcgagatggaagcgagaaatactatgtggactctgtgagggccgattcaccatctccacagacaacgccaagaaatcaatcttttgcaaatgaacagtctgagagtcgaggacacggccatgtattactgtacgagagaacagacttggggccagggaaccctggtcaccgtctcctcagcctccaccaagggccccatccggtccttccccctggccgccctgctccaggacncacctcgagagcacngcgccctggctgcctggtcaaggctacttccatctacactactgagcggctggcaaggcgcatagnnnnnnn

SEQ ID NO: 57717 - DNA, 433 bp, Homo sapiens
  misc_feature: GYAE6OF01B9ECS.37.33.C11.1.454.CMB.1.raw
  modified_base (403)..(403): a, c, t, g, unknown or other
  misc_feature (403)..(403): n is a, c, g, or t
  modified_base (410)..(411): a, c, t, g, unknown or other
  misc_feature (410)..(411): n is a, c, g, or t
  modified_base (420)..(420): a, c, t, g, unknown or other
  misc_feature (420)..(420): n is a, c, g, or t
  modified_base (426)..(433): a, c, t, g, unknown or other
  misc_feature (426)..(433): n is a, c, g, or t
tcagtagtgtagatcacgaccggtgctcgatttagagtgagctcggttgggtccgcccaaggctcccagggaaggggctcggagtgggtggccaacataaagcgagatggaagcgagaaatactatgtggactctgtggaggggccgagttcaccatctccacagacaacgccaagaaatcaatctttttgcaaatgaacagtctgagagtcgaggacacggccatgtatactgtacgagagaacagacgttggggcaggggaaccctggtcaccgtctcctcagcctccaccaagggccccagtccggtccttcccccgtggccgccctgcctccgaggagccacctccgagagcacagcgaccctgggctgcctggtcaaggactactcatctacactacngagcggnngacaaggcncatagnnnnnnnn

SEQ ID NO: 57718 - DNA, 569 bp, Homo sapiens
  misc_feature: GYAE6OF01C3X8A.37.33.C11.1.454.CMB.1.raw
  modified_base (328)..(328): a, c, t, g, unknown or other
  misc_feature (328)..(328): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgaggagacagagtcaccatcacttgccgggcagtcgactatagtacctggttgctggtatcaacagaaaccaggaaacgcccctaaggtcctgatctatgatgcctccactttggaaagcgggtccatcaaggtcagcgnagtgtatcgtagggacagtaattcactctacaccatcagtagcctgcagcctgatgtattttgactaactttattactgtacaagtcaactaataagtagggagtaacgttccgggaccggaaggggaccgtaaggggttagaaggtactaacgaaaaacgtaacgtcggttagggaccttcggaccctaaccgtaactttccgttacgttacctttacctaacttcccgtttaacccccg

SEQ ID NO: 57719 - DNA, 502 bp, Homo sapiens
  misc_feature: GYAE6OF01D9PFP.37.33.C11.1.454.CMB.1.raw
  modified_base (450)..(450): a, c, t, g, unknown or other
  misc_feature (450)..(450): n is a, c, g, or t
  modified_base (452)..(453): a, c, t, g, unknown or other
  misc_feature (452)..(453): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (459)..(460): a, c, t, g, unknown or other
  misc_feature (459)..(460): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (474)..(475): a, c, t, g, unknown or other
  misc_feature (474)..(475): n is a, c, g, or t
  modified_base (477)..(477): a, c, t, g, unknown or other
  misc_feature (477)..(477): n is a, c, g, or t
  modified_base (483)..(493): a, c, t, g, unknown or other
  misc_feature (483)..(493): n is a, c, g, or t
  modified_base (495)..(495): a, c, t, g, unknown or other
  misc_feature (495)..(495): n is a, c, g, or t
  modified_base (497)..(502): a, c, t, g, unknown or other
  misc_feature (497)..(502): n is a, c, g, or t
tcagtagtgtagatcacgaccggtgctcgattttagagtgagctcgttggggtccgccaggactccaggggaagggggtctggagtcgggtgggcctaacattaaagcgagatggaagcggagaaatactatgtggacgtctgtgaggggccgattccaccatctccacacgactaacgccaagaaatcgaatctttttggcaaatgaacagtctgaagagtcgaggacacggcctatgtattactgtaacgaagaagaaacagtacttggggccagggaacctggtacaaccgtcgtcctcaccgcctccaccaagggtcccagtccggtcttcccccgtcgggccgtccccgtgcctcccaggcgcaccgtccgagacgcacgagcggcctggctgcctgcaagctacttcatctacatactgagcgggctggtcaaggcgcaatgancnncncntnngtgngngacagcannanagctgnnnnnnnnnnncncnnnnnn

SEQ ID NO: 57720 - DNA, 811 bp, Homo sapiens
  misc_feature: GYAE6OF01DERCK.37.33.C11.1.454.CMB.1.raw
  modified_base (97)..(97): a, c, t, g, unknown or other
  misc_feature (97)..(97): n is a, c, g, or t
  modified_base (188)..(188): a, c, t, g, unknown or other
  misc_feature (188)..(188): n is a, c, g, or t
tcagtagtgtagatcacgaccggtgctcgatttagagtgagctcgttgggtttggggtcaggactcagtcaggacacagcatggacatgaggtcccntcagctctgggctctgctgctctggctccaggagccaaatgtgacatccagatcgaccagtctccttccacctgtctgctatctgtagganacagatcacatcacttgccggcagtcgactattagtaccgtggttcgaccttaggtactcgaaacgtagtaaaccgagggtaaactcccgtaaaggtcctaggtaactaccgtaacgtcgtaacgttcgtaccttaccgtaacgttttacgggaaaacggtccggggttacccctaagttaccgtaaacgggtttacctaacgggttaccggtaactaacgggtttacgtttaacgttccggtaacggggtaacctaacggtaaacgtttcccgaaacgttcccgtaacgtaacccgtaacgttaccgtaacggttaaccgtcccttagggtaccgtaacggtcccgtttaggtaacgttacggttaacgtttttacggacctttaaacgttttaacgttaaccgttacggttactaacggttactaaccgtttaaacgttaacggttacgggtaacgttacgtttacccgggacggttaacgggtacccgttaggggttacgtaacggtacgttaccgtaaaacggttaccggttcggtacggtacgttacggaacccttaaccggttacgttaccgttacggttaaccctttcgtaaaccggttcccgtttaacccccggg

SEQ ID NO: 57721 - DNA, 415 bp, Homo sapiens
  misc_feature: GYAE6OF01EM4DD.37.33.C11.1.454.CMB.1.raw
  modified_base (406)..(406): a, c, t, g, unknown or other
  misc_feature (406)..(406): n is a, c, g, or t
  modified_base (412)..(415): a, c, t, g, unknown or other
  misc_feature (412)..(415): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcncatagnnnn

SEQ ID NO: 57722 - DNA, 495 bp, Homo sapiens
  misc_feature: GYAE6OF01ETSUF.37.33.C11.1.454.CMB.1.raw
  modified_base (487)..(487): a, c, t, g, unknown or other
  misc_feature (487)..(487): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaagcgggtcccatcaaggttcagcggcagtgtatctgggacagaattcactctcaccatcagtagcctgcagcctgatgattttgctaacttattactgtcagcactatatgggatagttcggcgagggaccagggttgagatacaaacgacgtggtgactgcacatctgtcttcntctccccg

SEQ ID NO: 57723 - DNA, 585 bp, Homo sapiens
  misc_feature: GYAE6OF01A4GEJ.37.33.C11.1.454.CMB.1.raw
  modified_base (146)..(146): a, c, t, g, unknown or other
  misc_feature (146)..(146): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccagggagccaaagngtcggacagtcccaaggacgtcgaaccctagtctccttccaccctgtctgcatctgtaggagacagatcaccatcacttgccgggccagtcggactattagtacctggttggcctggtatcaacagaaaccagggaaacgcccctaaggtcctgatctatgatcgcctcactttggaaagcgggtcccatcaaggttcagcggcagtgtatcgtgggacagtaattcactctcaccagtcagtacnctncagctnatagtattcacttaatttatactgtacagtactaactaagtaagtagggtacgtacggttaccgggaccgggtaacggggtaccgtaggggttacgaaggtaactaaccgtaaaacggtacgtgggtacggacgtcgaccgtaacctacgttcgttacgttccttacctccttccccgtacccg

SEQ ID NO: 57724 - DNA, 515 bp, Homo sapiens
  misc_feature: GYAE6OF01B6PON.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtccctgatctatgatgcctcactttggaaacgcgggtcccatcaaggttcagcggcagtgtatcgtgggacagaattcactctcaccatcagtagcctgcagcctgatgtattttgctaacttattactgtcagctactataagtgggatagttcggaccgagggaccgagggttgagtatacgaaacgtaacgtggtagctgaccacagtctgtacttcattccttaccccg

SEQ ID NO: 57725 - DNA, 453 bp, Homo sapiens
  misc_feature: GYAE6OF01BGYGK.37.33.C11.1.454.CMB.1.raw
  modified_base (447)..(453): a, c, t, g, unknown or other
  misc_feature (447)..(453): n is a, c, g, or t
tcagtagtgtagatcacgaccggtgctcgatttagagtgagctcgttgggtttgggggaagaggaagactgacggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagccctccaccaagggcccatccggtcttccccctggccgccctgcctccaggacgccacctccgagacgcacagccggccctgggctgcctggtcaaggactacttccatcctacactactgagcgggctggcaaggcgcatagnnnnnnn

SEQ ID NO: 57726 - DNA, 501 bp, Homo sapiens
  misc_feature: GYAE6OF01BFLS8.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcggcagtgtatctgggacagaatcactctcaccatcagtacgctgcagcctgatgtattttgactaactttattactgtcagcaactataagtgggagagttcggacgagggaccgagggttgagatacaaagacgtgtagctgcacatctgtcttcatcctcccg

SEQ ID NO: 57727 - DNA, 457 bp, Homo sapiens
  misc_feature: GYAE6OF01DULM8.37.33.C11.1.454.CMB.1.raw
  modified_base (424)..(457): a, c, t, g, unknown or other
  misc_feature (424)..(457): n is a, c, g, or t
tcagtagtgtagatcacgaccggtgctcgatttagagtgagctcgttgggtttgggtccgaccgaggctccagggaaggggctggagtgggtggccaacataaagcgagatggaagcgagaaatactatgtggactctgtgaggggccgattcaccatctccacagtacaacgccaagaaatcaatctttttgcaaatggaacagtctgagagtcgaggacacggccatgtatactgtacgagagaacagacttggggccagggaaccctggtcacgtctcctcacgcctccaccaagggcccatcggtcttcccctggcgccctgctccaggagccacctccgagtacgcacagcggcctgggctgcctggtcaaggctacttccatctacactactgagcgggctggacaaggcgcatagtnnnnnnnnnnnnnnnnnnnnnnnnnnnnnnnnnn

SEQ ID NO: 57728 - DNA, 506 bp, Homo sapiens
  misc_feature: GYAE6OF01ED6DP.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccaggatgacccagtctccttcaccctgtctgcatctgtaggagacagagtcaccatcacttgccgggccagtcggactattagtacctggttggcctggtatcaacagaaaccagggaaagcccctaaaggtcctgatctatgatgcctccactttggaagcgggtcccatcaaggttcagcggcagtgtatctgggacagaattcactctacaccatcagtagcctgcagcctgatgtattttgactaactttattactgtcagtcactataagtggagagttcggcgagggacctagggttagagtatacaaagtacgtgtggctgcacatctagtcttcatcctacccg

SEQ ID NO: 57729 - DNA, 447 bp, Homo sapiens
  misc_feature: GYAE6OF01DRNPQ.37.33.C11.1.454.CMB.1.raw
  modified_base (440)..(447): a, c, t, g, unknown or other
  misc_feature (440)..(447): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaaagaaatcaattctttttgacaaatgaacagtctgagagtcgaggacacggccatgtattactgtacgagagaacagacgttggggccagggaaccctggtcaccgtctcctcagcctctaccaagggccccatccggtcttccccctggccgcccctgcctccgaggacgccacctccgagagccacacggccggccctggggcctggcctggtcaaggacctacttccatcctacactactgacgcgggctggcaaggcacatagnnnnnnnn

SEQ ID NO: 57730 - DNA, 587 bp, Homo sapiens
  misc_feature: GYAE6OF01DQ0HM.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttgcctggtatcaacagaaaccagggaaacgcccctaaggtcctgatctatgatgccctccactttggaaagcgggtcccatcaaggttcagcggcagtgtatcgtgggacagaattcactctcaccatcagtagcctgacagcctgatgtatttgactaactttacttactgtacagtacaacttataaagttgggaagtacgtttcgggaccggacggggtaacccgtaggggttacgaagtacgttaccgaaaacggtaacgttagggttagggaccttgggaccctaacccgtacgtttaccgttacggtttcctttacctactttccccgtttacccccg

SEQ ID NO: 57731 - DNA, 497 bp, Homo sapiens
  misc_feature: GYAE6OF01BTNOL.37.33.C11.1.454.CMB.1.raw
  modified_base (488)..(488): a, c, t, g, unknown or other
  misc_feature (488)..(488): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccagatgacccagtctccttccaccctgtctgcatctgtaggagacagagtcaccatcacttgccgggccagtcggactattagtacctggttggcctggtatcaacagaaaccagggaaagcccctaaaggtcctgatctatgatgcctcactttggaaagcgggtcccatcaaggttcagcgcagtgtatctgggacagaattcactctcaccatcagtagctgcagcctgatgattttgctaacttattactgtcagcactataatggagagttcggcgagggaccgagggttgagatacgaaacgacgtgtagctgcacatctgtacttcnttcgtcccg

SEQ ID NO: 57732 - DNA, 490 bp, Homo sapiens
  misc_feature: GYAE6OF01BXY36.37.33.C11.1.454.CMB.1.raw
  modified_base (425)..(425): a, c, t, g, unknown or other
  misc_feature (425)..(425): n is a, c, g, or t
  modified_base (479)..(479): a, c, t, g, unknown or other
  misc_feature (479)..(479): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccaggggaaagcccctaaggtcctgatctatgatgcctcactttggaaagcgggtcccatcaaggttcagcggcagtgtatctgggacagaattcactctcaccatcagtagcctgcagcctgatgattttgctaattatactgtcagcactataatggganattcggcgagggccagggttgagatcaaacgtactgtaggctgcaccatctgtnttcatctcccg

SEQ ID NO: 57733 - DNA, 561 bp, Homo sapiens
  misc_feature: GYAE6OF01CSPTM.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggcagtcgactatagtacctggttggcctggtatcaaacagaaaccagggaaacgcccctaaggtcctagatctatgatcgcctctacgtttaggaaacgcgggtacccatacgaaggttcaggcgcagtgtatcgtagggacagtaatcactctacactatcagtacgctgcagcctagatagtattttgactaactttatactgtacagctaactagtaagtagggagtacgttccgggaccgtaagggaccgtagggttacgaagtaataacgaaaacggtaacgtggtaggactacggacctaccgtacttcctagttccttacctagttcccttaccccg

SEQ ID NO: 57734 - DNA, 417 bp, Homo sapiens
  misc_feature: GYAE6OF01DXB02.37.33.C11.1.454.CMB.1.raw
  modified_base (413)..(417): a, c, t, g, unknown or other
  misc_feature (413)..(417): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaattctttttgcaaatgaacagtctgagagtcgaggacacggccatgtattactgtacgagagaacagacttggggccagggaaccctggtcaccgtctcctcagcctccaccaagggcccatccggtcttccccctggcgcccctgctccaggagcacctcgagagcacagcgcctgggctgcctggtcaaggctactccatctacactactgagcgggctgggcaagggcgcatagnnnnn

SEQ ID NO: 57735 - DNA, 583 bp, Homo sapiens
  misc_feature: GYAE6OF01E457U.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggccagtcggactattagtacctggttgcctggtatcaacagaaaccagggaaacgccccgtaaggcctgatctatgatcgcctcctactttggaaacgtcgggtcccatcgaaggttcagcggcagtgtactcgtgggacagaacttcactctcaccatcagtagccctgcacgcctgattgtattttgacttaattattactgtactagtactaactaagtaagtagggtagtacgttacgggaccggtacgggtaccgtaggggttcgaagtacgtaacgaaaacgtacgttgggtacggacctcgaccctaaccgttacgttccgttacggttaccttaccgttccgttcccgttacccccgg

SEQ ID NO: 57736 - DNA, 496 bp, Homo sapiens
  misc_feature: GYAE6OF01B2L6V.37.33.C11.1.454.CMB.1.raw
  modified_base (488)..(488): a, c, t, g, unknown or other
  misc_feature (488)..(488): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccaggggaaagcccctaaggtcctgatctatgatgcctcactttggaagcgggtcccatcaaggttcagcggcagtgtatctgggacagaattcactctcaccatcagtagcctgcagcctgatgtattttgctaactttattactgtcagtcactataatgggagtattcgggccgagggaccagggttgagatacaaagactgtgctgccacatctgtcttcnttctcccg

SEQ ID NO: 57737 - DNA, 426 bp, Homo sapiens
  misc_feature: GYAE6OF01C99QT.37.33.C11.1.454.CMB.1.raw
  modified_base (311)..(311): a, c, t, g, unknown or other
  misc_feature (311)..(311): n is a, c, g, or t
  modified_base (420)..(426): a, c, t, g, unknown or other
  misc_feature (420)..(426): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccaggggaaccctggtcaccgtctcctcagcctccaccaagggccccatcggtcttcccccnggccgccctgctccaggacgcacctccgagagcacagccggccctgggctgcctggtcaaggactacttccatctacactactgagcgggctggcaaggcgacaatagnnnnnnn

SEQ ID NO: 57738 - DNA, 490 bp, Homo sapiens
  misc_feature: GYAE6OF01E3OTB.37.33.C11.1.454.CMB.1.raw
  modified_base (482)..(490): a, c, t, g, unknown or other
  misc_feature (482)..(490): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttcccctggcgccctgctccaggacgcacctccgagagcacagcggccctgggctgcctggcaaggctacttccatctacactactgagcgggctggcaaggcgcatagnnnnnnnnn

SEQ ID NO: 57739 - DNA, 493 bp, Homo sapiens
  misc_feature: GYAE6OF01D3G49.37.33.C11.1.454.CMB.1.raw
  modified_base (485)..(493): a, c, t, g, unknown or other
  misc_feature (485)..(493): n is a, c, g, or t
tcagtagtgtagatcacgaccggtgctcgatttagagtgagctcgttgggtttgggggtccctgagactctcctgtgcaacctctggattcagttgtagtgattgttggatgggttgggtccgccaggctccagggaaggggctggagtgggtggccaacataaaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggccccatcggtcttccccctggccgccctgctccaggacgcacctccgagagcacagcggccctgggctgcctggtcaaggctacttccatctacactactgagcgggctggcaaggcgcatagnnnnnnnnn

SEQ ID NO: 57740 - DNA, 640 bp, Homo sapiens
  misc_feature: GYAE6OF01B9606.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccacctgtctgcatctgtaggagacagacgtcacatcacttgccggcagtcgactattacgtaccgtggttcggcctaggtatacgaacaacgaaaccgaaggggaaaccgtaccccgtaaggtcctaggactactagtcgactcgtccctacctaacgtttacggaaacggtccggggtaccctagtacgtaacggttcgacggtccggacgtaggttacgtagtaccggtagggaactaagtaattccaacttctacacctatacgagtacgctagcacgcctagtattgtacttttgacttaacttattactgtacagtactaacttagtaacgagggtacgtacgttaccgggaccggtaagggtaccgtagggttagaggtaacgtaaccgaaacggtacgtggtacggactcgaccgtaacttacgtcgtttacgtacctttcgtccgtttccgttaccccg

SEQ ID NO: 57741 - DNA, 508 bp, Homo sapiens
  misc_feature: GYAE6OF01D8A9N.37.33.C11.1.454.CMB.1.raw
  modified_base (498)..(498): a, c, t, g, unknown or other
  misc_feature (498)..(498): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctcactttggaagcgggtcccatcaaggttcagcggcagtgtatctgggacagaattcactctcaccatcagtagcctgcagcctgatgtattttgctaactttattactgtcagcactataagtgggagtacgttcgggccgagggaccgtagggttgagtatacgaaacgacgtgtaggctgcacatctgtcttcntccttccccg

SEQ ID NO: 57742 - DNA, 511 bp, Homo sapiens
  misc_feature: GYAE6OF01EIEI8.37.33.C11.1.454.CMB.1.raw
  modified_base (427)..(427): a, c, t, g, unknown or other
  misc_feature (427)..(427): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctcactttggaaagcgggtcccatcaaggttcagcggcagtgtatcgtggacagatcactctcacatcagtagcctgcagcctgatgtattttgactaactttattactgtcagctatataagtggganagttcggacgagggaccgtagggttgagatacgaaacgacgtggtgctgacctacagttctagttccttcattccgttaccccg

SEQ ID NO: 57743 - DNA, 509 bp, Homo sapiens
  misc_feature: GYAE6OF01B7JRF.37.33.C11.1.454.CMB.1.raw
  modified_base (477)..(477): a, c, t, g, unknown or other
  misc_feature (477)..(477): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggccagtcggactattagtacctggttgcctggtatcaacagaaaccagggaaagcccctaaggtcctgatctatgatgcctcactttggaaagcgggtcccatcaaggttcagcggcagtgtatctgggacagaattcactctcaccatcagtagcctgcagcctgatgtattttgactaacttattactgtaagcactataagtgggaagagttcgggaccgagggaccagggttgagatacaaacgtaacgtggtggntggcaccatctgtcttcacttccttcccgacc

SEQ ID NO: 57744 - DNA, 599 bp, Homo sapiens
  misc_feature: GYAE6OF01D2152.37.33.C11.1.454.CMB.1.raw
  modified_base (275)..(275): a, c, t, g, unknown or other
  misc_feature (275)..(275): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcgactattagtacctggttggcctaggtatacaaacagaaaccagggaacncccctaaggtcctagactcagtgtactcgtcctccgtaacggtttacgggaaacgtcgggtaccagtacgtaggtcaggcgactgtagtatgaggacaagtacttcactctaccactagtaccgagtcgtcctagcctagaccttgtaactttgacttttacgactttaacgtttattaacgtcacgtaactactaacgtaagaggtacggagtacgtaccgggaacgggtacggtaacgtagggtagtacgaacgttaaacgtaaacgtacgttcggacgactcgacctacgtactcttactaccttctccgtcccttacccg

SEQ ID NO: 57745 - DNA, 414 bp, Homo sapiens
  misc_feature: GYAE6OF01E2RK9.37.33.C11.1.454.CMB.1.raw
  modified_base (410)..(414): a, c, t, g, unknown or other
  misc_feature (410)..(414): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaaggcccatcggtcttcccctggcgccctgctccaggagcacctccgagagcacagcggccctgggctgcctggtcaaggctacttccatctacactactgagcgggctggcaaggcgcatagnnnnn

SEQ ID NO: 57746 - DNA, 552 bp, Homo sapiens
  misc_feature: GYAE6OF01B704A.37.33.C11.1.454.CMB.1.raw
  modified_base (274)..(274): a, c, t, g, unknown or other
  misc_feature (274)..(274): n is a, c, g, or t
  modified_base (415)..(415): a, c, t, g, unknown or other
  misc_feature (415)..(415): n is a, c, g, or t
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacatccagatgacccagtctccttccaccctgtctgcatctgtaggagacagagtcaccatcacttgccgggccagtcggactattgtacctggttggcctggtatcaaacagaaaccaggggaaacncccctaaggtcctgatctatgatcgcctcctacgtttaggtaaacggccgggtacccgatacgaaggttacgacgcggcagtgtatcgtggacagtattcactctcacatacagtacgctgcacgcgtagtatgttatttnactaaactttattacgtgtcagactactaataagtaggagtacgttcgggacggagggtacgagggttagagtaactacgaaacgtagtggtggctggacctacgattcttacgtactttcagtttcccgtaccccg

SEQ ID NO: 57747 - DNA, 440 bp, Homo sapiens
  misc_feature: GYAE6OF01DZSAV.37.33.C11.1.454.CMB.1.raw
  modified_base (437)..(440): a, c, t, g, unknown or other
  misc_feature (437)..(440): n is a, c, g, or t
tcagtagtgtagatcacgaccggtgctcgatttagagtgagctcgttgggtttgggggaagaggaagactgacggtccgccaggctccagggaaggggctggagtgggtggccaacataaagcgagatggaagcgagaaatactatgtggactctgtgaggggccgattcaccatctccacagacaacgccaagaaatcaatctttttgcaaaatgaacagtctgagagtcgaggacacggccatgtattactgtacgagagaacagacttggggccagggaaccctggtcaccgtctcctcagcctccaccaagggcccatcggtctcccctggcgccctgctccaggagcacctccgagagcacagcggccctgggctgcctggtcaaggactacttccatctacactactgagcgggctggcaaggcgcatagnnnn

SEQ ID NO: 57748 - DNA, 419 bp, Homo sapiens
  misc_feature: GYAE6OF01DSP1M.37.33.C11.1.454.CMB.1.raw
  modified_base (415)..(419): a, c, t, g, unknown or other
  misc_feature (415)..(419): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaaggcccatcggtcttccccctggccgccctgctccaggacgcacctccgagagcacagccggccctgggctgcctggtcaaaggctacttcccatctacactactgagcgggctggcaaggcgcatgnnnnn

SEQ ID NO: 57749 - DNA, 599 bp, Homo sapiens
  misc_feature: GYAE6OF01DDXCZ.37.33.C11.1.454.CMB.1.raw
  modified_base (275)..(275): a, c, t, g, unknown or other
  misc_feature (275)..(275): n is a, c, g, or t
  modified_base (369)..(369): a, c, t, g, unknown or other
  misc_feature (369)..(369): n is a, c, g, or t
  modified_base (495)..(495): a, c, t, g, unknown or other
  misc_feature (495)..(495): n is a, c, g, or t
  modified_base (578)..(578): a, c, t, g, unknown or other
  misc_feature (578)..(578): n is a, c, g, or t
tcagtagtgtagatcacgaccggtgctcgatttagagtgagctcgttgggtttgggggtcagactcagtcaggacacagcatggacatgagggtcccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaacnccccgtaaggtcctgatctatgatgcctcacgtttggaacgcgggtccatcgaaggttcagcggcagtgtatcgtagggacaagattcacttcncacactcagtacgcctgcagcctgtatgtaattttcgacttaactttacttactgtactagtcctaacttagtaaagtggggtataacgtttcggggaccggaaggggtacccgtagggggtttanaacggtaataaaccgaacggtaaacgtcggttacggggtcttacggaccctaaccgtacttcgttacggttcccttttaaccnccgttttccccgttacccccg

SEQ ID NO: 57750 - DNA, 555 bp, Homo sapiens
  misc_feature: GYAE6OF01D856C.37.33.C11.1.454.CMB.1.raw
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (414)..(414): a, c, t, g, unknown or other
  misc_feature (414)..(414): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacagtccaggatgacccagtctccttccaccctgtctgcatctgtaggagacagagtcaccatcacttgccgggccagtcgactattagtacctggttgcctggtatcaacagaaaccagggaaagcccctaaggtcctgatctatgatgcctccactttggaaacgcgggtcccatcaaggttcagcggcagtgtatcgtgggacagaacttcactctcaccatcagtacnctgcagcctnatgtatttgactaactttattactntcagcactaagtaagtagggagtagttcggaccgaggggacctaggggttacgaaggacttaaccgaaacggtaacgttggtaggacgtcggaccaacctaacgttccttacgttacctttcgaccgtttccttacccccg

SEQ ID NO: 57751 - DNA, 511 bp, Homo sapiens
  misc_feature: GYAE6OF01AVK46.37.33.C11.1.454.CMB.1.raw
  modified_base (501)..(501): a, c, t, g, unknown or other
  misc_feature (501)..(501): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcggcagtgtatcgtgggacagaattcactctcaccatcagtagcctgcagcctgatgtattttgactaacttattactgtcagcactataagtgggagtagttcggaccgagggaccgagggttgagatacgaaacgtaacgtggtgacgtgacaccatctgtcttcnttcctccccg

SEQ ID NO: 57752 - DNA, 418 bp, Homo sapiens
  misc_feature: GYAE6OF01DGGV6.37.33.C11.1.454.CMB.1.raw
  modified_base (415)..(418): a, c, t, g, unknown or other
  misc_feature (415)..(418): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccttggtcaccgtctcctcagcctccaccaacgggcccatccggtcttccccctggccgccctgcctccaggagcacctccgagagcacagcggccctgggctgcctggtcaaggctactccatctacactactgagcgggctggcaaggcgcatagnnnn

SEQ ID NO: 57753 - DNA, 505 bp, Homo sapiens
  misc_feature: GYAE6OF01BKVGK.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcgcagtgtatctggacagaattcactctcaccatcagtagcctgcagcctgatgtattttgctaacttattactgtcagcactataagtgggagtattcggaccgtagggaccgagggttgagatacgaaacgtactggtgactgacaccatctgtacttcattccttcccg

SEQ ID NO: 57754 - DNA, 688 bp, Homo sapiens
  misc_feature: GYAE6OF01CJ373.37.33.C11.1.454.CMB.1.raw
tcagtagtgtagatcacgaccggtgctcgatttagagtgagctcgttgggtttgggggtcagactcagtcaggacacagcatggacatggacgggtccccgctcagctccgtggggctcctgctgctctggctcccaggagccaaatgtgacatccagatcgaccctagtcctccttccaccctgtctgcatctgtaggagacagacgtcaccatcgacgttcggacccgggcaggtcggaacttagttacggtacctggttcggccgttaggtatcaaacgaacggaaaccgagggaacgaccctaaggtcctagacttctatgaactcgtaccctctaacgtttagggaaacggtccgggtaccagtacgtaagttccaggcgacgtagtcgtacgtcgtagggaactacggtaatttccaccttactaccaaccgtactacgtacgacgtccgtagaccgtagtccgtagtaagttagttagttttacggaccttaacttttaagttaccgtgttaaccagtacgtaacttaaggttaacgagggtaagtacggtttcggaacggtaggtaaccgtagggttacgaagtaacctaacggaaacggttacgtgggtaggaccctacgggtacctaacctacggtttacctacgtttacctttcctaacgtttccccgtaacccccg

SEQ ID NO: 57755 - DNA, 562 bp, Homo sapiens
  misc_feature: GYAE6OF01DOCV6.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggccagtcgactatagtacctggttgcctggtatcaacagaaaccgagggaaacgcccctaaggtcctgatctatgatcgcctccacgtttaggaacgcgggtacccagtcaaggttcagcggcagtgtatcgtgggaacagtaattcactctacacatcagtacgcctgctacgctgtatagtattttacgacttaactttattactgtcagtctaactaagtaagtgggtagtacgttaccgggcggaagggtaccgtagggttagaagtactaacgaaacgtacgtggtacgctacggacctaccgtattcgtacgttcctttaccacgttcccgttaccccg

SEQ ID NO: 57756 - DNA, 542 bp, Homo sapiens
  misc_feature: GYAE6OF01DN3HY.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggccagtcggactatagtacctggttggcctggtatcaacagaaaccagggaaacgcccctaaggtcctgatctatgactgcctcactttggaaagcgggtccatcaagttcagcggcagtgtatctgggacagattcactctcaccatcagtagcctgcagcctgatgtattttgactaactttattacgtgtcacgtactactagtaagtgggagtacgttcgggaccggtagggaccgtagggttcgaagtacgtacgaaacgtacgtcggtagtacgtgacctactacgttcctacggtacctttcgacttccgtacccccg

SEQ ID NO: 57757 - DNA, 480 bp, Homo sapiens
  misc_feature: GYAE6OF01D8V3N.37.33.C11.1.454.CMB.1.raw
  modified_base (386)..(386): a, c, t, g, unknown or other
  misc_feature (386)..(386): n is a, c, g, or t
  modified_base (473)..(480): a, c, t, g, unknown or other
  misc_feature (473)..(480): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaaaaaactcactgtatctgcaaatggacggcctgagatccgaggacacggctgtgtattattgtgcgagagattttagactacaaagtttcgagtgactggtatgatgcttatgataccgtggggccaaggggaccatggtcaccgtctcttcagccctccaccaagggcccagtccggtccttcccccctgggcccgccctgcctccgaggacnccaccctccgagacgcacagccggccctgggctgcctggcaaggctacttccatctacactactgagcggctggcaaggcgcatagnnnnnnnn

SEQ ID NO: 57758 - DNA, 505 bp, Homo sapiens
  misc_feature: GYAE6OF01C9TI6.37.33.C11.1.454.CMB.1.raw
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgatatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaagcgggtcccatcaaggttcagcggcagtgtatctgggacagaattcactctcaccatcagtagcctgcagcctgatgtattttgctaacttattactgtcagcactataatgggagagttcggccgagggaccagggttcaagtatacgaaacgacgtgtggctgacaccattctgttnttcnttcttaccccg

SEQ ID NO: 57759 - DNA, 612 bp, Homo sapiens
  misc_feature: GYAE6OF01AHQJN.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggacacagagtcaccatcacttgccgggccagtcggactattagtacctggttggcctggtatcaacagaaaccaggggaaacgcccctaaggtcctgatctatgatgcctcactttggaaagcgggtccatcaaggttcagcggcagtgtatcgtagggactagaattcgacttctacaccatccaagtacgcctgccagcctagatgtattttagactaactttatacttgtacacgtactaacttaattaaggtaggggtaagtacggtttaccgggacccggtaagggggtacccgtaggggtttacggaaggtaactaaaccggaaaaccggtaacgttacggttacgggaccttggaccctaaccgtacgttacccgttagtttaccttaccctaacgtttcccgttaccccccg

SEQ ID NO: 57760 - DNA, 540 bp, Homo sapiens
  misc_feature: GYAE6OF01C8TSH.37.33.C11.1.454.CMB.1.raw
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
  modified_base (491)..(491): a, c, t, g, unknown or other
  misc_feature (491)..(491): n is a, c, g, or t
  modified_base (526)..(526): a, c, t, g, unknown or other
  misc_feature (526)..(526): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccagggaaagcccctaaaggtcctgatctatgatgcctccactttggaaagcggggtcccatcaaaggttcagtcggcagtgtatcgtggacagattcactcncacatcagtacgcctgcagcctgattgtaattttgactaactttacttacgtntacgatactaataagtaacgnggagtcggtcggacggtacggaggttggagagtaacaacgtaacgtagtggngtacgtcgactaactcgttacttacgttcttaccnctttcccgtacccg

SEQ ID NO: 57761 - DNA, 449 bp, Homo sapiens
  misc_feature: GYAE6OF01BL0JJ.37.33.C11.1.454.CMB.1.raw
  modified_base (441)..(449): a, c, t, g, unknown or other
  misc_feature (441)..(449): n is a, c, g, or t
tcagtagtgtagatcacgaccggtgctcgatttagagtgagctcgttgggtttggggggaagaggaagactgacggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttcccctggccgccctgctccaggacgccacctccgagagcacagcggccctgggctgcctggtcaaggactacttccatctacactactgagcgggctggcaaggcgcatagnnnnnnnnn

SEQ ID NO: 57762 - DNA, 651 bp, Homo sapiens
  misc_feature: GYAE6OF01CXJOY.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccgagggaaacgcccctaaggtcctgatctatgatcgcctcctacgtttaggaaaggtccggggtacccagtcgtaagggttcaggtccggactaggttagtactcgtagggaacaaggtaacttcgaactctaccacctatcagtacgcctgcagtccctagtattcgtagttttcgacttaaacgtttacttactgtacaacgtactaacttaagtaacgttagggagttaacggttccgggaccggtaggggaaccgtagggggttacgaaggtaacgtaaaccggaaaacggtaacgttcgggttacggaccgttcggacccgaaccgttaacgttccgtttacggtttacccttttaccgtaccgtttccccgttaccccccgg

SEQ ID NO: 57763 - DNA, 597 bp, Homo sapiens
  misc_feature: GYAE6OF01BFUSE.37.33.C11.1.454.CMB.1.raw
  modified_base (374)..(374): a, c, t, g, unknown or other
  misc_feature (374)..(374): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaacgcccctaaggtcctgatctatgatgcctcactttggaaagcgggtccatcaaggttcagcggcagtgtatctgggacagaattcactctcaccatcagtancctgcacgcctgattgtattttgactaatttattactgtacagtctaacttataagtgggtaagtacgtttacggggcccggtaaggggtacccgtagggggtttacgaaggtaacgttaccgaaaaaccggtaacgttgggttagggtacgttcggaccctaacccgtaacgtttccgttacggtttaccctttactaaccgtttccccgtttaaccccccg

SEQ ID NO: 57764 - DNA, 564 bp, Homo sapiens
  misc_feature: GYAE6OF01A2PDV.37.33.C11.1.454.CMB.1.raw
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (267)..(268): a, c, t, g, unknown or other
  misc_feature (267)..(268): n is a, c, g, or t
tcagtagtgtagatcacgaccggtgctcgatttagagtgagctcgttgggtttggggtcagactcagtcaggacacagcatggacatgagggtccccgctcagctcctggggctcctgctgctctggctcccaggagctaagtgcggactgcaaggcgtcactagctctcactgcngcatngagagacagntcacatcactgccggcagtcgatatagtctgtcgctgtanacanagaacgaggaacnccgtaagtctgactgtatnnctctctacgtagtacggtcgtactactacgtacgtacgacgcgcgtagtagtagtcgtagagtacgtacgtactactactactacactacgtacgtacgtcgtacgactacgtcgtagtagttacgttacgtttacgtaacttaacttacgttacgtacgtacgtacgtactacgtaagtaagtaggtacgtacggtacggtacggtacggtacggtaggtacgtacgtacgtaacgtaacgtacgtacgtagtacgtcgtactacgtacgtacgtactactactcgtccgtaccg

SEQ ID NO: 57765 - DNA, 419 bp, Homo sapiens
  misc_feature: GYAE6OF01D3J7Q.37.33.C11.1.454.CMB.1.raw
  modified_base (414)..(419): a, c, t, g, unknown or other
  misc_feature (414)..(419): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaattctttttgcaaatgaacagtctgagagtcgaggacacggccatgtattactgtacgagagaacagacttggggccagggaaccctggtcaccgtctcctcagcctccaccaaggcccatcggtcttccccctggccgccctgctccaggacgcacctccgagagcacagccggccctgggctgcctggtcaaggctacttccatctacactactgagcggctggcaaggcgcatagnnnnnn

SEQ ID NO: 57766 - DNA, 503 bp, Homo sapiens
  misc_feature: GYAE6OF01EYG9V.37.33.C11.1.454.CMB.1.raw
  modified_base (453)..(453): a, c, t, g, unknown or other
  misc_feature (453)..(453): n is a, c, g, or t
  modified_base (482)..(482): a, c, t, g, unknown or other
  misc_feature (482)..(482): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttgcctggtatcaacagaaaccagggaaagcccctaaggtcctgatctatgatgcctccactttggaaagcgggtccatcaaggttcagcggcagtgtatctgggacagaattcactctcaccatcagtagcctgcagcctagatgtattttgctaattattactgtacagcataataatgggagtagttcggccgagggaccaggggttnagtatacgaaacgagtggtgctgcaaccntctgtacttctatcgtacccg

SEQ ID NO: 57767 - DNA, 475 bp, Homo sapiens
  misc_feature: GYAE6OF01BW1L3.37.33.C11.1.454.CMB.1.raw
  modified_base (466)..(475): a, c, t, g, unknown or other
  misc_feature (466)..(475): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtggaggggccgattcaccatctccacagacaacgccaaagaaatcaattctttttgcaaatgaacagtctgagagtcgaggacacggccatgtattactgtacgagagaacagacgttggggccagggaaccctggtcaccgtctcctcagcctccaccaacggcccatccggtccttcccccgtggccgccctcgcctccgaggacgccaccctccgagacgcacacggccggccctggggcctcggcccgtgggtaccgaaacgggtaccttacctttacccacttcctaaccaccttacgtggacgccgggctgggacaagggcgcagtagnnnnnnnnnn

SEQ ID NO: 57768 - DNA, 546 bp, Homo sapiens
  misc_feature: GYAE6OF01D48ZT.37.33.C11.1.454.CMB.1.raw
  modified_base (373)..(373): a, c, t, g, unknown or other
  misc_feature (373)..(373): n is a, c, g, or t
  modified_base (537)..(537): a, c, t, g, unknown or other
  misc_feature (537)..(537): n is a, c, g, or t
tcagtagtgtagatcacgaccggtgctcgatttagagtgagctcgttgggtttggggttcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggacttattagacctggttggcctggtatcaacagaaaccagggaaacgcccctaagctcctcatctatggtgcatccagtttacaaactgggtccattaagattcagcgcagtggatcgtggcacagtacttcactctcacatcaancagctgcacgctagaagtatttgaccttaattaacttactgttactaacgaataattaactaaacttaccctacgttaccgttcggaaccgaacgggtaccgaaggtacggaagtacgaaacgtaacgtagtcggctacgccaacgtacttactagttacttcntttaccccg

SEQ ID NO: 57769 - DNA, 540 bp, Homo sapiens
  misc_feature: GYAE6OF01CJQ1Y.37.33.C11.1.454.CMB.1.raw
  modified_base (425)..(425): a, c, t, g, unknown or other
  misc_feature (425)..(425): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaacgcccctaaggtcctgatctatgatgcctcactttggaacgcgggtcccatcaaggttcagcggcagtgtatcgtgggacagtaattcactctcaccatcagtacgctgcagcctgatgtattttcgactaactttatactgtcagctaactanaagtgggagtagtcggaccgagggtaccgagggttacgagtaagtaccgaaacgtacgtggtaggactcggacctaccgtagttcttacgtacctttcacgttcccgttaccccg

SEQ ID NO: 57770 - DNA, 506 bp, Homo sapiens
  misc_feature: GYAE6OF01AUNDC.37.33.C11.1.454.CMB.1.raw
  modified_base (476)..(476): a, c, t, g, unknown or other
  misc_feature (476)..(476): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaaggtcctgatctatgatgcctccactttggaaagcgggtcccatcaaggttcagcggcagtgtatctgggacagaattcactctcaccatcagtagcctgtagcctgatgtattttgactaacttattactgtcagcactataatgggatagttcggccgagggaccgtagggttgagatacaaacgactgtcggntgcaccatctgttcttcacttccttcccgc

SEQ ID NO: 57771 - DNA, 595 bp, Homo sapiens
  misc_feature: GYAE6OF01DD2L0.37.33.C11.1.454.CMB.1.raw
  modified_base (554)..(554): a, c, t, g, unknown or other
  misc_feature (554)..(554): n is a, c, g, or t
  modified_base (556)..(557): a, c, t, g, unknown or other
  misc_feature (556)..(557): n is a, c, g, or t
  modified_base (559)..(562): a, c, t, g, unknown or other
  misc_feature (559)..(562): n is a, c, g, or t
  modified_base (564)..(577): a, c, t, g, unknown or other
  misc_feature (564)..(577): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(595): a, c, t, g, unknown or other
  misc_feature (583)..(595): n is a, c, g, or t
tcagtagtgtagatcacgaccggtgctcgatttagagtgagctcgttgggtccgggccaggcgtccgagggaaggggctggagtggggtggccaacataaagcgagagtggaagcgagaaatactatgtggactctgtgaggggccgattcaccatcgtccacagacaacgccaagaaatcaattctttttgcaaatgaacagtctgagagtcgaggacacggccatgtattactgtaacgagagaaacagaacgttggggccaggggaaccctggtacctaccgttctcctcacgaccctaccaaccgaacgggcccagtcccggtacccttccccccgtggccgtacccttgcctaccgaggacgacctacccgtccggaacgacgaccgaccgacggccggtccccgtggggtccttcggcccgttacgggtaaccaaaggggtacccttaaccgtttccccaagttaccctaacctaccctttacccgttgggaaccggtccggggtcttacggggaccaaacggggcccggtactaaggtagctagtgngnntnnnntnnnnnnnnnnnnnngngngnnnnnnnnnnnnn

SEQ ID NO: 57772 - DNA, 637 bp, Homo sapiens
  misc_feature: GYAE6OF01BBF79.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaacgcccctaaggtcctgatctatgatcgcctcactttggaaacgcgggtcccagtcaaggttcagcggcagtgtatcgtgggacagaacttcactctacacatcagtacgcctgcacgtcctgattgtattttacgacttaactttattacgttagtccaagtacctaacttaagttaacgtaggggtaacgttacggttaccggggacccggtaacgggggtaaccctaggggggtttacgaacgggtaacgttaaaccggaaaaaccggtaacggttcgggtacgggtaccgttcgacccggtaaacccttacgtttaccgttacgtttaccctttaccgtaccgtttccccgtttaccccccg

SEQ ID NO: 57773 - DNA, 505 bp, Homo sapiens
  misc_feature: GYAE6OF01AR1VR.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccagggaaacgcccctaaggtcctgatctatgatgcctccactttggaaacgcggggtcccatcaaggttcagcgcagtgtatctgggacagaattcactctcaccatcagtacgctgcagcctgatgattttcgactaacttattactgtcagcaactataagtggagtagtcggacgagggaccgtagggttgagatacgaaacgtacgtgtggctgacacatctgtcttcatcgtacccg

SEQ ID NO: 57774 - DNA, 589 bp, Homo sapiens
  misc_feature: GYAE6OF01E513U.37.33.C11.1.454.CMB.1.raw
  modified_base (418)..(418): a, c, t, g, unknown or other
  misc_feature (418)..(418): n is a, c, g, or t
  modified_base (570)..(570): a, c, t, g, unknown or other
  misc_feature (570)..(570): n is a, c, g, or t
  modified_base (574)..(574): a, c, t, g, unknown or other
  misc_feature (574)..(574): n is a, c, g, or t
  modified_base (576)..(577): a, c, t, g, unknown or other
  misc_feature (576)..(577): n is a, c, g, or t
  modified_base (581)..(581): a, c, t, g, unknown or other
  misc_feature (581)..(581): n is a, c, g, or t
  modified_base (583)..(585): a, c, t, g, unknown or other
  misc_feature (583)..(585): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
tcagtagtgtagatcacgaccggtgctcgatttagagtgagctcgttgggtttgggggggtccctgagactctcctgtgcaacctctggattcagttgtagtgattgttggatggggttgggtccgccaggctccagggaaggggctggagtgggtggccaacataaagcgagatggaagcgagaaatactatggtggactctgtggaggggccgattcaccatctccacagacaacgccaagaaatcaattctttttgacaaatgaacagtctgagagtcgaggacacggccatgtattactggtacgagagaacagacgttcggggccagggaaccctggtccaccgtctcctcagcctccgaccgaacgggcccagtccggtccttccccgtggccgccctcgctccgagggacnccaccctccgagcgcacgacggccggcccgtgggcctcggtcccgtgggtaccgaacgggtacctaccgttcccgattacctaccgaaccttacgtacggtacgggccgggtcgtacgggaccgaacgggtccggaccgacgtaagctacgncgcncnncgcncnnngngn

SEQ ID NO: 57775 - DNA, 503 bp, Homo sapiens
  misc_feature: GYAE6OF01A3RP9.37.33.C11.1.454.CMB.1.raw
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccaagatgacccagtctccttccaccctgtctgcatctgtaggagacagagtcaccatcacttgccgggccagtcggactattagtacctgttggcctggtatcaacagaaaccagggaaagcccctaaggtcctgatctatgatgcctcactttggaaagcggggtcccatcaaggttcagcggcagtgtatctgggacagaattcactctcaccatcagtagcctgcagcctgatgtattttgactaacttattactgtcagcatatagngganattcggccgagggacgaggttgagatacgaaacgacgtgtaggctgcacattctgttacttcacttcgtccccg

SEQ ID NO: 57776 - DNA, 529 bp, Homo sapiens
  misc_feature: GYAE6OF01DKIBC.37.33.C11.1.454.CMB.1.raw
  modified_base (369)..(369): a, c, t, g, unknown or other
  misc_feature (369)..(369): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttcaccctgtctgcatctgtaggagacagagtcaccatcacttgccgggccagtcggactattagtacctggttgcctggtatcaacagaaaccaggaaagcccctaaggtcctgatctatgatgcctccactttaggaagcgggtccatcaaggttcagcggcagtgtatctggacagattcactctcactatcagtancctgctagcctgatgtatttgactaactttatactgtcagtctaactataacgtgggtagtacgttcggccggaagggtacctagggttagaacgataccgaaacgtacgtggtggcttgacctaccgattcgtacgttccttactcttcccttaccccg

SEQ ID NO: 57777 - DNA, 562 bp, Homo sapiens
  misc_feature: GYAE6OF01AUF67.37.33.C11.1.454.CMB.1.raw
  modified_base (442)..(442): a, c, t, g, unknown or other
  misc_feature (442)..(442): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaacgcccctaaggtcctgatctatgatgcctccactttggaaacgcgggtcccagtcaaggttcagcggcagtgtatcgtgggacagtaattcactctcacatcagtacgcctgcagcctgatgtattttgactaactttattactgtacagtctaactaataagtgggtaanaggtttaccggacggtaacgggaccgtaggggttagaacgtagtaaccgaaaacggtaacgtggtagggacttcggacctaaccacgttaccgtgttaccttactcttcccgttaccccg

SEQ ID NO: 57778 - DNA, 519 bp, Homo sapiens
  misc_feature: GYAE6OF01A5JSE.37.33.C11.1.454.CMB.1.raw
  modified_base (101)..(101): a, c, t, g, unknown or other
  misc_feature (101)..(101): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (365)..(365): a, c, t, g, unknown or other
  misc_feature (365)..(365): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (478)..(478): a, c, t, g, unknown or other
  misc_feature (478)..(478): n is a, c, g, or t
tcagtagtgtagatcacgaccggtgctcgatttagagtgagctcgttgggtttgggggtcgagactcagtcaggacacagcatggacatgagggtccccgntcagctcctggggctcctgctgctctggctcccaggagccaaatgtggacagtccaaggatcgaccctagtcctccttccacctgtctgacatctgtaggagactagatcacagtcacgtgccggcagtcgactattgacctgtgctgtatcaanagaaccaggaacnccctaaggtccngatcatgatcgcctcacgtttggaaacgtcgggtccagtcaaggtcaggcgcagtgtatcgtggacagtacttcactctcaccntacagtacgcctgctagcttgatcgttattcgactaatttctatcganacgataactataagtgggatacgttcggacgaggtacgaggtganactacgaaacgtcgttgcgntacgtcaactgttacgtgtaccttcaacgttcccttacccg

SEQ ID NO: 57779 - DNA, 468 bp, Homo sapiens
  misc_feature: GYAE6OF01D7SR9.37.33.C11.1.454.CMB.1.raw
  modified_base (363)..(363): a, c, t, g, unknown or other
  misc_feature (363)..(363): n is a, c, g, or t
  modified_base (448)..(448): a, c, t, g, unknown or other
  misc_feature (448)..(448): n is a, c, g, or t
  modified_base (455)..(468): a, c, t, g, unknown or other
  misc_feature (455)..(468): n is a, c, g, or t
tcagtagtgtagatcacgaccggtgctcgatttagagtgagctcgttgggtttggggggaagaggaagactgacggtccgccaggctccagggaaggggctggagtgggtggccaacataaagcgagatggaagcgagaaaatactatgtggactctgtgaggggccgattcaccatctccacagacaacgccaagaaatcaaatcttttttgcaaaatgaacagtctgagagtcgaggacacggccatgtattactgtacgagagaacagacttggggccagggaaccctggtcaccgtctcctcagccctccaccaacgggccccaatccggtccttcccccgtggccgcccctgctcccnggacgcacctccgagagcacagcggccctggctgcctggtcaaggactacttccatctaacactactgagcgggctggcaaggcncgatagnnnnnnnnnnnnnn

SEQ ID NO: 57780 - DNA, 443 bp, Homo sapiens
  misc_feature: GYAE6OF01AU87W.37.33.C11.1.454.CMB.1.raw
  modified_base (431)..(431): a, c, t, g, unknown or other
  misc_feature (431)..(431): n is a, c, g, or t
  modified_base (437)..(443): a, c, t, g, unknown or other
  misc_feature (437)..(443): n is a, c, g, or t
tcagtagtgtagatcacgaccggtgctcgatttagagtgagctcgttgggtttgggggaagaggaagactgacggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcncatagnnnnnnn

SEQ ID NO: 57781 - DNA, 709 bp, Homo sapiens
  misc_feature: GYAE6OF01DL8PZ.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagctgggttttccttgttgctattttagaaggtgtccagtgtgaagtgcagctggtggactcgtgggggaggcctggtccagccgtggggggtccctgagactctcctgtgcaacctctggattcagtttgtagtgatttggttggagttggggttcgggccgccgagggcctccggaggggaaggggctgggaggtgggtcgaccaacgaagtaaaaggcggaagagtagggaaagcgaagaaaatactaagtggtggtactcgtggtagggacggggtacccgtagtttaccgaacctaacgtacctacccaacgaacgaaccgaaaccggaacccaaaaggtaaactacctaaatttacttttttagaactaaaattacgaaactaacggttacctaggtaacggtaacggtacgtaagggaacccgtaccgggaccctaagttacggttaaacgtttaaccgttaggtaaaccgaaggtaaacggaaactaacgggtaacgttaccgggggaaccgaaccggggaacccgttcgggtcccgtaacccggttaccccg

SEQ ID NO: 57782 - DNA, 422 bp, Homo sapiens
  misc_feature: GYAE6OF01BYA7Y.37.33.C11.1.454.CMB.1.raw
  modified_base (417)..(422): a, c, t, g, unknown or other
  misc_feature (417)..(422): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaaggcccatcggtcttccccctggccgccctgcctccaggacgcacctccgagacgcacagccggccctgggctgcctggtcaaggacctacttccatctacactactgagcggctggcaaggcgcatagnnnnnn

SEQ ID NO: 57783 - DNA, 567 bp, Homo sapiens
  misc_feature: GYAE6OF01B6W09.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttgcctggtatcaacagaaaccagggaaacgcccctaaggtcctgatctatgatcgcctcctacgtttacggaaacggtccggggtacccagtcgtaaacggttcaaggcggcagtgtatcgtagggacagtaactcactctacaccatcagtacgctgcagcctgattgtattttagactaactttattacgtgtacagtacaacttataagtgggagtacgttcggacggagggtaccgtagggttagagtactacgaaaacgtacgtggtcggacttcgaccaaccgtagttcttacgttaccttcctattcccgttccccg

SEQ ID NO: 57784 - DNA, 522 bp, Homo sapiens
  misc_feature: GYAE6OF01BFOTC.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaacgcccctaaggtcctgatctatgatgcctcactttggaaacgcgggtccatcaaggttcagcggcagtgtatcgtgggacagaattcactctcaccatcagtgcctgcagctagatgtatttgactaactttattactgtcagctatataagtgggagtagttccgggaccgagggtaccgagggttagacgtatacgaaaacggacgtgtaggctgacacctatctgttccttctacttccgtaccccg

SEQ ID NO: 57785 - DNA, 418 bp, Homo sapiens
  misc_feature: GYAE6OF01BY3VY.37.33.C11.1.454.CMB.1.raw
  modified_base (412)..(418): a, c, t, g, unknown or other
  misc_feature (412)..(418): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatcttttgcaaatgaacagtctgagagtcgaggacacggccatgtattactgtacgagagaacagacttggggccagggaaccctggtcaccgtctcctcagcctccaccaagggcccatcggtcttccccctggccgccctgctccaggacgcacctccgagagcacagcggccctgggctgcctggcaaggctactccatctacactactgacgcgggctggcaaggcgcatagnnnnnnn

SEQ ID NO: 57786 - DNA, 484 bp, Homo sapiens
  misc_feature: GYAE6OF01BB6MP.37.33.C11.1.454.CMB.1.raw
  modified_base (463)..(484): a, c, t, g, unknown or other
  misc_feature (463)..(484): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccagtccggtccttccccctggccgccctgcctccaggacgccacctcccgagacgccacacggccggcccctggggcctcggccctgggtaccaaagggtcctaaccgttcccattacctaccacttaaccgtggacggcgggtactgggacgaagggccgacgatacgnnnnnnnnnnnnnnnnnnnnnn

SEQ ID NO: 57787 - DNA, 549 bp, Homo sapiens
  misc_feature: GYAE6OF01B92S8.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagctgggttttccttgttgctattttagaaggtgtccagtgtgaagtgcagctggtggactcgtgggggaggcctggtccagcctggggggtccctgagactctcctgtgcagcctctggattcaactttggtagctattggatggactgggtccgccagtctccgaggggaaggggctgggagtggggtggccaacgatacgagggaggtgggtaggtaacgaaaaactgtgtggactcgtggtggcggggccattcaccatcctccagacgacaacgaccaaaactcactagtatctgacaaagtcggacggcctagagacgtccggaggacgacggctagtgtattagttgtagcgtagagtatttagactaataagtttcgagtagacttggtatag

SEQ ID NO: 57788 - DNA, 610 bp, Homo sapiens
  misc_feature: GYAE6OF01C9NUL.37.33.C11.1.454.CMB.1.raw
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacagtccaggatcgacccagtcctccttccacctgtctgcatctgtaggagacagagtcaccatcacttgccggcagtcgacttatagtaccgtggttcggcttaggtatacaaacagaaaccgaggaacgccctaaggtcctagatctatgactcgcctccgtaagtttaggaaacggtccgggtaccataccggaaggttccgaggccggacgagtgtacgtgtagggactaagacttcactcacacctagtacagtacncctagcanccgtgattgtactttgaacttactttatacgtgttacagttacaacgttaagtaagtgggtacgtacgttaccgggaccggtaaggtaccgggtagggttaagaacgtacggtaaaccaaacgggtaaacgttgggacgtcctcggaccctacgtacttcgttacgtacctttccaaccgttcccttaccccg

SEQ ID NO: 57789 - DNA, 730 bp, Homo sapiens
  misc_feature: GYAE6OF01CTD02.37.33.C11.1.454.CMB.1.raw
  modified_base (137)..(137): a, c, t, g, unknown or other
  misc_feature (137)..(137): n is a, c, g, or t
  modified_base (365)..(365): a, c, t, g, unknown or other
  misc_feature (365)..(365): n is a, c, g, or t
tcagtagtgtagatcacgaccggtgctcgatttagagtgagctcgttgggtttgggggtcagactcagtcaggacacagcatggacatgagggtccccgctcagctcctgggctcctgctgctctggctcccagganccaaatgtgacatccagatgacccagtcctccttccaccctgtctgctatctgtaggagacagatcaccatcacttcgccggccaggtcgtactagttacgtacctggttggcctaggtactcaacaagaaaccgagggaaacgccccgtaaaggtcctgactctatgactcgcctcctacgtttaggaacgtccggggtccctaagtcgaaaggttcgaggaccggngtacgtagtatcgagggaatagtaacttcaccttcaccaacctatacgtagtacgtcccgtcgaccgtacgcccttagtacgttagttaacttttcggtaaccttaaacttttatttaccgttacgttaccgtaacgtaccttaaaccgttaagtttaaaggtcgggggtaaacgttaccgggtttacccggggtaaccgggtaaccgggtaaccgggttagggggttaacgtaaacgggttaacttaaacccggtaaaaacgggttaaccgttacggggtacgggttaacgtccggaacccgtaaccgttaacgttacccgtttacgtttccgtttacctaccgtttccccgttaaccccccgg

SEQ ID NO: 57790 - DNA, 645 bp, Homo sapiens
  misc_feature: GYAE6OF01AMZXH.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctccaggagccaaatgtgacatccagatcgaccagtctccttccaccctgtctgcatctggtaggagacagagtcaccgatcacttgccgggccagtcggactacttagtacctggttggcctggttaactcaacgtagaaaccagggaaacgcccctaaaggtccgtgactctatgatcgccgtccactttggaagcgggtaccatacaaggttcagcggcgagtgtactcgtggacagtacttcactctcacctagtcagtacgcctgcagacctagatagtattttgacttaacgtttatactttagtacgaagtacttaaccgtaagttaaacgttacggggtaacgtacggttttaccgggacccggtaaggggtaacccgttaggggttaacgtaaccggtagtaccgaaaaccggtacgttacgggtacgggtaccgttacgggaccgtaacccgtaaccgttacggttacgtttaccggtttcgtaaccgttcccggtttaacccccgg

SEQ ID NO: 57791 - DNA, 542 bp, Homo sapiens
  misc_feature: GYAE6OF01BLODV.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcggcagtgtatcgtgggacagtaatcactctcaccatcagtagcctgcagcctgatgtattttgctaacttattactgtacagcaacttataagtgggagagttcgggaccgagggaccgagggttagagtagtaccgaaacggtacgtggtaggcgttcgaccctaaccgtattaccgttcgttaccttcgtattcccgttacccccg

SEQ ID NO: 57792 - DNA, 500 bp, Homo sapiens
  misc_feature: GYAE6OF01B3BMC.37.33.C11.1.454.CMB.1.raw
  modified_base (344)..(344): a, c, t, g, unknown or other
  misc_feature (344)..(344): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccaggactgacccagtctccttccaccctgtctgcatctgtaggagacagagtcaccatcacttgccgggccagtcggactattagacctggttgcctggtatcaacagaaaccagggaaacgcccctaaggtcctgatctatgatgcctcactttggaagcgggtccatcaaggttcagcggcagtgtancgtggacagattcactctcacatcagtagcctgcagcctagatgtatttgctaacttattactgtcagctactataagtgggatagttcggcgaggacgagggttgagatacgaaacgtacgtggtgctcgcacagtctagtctctgttcctcccg

SEQ ID NO: 57793 - DNA, 548 bp, Homo sapiens
  misc_feature: GYAE6OF01EZ05T.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgccctccacgtttggaaacggccgggtcccatcaaggttcagcggcagtgtatcgtgggacagtaattcactctcacctatcagtagcctgcagcctgatgtattttcgacttaactttattactgtcagactactaatagtagggatagttacgggaccgtaggggacctagggtgaagtactaacgaaacgtacgtggtaggcgtcgaccacctagttccgtagttcctttccacttccccgttaccccg

SEQ ID NO: 57794 - DNA, 650 bp, Homo sapiens
  misc_feature: GYAE6OF01C0V80.37.33.C11.1.454.CMB.1.raw
  modified_base (283)..(283): a, c, t, g, unknown or other
  misc_feature (283)..(283): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctggtaggagacagacgtcaccatcacttggcccgggcagtcggactattagtacctggttcgcctggtatcaaacaacgaaaaccgagggaaacnccctaaggtcctagatctatgactcgcctcctagtttagaacggcggtaccagtcgaaggttcagcggctagtgtatcgtaggacagtaattcactctacacatcgagtcgacctggaccagtcctagtacttagttacttttagacttaactttagttaccgcgttacacgtactaacgttaagtaaggtagggtaacgtacgggttaccgggacccgggtaagggacccgttaggggttaacgaacgtaacgtaaccggtaaaacggtacggtttgggacggtaccttaccggaacccgtaaccgttacgtttacccgttacggtttaccctttaccgtaccccgtttccccggttttacccccg

SEQ ID NO: 57795 - DNA, 545 bp, Homo sapiens
  misc_feature: GYAE6OF01D7QXU.37.33.C11.1.454.CMB.1.raw
  modified_base (100)..(100): a, c, t, g, unknown or other
  misc_feature (100)..(100): n is a, c, g, or t
  modified_base (380)..(380): a, c, t, g, unknown or other
  misc_feature (380)..(380): n is a, c, g, or t
  modified_base (473)..(473): a, c, t, g, unknown or other
  misc_feature (473)..(473): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaaatgtgacatccagattaccagtctcctccaccctgtctgcatctgtaggagacagagtcaccatcacttgccggcagtcgatattagtacctggttgcctggtatcaacagaaaccgaggaaacacccgtaagtcctgatctatgatgcctctacgtttaggaacggcgggtaccagtacgaaggttcagcggcagtgtatcgtaggactagtaattcactctacacgatacagtacnccgtagctagcctagtattgtatttcgactaactttatactgtacagtctaacttaagagtgggatacgtcgggacgagggtacctagggtanacgaatacgtaaacgagtcggtagctacgaccaccgtattcgttacgttcctactacttcccgtcccgtacg

SEQ ID NO: 57796 - DNA, 721 bp, Homo sapiens
  misc_feature: GYAE6OF01BK8S1.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttcggccggccagtcggacttattacgtacctggttcggccgtggtatacaacagaaaccgagggaaacaccccgtaaggtcctagatctatgtatcgcctcctacgtttagggaaacggtccggggtacccagtacgtaaggttcgacggcggctaggtgtacgttcgagggacaacggtaacttacacttcctaccaacctataccgaacggttacgcccgtcggacctacgtcccgttagtacttagttagtttttacgacctttaaacgtttacttacgttcgtactacgtacctaacgttaacgtaacggttaggggtaacgtaccggttttaccggggacccgggtaaacgggggtaacccggtagggggtttacgaaagggtaaccgttaaaccggaaaccggttaaaccggttgggttaccgggtacgttaccggacccgtaaaccccgttagttacccttcgtttacccttacccgttaccgttcccccgtttacccccgg

SEQ ID NO: 57797 - DNA, 550 bp, Homo sapiens
  misc_feature: GYAE6OF01CR62N.37.33.C11.1.454.CMB.1.raw
  modified_base (270)..(270): a, c, t, g, unknown or other
  misc_feature (270)..(270): n is a, c, g, or t
  modified_base (351)..(351): a, c, t, g, unknown or other
  misc_feature (351)..(351): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctgtaggagacagagtcaccatcacttgccggcagtcgactatagtacctggttgcctggtatcaacaagaaaccagggaacncccctaaggtcctagatctatgactgcctacgactttggaaacggcgggtcccagtcgaaggttcaacgcggcagtcgtancgtgggaacataatccgtactctacacctatcagtacgctgcagctgatgtatttgacttaacgttattacgtgttacagtcaacgttaagtaagtgggactacgttccgggacgtaaggaccgtagggtagagtagtacaaacgtacgtggtagactgcctaactatccgtacgttacttctacgttcccgttacccg

SEQ ID NO: 57798 - DNA, 568 bp, Homo sapiens
  misc_feature: GYAE6OF01DLDGR.37.33.C11.1.454.CMB.1.raw
  modified_base (350)..(350): a, c, t, g, unknown or other
  misc_feature (350)..(350): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaatgatttagctggtatcagacaaggaaaccgagggaaacgccccgtaaggtcctggatctatgatcgcctacctacgtttaggaaacggcgggtaccatcgaaggttcagcggnagtgtatcgtaggacagtaacttcactctcaccatcagtagcctgcagcctgtatgtattttgacttaacttattactgtactagactaacttagttaagtggggtaatacggttaccgggacccggtaaggggtaccggtaagggttacggtaagaagttaaccggaaacgtaacgttggtacgggtactacggacctaaccctgttccgttaccgg

SEQ ID NO: 57799 - DNA, 423 bp, Homo sapiens
  misc_feature: GYAE6OF01DOJK5.37.33.C11.1.454.CMB.1.raw
  modified_base (414)..(414): a, c, t, g, unknown or other
  misc_feature (414)..(414): n is a, c, g, or t
  modified_base (420)..(423): a, c, t, g, unknown or other
  misc_feature (420)..(423): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccaggggaaccctggtcaccgtctcctcagcctccaccaagggcccatccggtccttcccccgtggccgccctgcctccaggagccacctccgagagcacagcggccctgggctgccctggtcaacggctacttccatcctacactactgagcggctgcaaggcncatagnnnn

SEQ ID NO: 57800 - DNA, 582 bp, Homo sapiens
  misc_feature: GYAE6OF01B5COJ.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttcgccgggccagtcggactattagtacctggttggcctggtatcaacagaaaccagggaaacgcccctaaggtcctagatctatgatcgcctcctactttgggaaacggtccggggtcccatcaaggttcaggcggcagtgtatcgtagggacagaattcactctcaccatcagtcgcctgcacgcctagatgtaattttgactaactttattctgtcagctactagtaagtgggagtacgttccgggacggacgggacgtaggggttagaacggtacttaacgaaaccggtacgttcgggtacgggtacgtcggaccctaacccgattaccgttacggttccttttaccaccgtttccctaccccccgg

SEQ ID NO: 57801 - DNA, 422 bp, Homo sapiens
  misc_feature: GYAE6OF01D5AC6.37.33.C11.1.454.CMB.1.raw
  modified_base (415)..(422): a, c, t, g, unknown or other
  misc_feature (415)..(422): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttcccctggccgccctgctccaggacgccacctccgagagcacagccggccctgggctgcctggtcaaggctacttccatctacactactgagcgggctggcaaggcgcatagnnnnnnnn

SEQ ID NO: 57802 - DNA, 415 bp, Homo sapiens
  misc_feature: GYAE6OF01BBX3G.37.33.C11.1.454.CMB.1.raw
  modified_base (261)..(261): a, c, t, g, unknown or other
  misc_feature (261)..(261): n is a, c, g, or t
  modified_base (312)..(312): a, c, t, g, unknown or other
  misc_feature (312)..(312): n is a, c, g, or t
  modified_base (405)..(405): a, c, t, g, unknown or other
  misc_feature (405)..(405): n is a, c, g, or t
  modified_base (411)..(415): a, c, t, g, unknown or other
  misc_feature (411)..(415): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaacccnggtcaccgtctcctcagcctccaccaagggcccatcggtctccccctggcnccctgctccaggagcacctccgagagcacagcggccctgggctgcctggtcaaggctacttccatctacactactgagcgggctggacaggcncatagnnnnn

SEQ ID NO: 57803 - DNA, 562 bp, Homo sapiens
  misc_feature: GYAE6OF01AU49Q.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaagcccctaaggtcctgatctatgatgcctccacttttggaaacgtcggggtcccatcaaggttcaggcgcagtgtatcgtgggacagaattcactctcacatcagtacgcctgccagcctgactgtattttgactaacttattactgtcagtctaactataacgtgggagtagttcggaccgagggaccgtagggttcgagtaatacgaaaacgtacgtaggtggaccttcggaccgtaacctacgttaccttacggtttaccctttacgtactttccccgttaacccccgg

SEQ ID NO: 57804 - DNA, 518 bp, Homo sapiens
  misc_feature: GYAE6OF01AQCGN.37.33.C11.1.454.CMB.1.raw
  modified_base (195)..(195): a, c, t, g, unknown or other
  misc_feature (195)..(195): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtagganacagagtcaccatcacttgccgggccagtcggactattagtacctggttggcctggtatcaacagaaaccagggaaacgcccctaaggtcctgatctatgatgcctcactttggaaacgcgggtcccatcgaaggttcagcggcagtgtatcgtgggacagaattcactctcaccatcagtacgcctgcagcctgatgattttgactaacttatactgtcagcactataagtagggatagttcggaccgtagggacctagggttagagataccgaaacgtacgtggtggctcgacaccatcctgtcttctcgtcccttccccg

SEQ ID NO: 57805 - DNA, 523 bp, Homo sapiens
  misc_feature: GYAE6OF01BFVMH.37.33.C11.1.454.CMB.1.raw
  modified_base (512)..(523): a, c, t, g, unknown or other
  misc_feature (512)..(523): n is a, c, g, or t
tcagtagtgtagatcacgaccggtgctcgatttagagtgagctcgttgggtttgggggttccctgagactctcctgtgcaacctctggattcagttgtagtgattgttggatgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaacgggcccagtccggtccttcccccgtggccgccctgcctccgacggacgccacctccgagacgcacacgccggcccctgggcctcggcctgggtaccaacggtcctacttccatcctaacactactgacgccgggctcggcaaggcacagtagnnnnnnnnnnnn

SEQ ID NO: 57806 - DNA, 429 bp, Homo sapiens
  misc_feature: GYAE6OF01COR5F.37.33.C11.1.454.CMB.1.raw
  modified_base (423)..(429): a, c, t, g, unknown or other
  misc_feature (423)..(429): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtccttccccctggccgccctgcctcccaggacgccaaccctccgagacgcacagccggccctgggctgcctggtcaaggactactccatctacactatcgagcgggctggacaaggcacatagnnnnnnn

SEQ ID NO: 57807 - DNA, 612 bp, Homo sapiens
  misc_feature: GYAE6OF01BNF8Q.37.33.C11.1.454.CMB.1.raw
tcagtagtgtagatcacgaccggtgctcgatttagagtgagctcgttgggtttgggggtcagactcagtcaggacacagcatggacatggagggtccccgctcagctccgtggggctcctgctgctctggctcccaggagccaaatgtgacatccagatcgacccagtcctccttccaccctgtctgcatctggtaggagacagagtcaccatcacgttcggccgggccaggtcggacttagtttagtaccgttggttggccgtggtactcaacaagaaaccgaggggaaacgccccgtaaggtcctagatctatgatcgcctacctacgtttaggaaacggtccgggtaccagtacgtaaggttcaggcggactagtacgtatcgtagggacagtacttcactctacacatcagtacgcctgctacgctgtagtagttatttacgacttaacttattacgtgtacagtactaactagtagtagggagtacggttccgggacggtacgggtaccgtagggttacaagtacgtaaccgaaacggtacgtcggtaggacctcggaccctacgttacgttccgttacgttaccttctccgtttcccgttaccccg

SEQ ID NO: 57808 - DNA, 638 bp, Homo sapiens
  misc_feature: GYAE6OF01BS9CX.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagcttgggttttccttgttgcttattttagaaggtgtccagtgtgaagtgcagctggtggactcgtgggggagccgtggtccaggccgtggggggtccctgagactctcctgtcgcctaacctcgtggattcgagttgtagtgtagtttggttggagttggggttcgggtccgccgagggcctaccggaggggaacggggcgtgggaggtgggtacggaccaacgaagtaaaggcgaagagtagggaagacgaagtaaatactagtggtagactcgtggtaggacggggcgtacttccacctactcctaccacaacgacaaaccgaccaaagtaactactaactttacgttttagaactaaatacgaactagttactaggagtaggtacggaagaccgaccgacagttacgtacttacgtagtaacggagaacgaacgaggtacggtcggggacccgaacgggtaacccgtcggtcccgtccgttacccg

SEQ ID NO: 57809 - DNA, 642 bp, Homo sapiens
  misc_feature: GYAE6OF01ETOU7.37.33.C11.1.454.CMB.1.raw
  modified_base (624)..(624): a, c, t, g, unknown or other
  misc_feature (624)..(624): n is a, c, g, or t
  modified_base (630)..(630): a, c, t, g, unknown or other
  misc_feature (630)..(630): n is a, c, g, or t
  modified_base (635)..(635): a, c, t, g, unknown or other
  misc_feature (635)..(635): n is a, c, g, or t
  modified_base (637)..(638): a, c, t, g, unknown or other
  misc_feature (637)..(638): n is a, c, g, or t
  modified_base (640)..(642): a, c, t, g, unknown or other
  misc_feature (640)..(642): n is a, c, g, or t
tcagtagtgtagatcacgaccggtgctcgatttagagtgagctcgtttgggtttggggggtccctggagactctcctgtgcaacctctggattcagttgtagtgattgttggatgggttgggtccgccgaggctccagggaaggggctggagtgggtggccaacataaagcgagatggaagcgagaaatactatgtggactctgtgagggccgattcaccatctccacagacaacgccaagaatcaatctttttgcaaatgaacagtctgagagtgagacacggcatgtattactgtacgagagaacagacgttgggaccagggaaccctggtccaccgtctcctcacgcctacccaccgaacgggccctagtccggttccttcccccgtggcccgtccccgtgtcctacccgaggtaccgtccaacccgtccggaacgacgaccaccgacggcccgggaccccgtggggaccttcggcccgttacgggtaccgaaacgggtacccttacctttacccgtaacttacccgtaaaccaccgttaaccgtacgggtaaccggtccggggtcttaccgggaacccgtaaggggtcccggaaccgtaaggtaacggcgtagagacgcngtaacncgtcncnncnnn

SEQ ID NO: 57810 - DNA, 537 bp, Homo sapiens
  misc_feature: GYAE6OF01BYSE5.37.33.C11.1.454.CMB.1.raw
  modified_base (504)..(537): a, c, t, g, unknown or other
  misc_feature (504)..(537): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtggaggggccgattcaccatctccacagacaacgccaagaaatcaatctttttgcaaatgaacagtctgagagtcgaggacacggccatgtattactgtaacgagagaacagtacgttggggccaaggggaaccctggtccaaccgtctacctcacgccctaccaccgaaagggcccctatcggtccctttcccccctgggcccgtccctcgcctcccgaacgggacgaccaccctaccggaaggacgccaacgacgccggtccccgtgggctggccctggtaaccaaacggtactaccttccaacgttcctaaacacttaacgtggaacggtcccggggcttaggggaccgaaagggcgaccgtaataaggnnnnnnnnnnnnnnnnnnnnnnnnnnnnnnnnnn

SEQ ID NO: 57811 - DNA, 698 bp, Homo sapiens
  misc_feature: GYAE6OF01B0PQX.37.33.C11.1.454.CMB.1.raw
  modified_base (220)..(220): a, c, t, g, unknown or other
  misc_feature (220)..(220): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcatcatcacttgccgggnaagtcgactatagtactggttgcctggtatacaacaagaaaccagggaaacgccccgtaaggtcctagatctatgatcgtccctaccgtacgtttagggaaacggtccggggtacccagtacgtaaacggttcgaacggcggacgtaggtgtaacgtcgtaggggaacaggtaacttcaaccttctacaacctatctagtacgccgtgacgacgtccgtagtacgttagttattttacgacctttaaactttagtttaacgttcgtactaacggtacctaacgtttaaagttaaaggttacgggggtaacgtaaccggtttcccggggaaccgggtaaacggggtacccgggttaaggggtttaagaacggttaaaccgtaacgaaaaaccggtaacggttagggttacgggccgttacgggacccttaaaccgtacgtttaccgtacggtttccctttaacgtcccgtttacccccg

SEQ ID NO: 57812 - DNA, 564 bp, Homo sapiens
  misc_feature: GYAE6OF01B7O1M.37.33.C11.1.454.CMB.1.raw
  modified_base (196)..(196): a, c, t, g, unknown or other
  misc_feature (196)..(196): n is a, c, g, or t
  modified_base (274)..(274): a, c, t, g, unknown or other
  misc_feature (274)..(274): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccaagatgacccagtctccttccaccctgtctgcatctgtagganacagagtcaccatcacttgccgggccagtcggactattagtacctggtggcctggtatcaacagaaaccagggaaacncccctaaggtcctagatctatgatcgcctcctacgtttaggaaacgccggggtacccagtacgtaaggttcaggcggcagtgtagtcgtgggacagtaacttcactctcaccatcagtacgcctgcagtcctgattgtattttacgactaactttattacgtgtacagtctaactagtaacgtgggagtacgttccgggacgagggaccgtagggtgaagactacgaaacggtacgttggtcggctcgacctacctagttcctggttaccttctcgttcccgttaccccg

SEQ ID NO: 57813 - DNA, 794 bp, Homo sapiens
  misc_feature: GYAE6OF01BMDK4.37.33.C11.1.454.CMB.1.raw
  modified_base (102)..(102): a, c, t, g, unknown or other
  misc_feature (102)..(102): n is a, c, g, or t
tcagtagtgtagatcacgaccggtgctcgatttagagtgagctcgttggggtttgggggtcagactcagtcaggacacagcatggacatgacgggtccccgntcagctcctgggctcctgctgctctggctcccaggagccaaatgtgacatccagatgacccagtcctccttccaccctgtctgcagtctgtaggagacagcgtacaccgatcgacttggccgggccaggtccggacttaagttacgttaccgttggttcggacctggtaactaccgaaaccgaacggaaaacccgaaggggaaaaccgtcccccgtaaagggttccccttaggtacttctaacgtggtactcggtccccttaccgtacgtttcgggaaaccggtccggggttacccagtaccgtaaggttccgaacggtcggacgtaggttacgtaacgtcggttagggaactaaggttaacttccgaaccgtcctaaccgaccgtagtacccgacgtaaccgtccgttcggacgtacgtcccgttagaagttcgttaactttttcggaaccttaacttttaaccgttagttcgttaccgaagttaccgtaaaccgttacgttaaaggttacggggttaacttcggggttacccgggaaccgggtaaccgggtaaccggttaaggggtttaagaaaccggtaagttaaacccgtaaagggtaaccgttcggggtacgtccggtacgaacccgttaacccgtaagttccggttttaccgtaacgtttccgttccccgtttcccgttacccccg

SEQ ID NO: 57814 - DNA, 598 bp, Homo sapiens
  misc_feature: GYAE6OF01EJ5DY.37.33.C11.1.454.CMB.1.raw
  modified_base (274)..(274): a, c, t, g, unknown or other
  misc_feature (274)..(274): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctgtaggagacagagtcaccaccacttgctgggccagtcggactattagtacctggttgcctggtatcaacagaaaccagggaaacncccctaaggtcctagatctagtgatcgcctcctagtttggaaacgcgggtaccatcaaggttcaggcggacagtgtatcgtgggacagtaatcactctacacatcagtacgcctgcagctgatgtatttgacttaactttattactgtacagtactaacgttaagtaagtgggtaacgtaggtttacccgggaccggtaagggtaccgtaggggttacgaaacggtacttaaccggaaaaacggtacggttacgggtacggtaccttacggacctaacccgtatttccgttacgttcctttaacctacgttccccgttaccccg

SEQ ID NO: 57815 - DNA, 588 bp, Homo sapiens
  misc_feature: GYAE6OF01EZXUE.37.33.C11.1.454.CMB.1.raw
  modified_base (529)..(529): a, c, t, g, unknown or other
  misc_feature (529)..(529): n is a, c, g, or t
tcagtagtgtagatcacgaccggtgctcgatttagagtgagctcgttgggtttggggggtcagactcagtcaggacacagcatggacatggacgggtccccgctcagctccgtggggctcctgctgctctggctcccaggagccaaatgtgacatccagatgacccagtcctccttccaccctgtctgcatctggtaggagacagagtcaccatcacttcggccgggccaggtcggacttattacgtaccgttggttggcctggtatacaacaagaaaccagggaaacgcccctaaggtcctgatctatgatcgcctcctacgtttggaaacggtccgggtacccatacgtaaggttcaggcggctaggtgtacgtcgtagggacagtaacttcacctctaccactactcgaggtacgccctagcctacgccttagtacttgttacgttttcgacttaactttattactgtacagtactaacttaagtagtagggagtcgttccgggaccggtagggtaccgtagggtnaagtactacgaaacgtagtggtggctcgcctactcttcgtattcctctctccgtacccg

SEQ ID NO: 57816 - DNA, 590 bp, Homo sapiens
  misc_feature: GYAE6OF01BERM6.37.33.C11.1.454.CMB.1.raw
  modified_base (574)..(574): a, c, t, g, unknown or other
  misc_feature (574)..(574): n is a, c, g, or t
  modified_base (576)..(579): a, c, t, g, unknown or other
  misc_feature (576)..(579): n is a, c, g, or t
  modified_base (581)..(583): a, c, t, g, unknown or other
  misc_feature (581)..(583): n is a, c, g, or t
  modified_base (585)..(590): a, c, t, g, unknown or other
  misc_feature (585)..(590): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaaagcgagatggaagcgagaaatactatgtggactctgtgagggccgattcaccatctccacagacaacgccaaagaaatcaatctttttgacaaatgaacagtctagagagtcgaggacacggccatgtattactgtacgagagaacagacttggggccagggaaccctggtcaccgtctcctcacgccctccaccgaacgggccccagtccggtcccttcccccgtggcccgccctcgcctcccgaggacgccaacccgtcccgagacgaccaccgacggcccgggcccgtagggcctcggcccgttgggtaccgaaacgggaccttacgttcccaacgttcctaacctaccttacgtcgaacggccgggtctacgggccgaaacgggccgtacgaaagttacggacncnnnncnnncnnnnnn

SEQ ID NO: 57817 - DNA, 601 bp, Homo sapiens
  misc_feature: GYAE6OF01AH8RB.37.33.C11.1.454.CMB.1.raw
  modified_base (251)..(251): a, c, t, g, unknown or other
  misc_feature (251)..(251): n is a, c, g, or t
  modified_base (447)..(447): a, c, t, g, unknown or other
  misc_feature (447)..(447): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactatagtacctggttgcctggtancaacagaaccaggaacgccctaaggtcctgatctatgatgcctcctacgtttagggaaacggtccggggtaccccagtacgtaagggttcaacggtcggactaggtgtatccgtgggacaaggtaactttcaccttctaccgacctactactagtacgcctgccagctgatgtattttgacttaatttattacgtntacagtacctacttaagttaagtgggtaacggtagttaccgggaccggtagggtaccgtaggggttacgaagtaacgttacgaaaaccgtacggtggtacggacgtcgaccctacgtacttccgttcgttaccttcgtacttcccgttaccccg

SEQ ID NO: 57818 - DNA, 569 bp, Homo sapiens
  misc_feature: GYAE6OF01AEECH.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactatagtacctggttgcctggtatcaacagaaaccagggaaacgcccctaaggtcctagatctatgatcgcctctacgtttggaaacggccggggtacccagtacaaggttcaggcggcagtgtatcgtagggacagtaatcactctacacatcagtacgctgcacgcctgatgtattttcgacttaacttagttactgtacagactaacttaagtaagtgggaagtagttaccgggaccggtaagggaccgtaggggttagaaggactaaccgaaaacgtacgtggtaggactcggacctacctattccgttacgttccttactacgttcccgttaccccg

SEQ ID NO: 57819 - DNA, 712 bp, Homo sapiens
  misc_feature: GYAE6OF01ELD7Z.37.33.C11.1.454.CMB.1.raw
  modified_base (604)..(604): a, c, t, g, unknown or other
  misc_feature (604)..(604): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtcctccttccaccctgtctgcatctgtaggagacagagtcaccatcacttgccggccagtcggactattacgtacctggttgcctggtatcaacaagaaaccagggaaacgcccctaaggtcctgatctatgatcgcctccgtagtttagggaaacggtcgggtacccagtcgtaaacggttcaacggtcggactaggttacgttagtccgtaggggacaacggtaacttccaactccttacaaccctataccaggttaactcccgttacggacaaccgggtcctttaggtaagtttacgtttaagtttttacgtaacccttaaacctttttaactttacgttacgttacccgaagtacctaaccgttaagttaaacggtgggtaaacggtccggtttaccggggaccgggtaacggggtaccgttaaggggggttaanaacggttaacgtaaaccggtaaacggttacggttacgggtaggacccgtacgaacccttaaccttacgttccgttacgtttaccttaccgttcccgttcccgttaccc

SEQ ID NO: 57820 - DNA, 548 bp, Homo sapiens
  misc_feature: GYAE6OF01BTI2A.37.33.C11.1.454.CMB.1.raw
  modified_base (418)..(418): a, c, t, g, unknown or other
  misc_feature (418)..(418): n is a, c, g, or t
  modified_base (535)..(548): a, c, t, g, unknown or other
  misc_feature (535)..(548): n is a, c, g, or t
tcagtagtgtagatcacgaccggtgctcgatttagagtgagctcgttgggtttgggggggtccctgagactctcctgtgcaacctctggattcagttgtagtgattgttggatggggttgggtccgccaggctccagggaaggggctggagtgggtggccaacataaaagcgagatggaagcgagaaatactatgtggactctgtgaggggccgattcaccatctccacagacaacgccaaagaaatcaattctttttgacaaatgaacagtctgagagtcgaggacacggcatgtattactgtacgagagaacagacgttggggccagggaaccctggtccaccgtctcctcacgcctccaccgaacgggcccagtccggtccttcccccgtggcccgtccctgcctccgagggacnccaccgtccgagacgcacgacgccggcccgtcgggctcgccgtcggtacgaacggtacctacttccatcctaacaccttactggacggccgggctgggaccaaggccgacagtacgnnnnnnnnnnnnnn

SEQ ID NO: 57821 - DNA, 614 bp, Homo sapiens
  misc_feature: GYAE6OF01DLP56.37.33.C11.1.454.CMB.1.raw
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagacgtccaccatcacttggccgggccagtcggaactattagtaccgtggttcggcctggtactacaaacaacgaaaaccgagggaaaccgccccgtaaggtccctagacttctatgacgtcgccctaccgtacgtttagggaaacggtccggggtccctaagtccgtaaaggttcaacggtcggactaaggttcgtaacgtccgtagggaactagtaacttccacttcctacacctatcaggtacncctgactacgccgttagntgtatttcgacttatttattctgttcagtctatagtaagtggtagtcgttcggcggtacggaccgtagggttacgaagtactaacgggaacgtaacggtgtacggtctacgacctactacgttacttcgttcttacctcgttcccgtacccg

SEQ ID NO: 57822 - DNA, 590 bp, Homo sapiens
  misc_feature: GYAE6OF01AV34D.37.33.C11.1.454.CMB.1.raw
  modified_base (374)..(374): a, c, t, g, unknown or other
  misc_feature (374)..(374): n is a, c, g, or t
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaaagcgagatggaagcgagaaatactatgtggactctgtgaggggccgattcaccatctccacagacaacgccaagaaatcaatctttttgcaaatgaacagtctgagagtcgaggacacggccatgtattactgtgcgagagatcagacggagtatagcagcagctctgactacgtcggggccaccggaaccctggtccaccgtctccncacgcctccaccacggcccagtccggtccttcccccnggccacccctcctaccaagcnccaccgtcgtcggggccacgacggccggcccgtcgggcctcggcccgtcggtacgaacggtaccttaccttcccaattaccctaccgtaaccttacgtacggacgggtccggggccgttacgggccgaaacggggtcccgacgaagttaacgngntcg

SEQ ID NO: 57823 - DNA, 799 bp, Homo sapiens
  misc_feature: GYAE6OF01C52C8.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccaggaacgcccctaaggtcctgatctatgatcgcctcctacgttttacggaaacggtccggggtaccctagtacgtaaagggttccgaaggccggacgtaaggttacggttaacgtacggttaggggaacctaaggtaaactttaccgaaccttcctacctaaccctaagttaccgaaggttaccgtcccgttacggaccctaacggtccccgttaggtaacgtttacggtttaacgtttttacgaaccctttaaaacgttttaacgtttaacccgtttacggttaccgtaacggtacccttaaaaccgttaagtttaaaggttacgggggtaacggttaaccggggttttacccgggaaccggggtaacgggggttaacccggttaagggggtttaacggaaacggttaaccgtaaaccggtaaaaaaccggtaaccggttagggttaccgggaacccgttcggaacccgtaacccgttaacgtttcccgttacgttacccgtttacccttaccgttcccccgtttaccccccgg

SEQ ID NO: 57824 - DNA, 448 bp, Homo sapiens
  misc_feature: GYAE6OF01DZS1F.37.33.C11.1.454.CMB.1.raw
  modified_base (318)..(318): a, c, t, g, unknown or other
  misc_feature (318)..(318): n is a, c, g, or t
  modified_base (425)..(425): a, c, t, g, unknown or other
  misc_feature (425)..(425): n is a, c, g, or t
  modified_base (434)..(448): a, c, t, g, unknown or other
  misc_feature (434)..(448): n is a, c, g, or t
tcagtagtgtagatcacgaccggtgctcgatttagagtgagctcgttgggtccgccaggctccagggaaggggctggagtgggtggccaacataaaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacgttggggccagggaaccctggtccaccgtctcctcacgcctccaccaacgggcccagtccggtccttcccccgnggcccgccctgcctccgaggacgccacctccgagcgcacgacggccggcccgtgggctgcctggtacaaggctactcatctaacactactgagcggctaggcaggcncaagtagcnnnnnnnnnnnnnnn

SEQ ID NO: 57825 - DNA, 432 bp, Homo sapiens
  misc_feature: GYAE6OF01BJVU5.37.33.C11.1.454.CMB.1.raw
  modified_base (418)..(432): a, c, t, g, unknown or other
  misc_feature (418)..(432): n is a, c, g, or t
tcagtagtgtagatcacgaccggtgctcgatttagagtgagctcgttgggtttgggtccgccaggctccagggaaggggctggagtgggtggccaacataaagcgagatggaagcgagaaatactatgtggactctgtgaggggccgattcaccatctccacagacaacgccaagaaatcaatcttttgcaaatgaacagtctgagagtcgaggacacggccatgtattactgtacgagagaacagacttggggccagggaaccctggtcaccgtctcctcagcctcaccaaggcccatcggtctcccctggcgccctgctccaggacgcacctccgagagcacagcggccctgggctgcctggtcaaggactactccatcctacactactcgagcgggctcggcaaggcgcagtagnnnnnnnnnnnnnnn

SEQ ID NO: 57826 - DNA, 602 bp, Homo sapiens
  misc_feature: GYAE6OF01C8KZZ.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgaccagtctccttcaccctgtctgcatctgtaggagacagagtcaccatcacttgccgggccagtcggactattagtacctggttcggcctggtatacaacaagaaaccgagggaaacgcccctaaggtcctgatctatgatcgcctactacgtttaggaaacgtcggggtacccagtcgaaggttcaggcgcagtgtatcgtggacagaattcactctcacatcagtacgcctgcagcctagattagttactttcgactaactttacttactgtacgagtactaacttagtaacgtagggtaagtacgttccgggaccggtaaggggtaccgtaggggttacgaacgtaacgtaaaccgtaaacggtaaccgtggtacggtacgttacggacctaacccgtacgttccgttaacggttccttaactccgttcccgttaccccgg

SEQ ID NO: 57827 - DNA, 488 bp, Homo sapiens
  misc_feature: GYAE6OF01C7M8N.37.33.C11.1.454.CMB.1.raw
  modified_base (202)..(202): a, c, t, g, unknown or other
  misc_feature (202)..(202): n is a, c, g, or t
  modified_base (325)..(325): a, c, t, g, unknown or other
  misc_feature (325)..(325): n is a, c, g, or t
  modified_base (466)..(488): a, c, t, g, unknown or other
  misc_feature (466)..(488): n is a, c, g, or t
tcagtagtgtagatcacgaccggtgctcgatttagagtgagctcgttgtgtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagngtcgaggacacggctatttattactgcgtcgagagaaggactgggcggtttcgactacgtggggccagggaaccctggcaccgtctcctcagcctccaccaagggcccatcggtcttcccccnggccgccctgctccaggacgcaccctcgagacgcaacgacgccggccctggggcctggcccgtggtcaaagggtacctaccttcccgaattcctactactacgtcggacggtacggcgtacggacgaaggcgagactagcnnnnnnnnnnnnnnnnnnnnnnn

SEQ ID NO: 57828 - DNA, 547 bp, Homo sapiens
  misc_feature: GYAE6OF01A9ZWU.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccaggggaaacgcccctaaggtcctgatctatgatgcctccactttggaaagcggggtccatcaaggttcagcggcagtgtatcgtgggacagaattcactctcaccatcagtacgcctgcagcctgatgtattttgactaactttattactgtcagcaactataagtgggagtacgttcgggaccgtagggacccgtaggggttagaaggataccgaaacggtaacgtggtaggcctcggaccaaccgtacttcgtgttcctttctacgttccgttacccccg

SEQ ID NO: 57829 - DNA, 606 bp, Homo sapiens
  misc_feature: GYAE6OF01AVAU8.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttggcccggcagtcggactattacgtaccgtggtgcctggtactcaacagaaaccgagggaaacgccccgtaaggtcctagtactctatgactcgcctccgtacgtttagggaaacggtccgggtaccagtacgtaaggttcaggcggacagtgtacgtcggtagggactaaggtacttcacctctacaccactacagtacgccgtgacacgtcctagagttacgttacgttttacgaaccttaacgtttacttaccgtagtacctagtactacttaagtaacgtagggtaagtacggtacggacggacggtacggtaggtagacgtagtaaccgaaaggtcgtaggtggctcgtactactacgtcgttacgttacttctacttcccgtaccccg

SEQ ID NO: 57830 - DNA, 656 bp, Homo sapiens
  misc_feature: GYAE6OF01B3RK7.37.33.C11.1.454.CMB.1.raw
tcagtagtgtagatcacgaccggtgctcgatttagagtgagctcggttgggtttgggggtcagactcagtcaggacacagcatggacatgagggtccccgctcagctcctggggctcctgctgctctggctcccaggagccaaatgtgacatccagatgacccagtctccttccacctgtcctgcatctgtaggagacagagtcacatcacttcgccggcagtcgactagttagtacctggttgctggtatcgaactagaaaccaggaacgacccgtaaggtcctagactcgtagtgatcgcctctacgtttaggaacgtccggggtaccctaagttacgaaacgggtttcgacggaccggtacgtaacggttggtaacgtcggtaggggaacaaggtaacttccacgtcctacacctactacgacgtacgccctagacctacggtcctagacgttgttactttacgacttaactttaatacgttcgtactaacgtctaattaagtaagtacgggtagtacgttacggaccggtaacgggtacgtaggggttacgaacggtaacgtaaccggaaacggttacgtagggttggaaccgttcggacccgtaacgttacgttccgttacgttaccttcctacgttccccgttaccccgg

SEQ ID NO: 57831 - DNA, 659 bp, Homo sapiens
  misc_feature: GYAE6OF01DI8JV.37.33.C11.1.454.CMB.1.raw
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (570)..(570): a, c, t, g, unknown or other
  misc_feature (570)..(570): n is a, c, g, or t
tcagtagtgtagatcacgaccggtgctcgatttagagtgagctcgttgggtttgggggtcagactcagtcaggacacagcatggacatgagggtcccccgctcagctcctggggctcctgctgctctggctcccaggagccaaagtgtcggacagtccgaaggactcgacctagtctccttccaccctgtctgcactctagaggagacaggactcacctatctacgtcggccggcagtcgactatacgtactggtcgctggtanacaagacgaaccgaggaaccnccgtaaggtcagtactctatacgatccgtcctaccgtagtttacggaacggtcgggtaccagttacgaacggttccaggtcgctaggtgttaacgtcgagggaacacggtactactacctacgtaccaaccgttatacggtacggtactcctaggaccgtactccggtatacgttacgttagtttaccaacttaaacgtttcgttacgtgtacctaggtaactaacgtttaagagggtaagggtacgtcgggttaccggaacgggaacggttacgtaggggttanaacgttacgtaaaccgaagttaacggttgacccggattaccacgttaccgtacgttcgtaacgtttcttacccgtgtccccggttaacc

SEQ ID NO: 57832 - DNA, 554 bp, Homo sapiens
  misc_feature: GYAE6OF01DUM7G.37.33.C11.1.454.CMB.1.raw
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
  modified_base (495)..(495): a, c, t, g, unknown or other
  misc_feature (495)..(495): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctgtagagacagagtcaccatcacttgccggcagtcgactattagtacctggttgcctggtatcaacagaaaccagggaacgcccgtaaggtcctgtatctagtgatcgcctccaacgtttaggaaaggtccggggtcccaagtcgaaaggttcgaggcggctagtgtatcgaggacganattcactcacaccatcagtacnctgcacgctgtatgtattttgactaactttattacgtgttacagtactaacttaagtaaagtagggtaacgtagttccggacggacgggacgtagggttagagaanacgaaacgacgtggtgactcacacgtacttcgtcgttacttctacgttcccgttacccg

SEQ ID NO: 57833 - DNA, 596 bp, Homo sapiens
  misc_feature: GYAE6OF01D0MY2.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggacttattagtaccgtggttggcctggtatacaacaagaaaccgaagggaaacgcccctaaggtccctagatctatgatcgcctctacgtttggaacggtccgggtaccagtcgaagggtcggcggcagtgtatcgtggacagaacttcactctcacctatcagtacgcctgcagcctgtatgtatttgactaactttattacttgtaccagtactaacttaagtaaggtggggaacgtacggttaccggggaccggtaacggggtaccgtaaggggttacgaagtaactaaccgaaaacgtacgtggtacggtactcggacctaccgtattccgttcgttcctttaccgtccttcccgttcccggtacc

SEQ ID NO: 57834 - DNA, 556 bp, Homo sapiens
  misc_feature: GYAE6OF01BQUZG.37.33.C11.1.454.CMB.1.raw
  modified_base (280)..(280): a, c, t, g, unknown or other
  misc_feature (280)..(280): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (531)..(531): a, c, t, g, unknown or other
  misc_feature (531)..(531): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgcccgggccagtcggacttattagtacctggttggcctggtatcaaacgagaaaaccaggggaaacncccccgtaaggtccctagatctatgatcgcctccacgtttagggaaacggccggggttacccatcgtaaacggttcagcggctagtntatcgtgggacagtaattcactctcacatcagtancctgcagcctgatgtatttgactaatttattactgtcagactaactagtaagtgggtatacgtttcggaccggtacggaccggtagggttgaagatacgaaaacgtcgtgtacggctcggacctaaccngttctgtctttcgcttccgtccccg

SEQ ID NO: 57835 - DNA, 595 bp, Homo sapiens
  misc_feature: GYAE6OF01BNY7H.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaaatgtgacatccagatcgacccagtctccttccaccctgtctgcattctgtaggagacagactcaccatcacttggccggccagtcggtactattagtacctggttcgcctggtatcaacagaaaccgacgggaaacgcccctaaggtcctagtatacctatgatcgtcctcctacgtttaggaaacgtcgggtacccagtcgaaggttcaggcggacagtgtaatcgtagggacagtactcactcacacatactatacgctagcacgtctagattagtattttcgacttaactttattactgtcagtacaacgttagaacgtaggagtacgttacggaccgtaacgggtaccgtagggttcgaagtacgtaaccgtaaaacgacggttacggtcgacttcggacctaaccgtacttccgttacttaccgttcctaacgttcccgttaccccgg

SEQ ID NO: 57836 - DNA, 589 bp, Homo sapiens
  misc_feature: GYAE6OF01CTWD0.37.33.C11.1.454.CMB.1.raw
tcagtagtgtagatcacgaccggtgctcgatttagagtgagctcgttgggtttggggggtcagactcagtcaggacacagcatggacatgagggtccccgctcagctcctggggctcctgctgctctggctcccgaggagccaaatgtgacatccagatcgacccagtcctccttccaccctgtcctgcatctgtagagacagatcaccatcacttgccgggccagtcggactattagtacctggttgcctggtatcaacagaaaccagggaaacgcccctaaaggtccctagatctatgatgccctctacgtttaggaacgcgggtcccatcgaaggttcagcgcagtgtatcgtaggacagacttcactctcacatcagtacgcctgccagcctgattgtaatttcgactaaactttattactcgtcaagctaacttaagtaagtgggaacgtcgttccgggaccggtaagggtaccgtagggttacgaacggtactaccgaaacggtaacgttgggtacggtaccgtacggaccctaccgtaacgtttccgtacgttacccttactacccgttcccgttacccccg

SEQ ID NO: 57837 - DNA, 615 bp, Homo sapiens
  misc_feature: GYAE6OF01AFEB8.37.33.C11.1.454.CMB.1.raw
  modified_base (100)..(100): a, c, t, g, unknown or other
  misc_feature (100)..(100): n is a, c, g, or t
  modified_base (164)..(164): a, c, t, g, unknown or other
  misc_feature (164)..(164): n is a, c, g, or t
  modified_base (373)..(373): a, c, t, g, unknown or other
  misc_feature (373)..(373): n is a, c, g, or t
  modified_base (463)..(463): a, c, t, g, unknown or other
  misc_feature (463)..(463): n is a, c, g, or t
  modified_base (559)..(559): a, c, t, g, unknown or other
  misc_feature (559)..(559): n is a, c, g, or t
  modified_base (598)..(598): a, c, t, g, unknown or other
  misc_feature (598)..(598): n is a, c, g, or t
tcagtagtgtagatcacgaccggtgctcgatttagagtgagctcgttgggtttggggtcagactcagtcaggacacagcatggacatgagggtcccccgntcagctccgtgggctcctgctgctctggctcccgaggagccaaatgtgacatccagatgacccngtcctccttccacctgtctgacatcgtgtaggagacaggactcaccagtccacgttcgccgggccaggttcgacttagtacgtacctggttgccgtggtatcaacagaaaccagggaaacgccccgtaaggtacctgactcgtaatgatcgcctctacgtttggaaacgcgggtacccagtcgtaacgttcaggtccgctagtgttacncgtaggaccagtaactcgacttcctacgacctacgttcgaaacgttcgtaaccctcggaacctaggtcccctagtagttcgtacgttttnaccgtatttactcgttatacaacgtataacgttactaacttaccgttcgtacgttaccgcgaaacggtccaaggtagtaacggactaaaaccggtntaagtcggtactgccggtacctaattcgtcgtcttaacncttaacctcccggtacc

SEQ ID NO: 57838 - DNA, 509 bp, Homo sapiens
  misc_feature: GYAE6OF01AKWTF.37.33.C11.1.454.CMB.1.raw
  modified_base (241)..(241): a, c, t, g, unknown or other
  misc_feature (241)..(241): n is a, c, g, or t
  modified_base (343)..(343): a, c, t, g, unknown or other
  misc_feature (343)..(343): n is a, c, g, or t
  modified_base (472)..(472): a, c, t, g, unknown or other
  misc_feature (472)..(472): n is a, c, g, or t
  modified_base (476)..(509): a, c, t, g, unknown or other
  misc_feature (476)..(509): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgaganaacagacgttggggccagggaaccctggtcaccgtctcctcacgcctccaccaagggccccatccggtccttcccccgtggccgcccctgcctccgaggacnccaacctcccggagacgctaacgacggccggccccgtagggcctcggcccttggtacaacgccttactccatcgtaacactactaggaggccgggtacgtcggaccgaacgggtccgaccgtagtacgnacgnnnnnnnnnnnnnnnnnnnnnnnnnnnnnnnnnn

SEQ ID NO: 57839 - DNA, 500 bp, Homo sapiens
  misc_feature: GYAE6OF01EJWS2.37.33.C11.1.454.CMB.1.raw
  modified_base (391)..(391): a, c, t, g, unknown or other
  misc_feature (391)..(391): n is a, c, g, or t
  modified_base (431)..(431): a, c, t, g, unknown or other
  misc_feature (431)..(431): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
  modified_base (490)..(490): a, c, t, g, unknown or other
  misc_feature (490)..(490): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcggcagtgtatcgtgggacagaattcactctcaccatcagtagcctgcagcctgatgnttttgactaactttattactgtcagcactataataggagnttacggcgaggacctagggttnagatacgaaacgactgnggctgacacatctgtcttcntccttacccg

SEQ ID NO: 57840 - DNA, 665 bp, Homo sapiens
  misc_feature: GYAE6OF01BWN58.37.33.C11.1.454.CMB.1.raw
  modified_base (653)..(665): a, c, t, g, unknown or other
  misc_feature (653)..(665): n is a, c, g, or t
tcagtagtgtagatcacgaccggtgctcgatttagagtgagctcgttgggtttgggggggtccctgagactctcctgtgcaacctctggattcagttgtagtgattgttggatggggttgggtccgccaggctccgaggggaagggggctgggaggtgggtggccaacaataaaagcgagatggaagcgaagaaatactatgtggactctgtggagggccgatcacatctccacagacaacgacaagaaatcaattctttttagacaaaatgaactagtctgagagtacgaggacacggccatgtattacgtgtacgaagagaacagacgttggggaccgaacgggaacccgtggtccaccgtcctcctcgacgtccctaccgaaccgaacgggcccctaacgttcccggttcccgttcccccggtggccccgtcccgtcgtccctaccggacggacgcccaaccctaccggaagacgccaaccgacgggcccggtccggtacggggccgttcggcccggttacgggttaccgaaacgggtaccctttaccttacccgaacgtttaccctaaccgtaacccgttacggtacggtaaccgggtccggggtaccgttacggggacccgaagggcccgacgtaaacgtaggcacgnnnnnnnnnnnnn

SEQ ID NO: 57841 - DNA, 672 bp, Homo sapiens
  misc_feature: GYAE6OF01DY4OE.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctgtaggagacagacgtcaccatcacttcggccggcctaggtcggtactagttacgtaccgtggttggcctaggtactacaacgaaggaaaaccgaacgggaaaccgtaccccgtaacggtcctagtactactatcgtactcgtcctacgtacgtttacggaacggtccgggtacctacgtacgtaaggtacgtagacggtacgtagtacgtagtacgtacggtacgtaacgtaactactactacgtactacgactacgacgtacgtccgtacgaccgtacgtaccgtagtacgttattacgttacgttacttaactttacttacgttacgtacgtacgtactaacgtaagtaaggttagggtacgtacggtaccgggtacggtacgggtaacggtacggttaagaacgtacgtaaacgtaacgtaacggtcgtaggtacgtcgaccgtactcgttctacgttacttccgtcgttcccgttaccc

SEQ ID NO: 57842 - DNA, 661 bp, Homo sapiens
  misc_feature: GYAE6OF01C9357.37.33.C11.1.454.CMB.1.raw
  modified_base (279)..(279): a, c, t, g, unknown or other
  misc_feature (279)..(279): n is a, c, g, or t
  modified_base (442)..(442): a, c, t, g, unknown or other
  misc_feature (442)..(442): n is a, c, g, or t
tcagtagtgtagatcacgaccggtgctcgatttagagtgagctcgttgggtttgggggtcagactcagtcaggacacagcatggacatgagggtccccgctcagctccgtggggctcctgctgctctggctcccaggagccaaatgtgacatccagatcgaccagtcctcctccacctgtctgcatctgtaggagacagagtcacatcactcgccgggcaggtcgactattacgtaccgttggttcgcctggtatacaaacgagaaaccgagggaaccnccccgtaaggtctgacttactatgactcgacccttaccgtaacgtttacgggaaacggtccgggtacccagttaccgaaaggttccgagtccggactaggtcgttacgcggttacgggaaatacggtaacttccaccttctaccgacctataccgaggtaccnccgtagtccgacgtctagtacttgttacttttcgaactttaactttattaccgtgtactagtacctaagttaagtaaggtacggacgtaacgggttccgggaaccggtacgggtaccgtagggttacgaacgtacgaaacctaaacgggacgttgggtacgacgtcgaccctaactacgtttacttcgttacctttccgtaccgttccccgttaccccg

SEQ ID NO: 57843 - DNA, 615 bp, Homo sapiens
  misc_feature: GYAE6OF01CTAK2.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatggcccagtctccttccaccctgtctgcatctgtaggagacagagtcaccatcacttgccgggccagtcggactattagtaccgtggttgcctggtatcaacagaaaccagggaaacgcccctaaggtcctagatctatgatcgcctcacgtttggaacgcgggtccatcgaagttcagcgcagtgtatcgtgggacaagaacttcactctacaccatcagtacgcctgcagtcctgattacgtatttcgactaaactttatacttgtacagtactaacttaagtaacgtggggtaacgtagtttccgggaccggtacggggtaacccggtaggggtttacggaagtaacgtaaaccgtaaaacggtaaacgttcgggtagggtaccgttacggaccctaaccgttaacgtttcccgttacggttacctttaccgtacctttccccggtttaacccccg

SEQ ID NO: 57844 - DNA, 620 bp, Homo sapiens
  misc_feature: GYAE6OF01AGU0K.37.33.C11.1.454.CMB.1.raw
tcagtagtgtagatcacgaccggtgctcgatttagagtgagctcgttggggtttgggggtcagactcagtcaggacacagcatggacatgagggtccccgctcagctcctggggctcctgctgctctggctcccaggagccaaatgtgacatccagatcgacccagtctccttccaccctgtctgcatctggtaggagacagacgtcaccatcacgttgccgggcagtcggacttagttacgtaccgtggttcggcctggtactacaaacaacgaaaccgaggggaacgtccccgtaaggtcctagactctatgactcgaccttccgtacgtttacgggaaacggtccggggtcccaagttacgtaaggttcgaggcggtactaggtcgtactcggtagggaactaggtaacttccactctaccacactcgagtacgacctgccgacgtccgtagtattagttactttacgacttaactttactacgtgtacagtactactaagtagaggtacgtgtacgggacgtagggaccgtagggttacaagactaaaccgaacgtacgttggcggtctaccgaccacgtacgttcgttcgttacctctaccgttcccgttacccg

SEQ ID NO: 57845 - DNA, 584 bp, Homo sapiens
  misc_feature: GYAE6OF01CBMDQ.37.33.C11.1.454.CMB.1.raw
  modified_base (193)..(193): a, c, t, g, unknown or other
  misc_feature (193)..(193): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
  modified_base (440)..(440): a, c, t, g, unknown or other
  misc_feature (440)..(440): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgaccagtctccttccacctgtctgcatctgtagganacagagtcaccatcacttcggccggccagtcgatattagtacctggttgcctggtatacaacaacgaaaccgagggaaacaccccgtaagtcctgactctatgatcgcccttaccgtacgtttagggaaacggccgggtacccaagttccgaaggttcagccggcagtntagtcgtgggaacagtaactcactcactactanacacgtacgcctgcgtacgcgtgatgttatttcacttaacttttntacgtcgtcagtactaacttaagtaggtacgggtacgtacgttccgggaacggtacgggtacgtaggggttacagtacgtaaacgaaacggtgtcggtagactcgaccgtactacttgtacgttcttcctaccttccgtacccg

SEQ ID NO: 57846 - DNA, 533 bp, Homo sapiens
  misc_feature: GYAE6OF01AO015.37.33.C11.1.454.CMB.1.raw
  modified_base (273)..(273): a, c, t, g, unknown or other
  misc_feature (273)..(273): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccagggaaacncccccaagctcctggtctacgctgcatccaatttggaaacaggacgtcccatccaaggttcagtaggaagtggatgtgggactagtattttactttcacctttcagcagcctgctagtctgaagacattgacaacattcttattgtcaaccacagtcgaccggtccctagggaaccaaagtcggaatactacaaacgtaactggtagactgcaacctntacgtntaccgttcacttcccttaccgcctattcctgtaacc

SEQ ID NO: 57847 - DNA, 586 bp, Homo sapiens
  misc_feature: GYAE6OF01BMYCW.37.33.C11.1.454.CMB.1.raw
  modified_base (274)..(274): a, c, t, g, unknown or other
  misc_feature (274)..(274): n is a, c, g, or t
  modified_base (364)..(364): a, c, t, g, unknown or other
  misc_feature (364)..(364): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctgtaggagacagagtcaccatcacttgccgggccagtcggactattagtacctggttgcctggtatacaacagaaaccgaggaacncccctaaggtcctgatctatgatcgcctcgtatttaggaacgtccgggtacccagtacgtaaggttcacgcggctagtgtatcgtagganagtatcactcacacatcagtacgctgcagctgattgttatttacgactaactttatacgtcgtacacgtactaacgttaagtaagtcgggtaaggtacgttccggggaccgggtaagggtacccggtaagggttgaaacgtaacgtaaccgtaaaacggttacgtggtacggactcggacctacctagttctacgttaccgttactccgttcccgtaccccg

SEQ ID NO: 57848 - DNA, 611 bp, Homo sapiens
  misc_feature: GYAE6OF01C2TAI.37.33.C11.1.454.CMB.1.raw
  modified_base (374)..(374): a, c, t, g, unknown or other
  misc_feature (374)..(374): n is a, c, g, or t
  modified_base (408)..(408): a, c, t, g, unknown or other
  misc_feature (408)..(408): n is a, c, g, or t
  modified_base (458)..(458): a, c, t, g, unknown or other
  misc_feature (458)..(458): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagttcctccttccaccctgtctgcatctggtaggagacagagtcaccatcacttggcccgggccagtcggacttagttacgtaccttggttggcctggtatacaaacaagaaaccgaagggaaacgtcccctaaggtcctgatactatgtactcgcctcctagtttaggaaacggtccgggtacccagtcgaaggttcagcggacagtgtancgtagggacagtaatcactctacacatcaagtcncgtgacctagctagtaattgtacttttagacttaaacgtttattaccgtntaccgagtactaacgttaataacggtaggtacggtacggttaccgggaccggaaggggtaccgtagggttagaacgtactaacgaaaacgtacgtggtacggacgtacgacctaaccgtgttacctacgttaccttcctagtcccgttacccg

SEQ ID NO: 57849 - DNA, 792 bp, Homo sapiens
  misc_feature: GYAE6OF01DU070.37.33.C11.1.454.CMB.1.raw
  modified_base (233)..(233): a, c, t, g, unknown or other
  misc_feature (233)..(233): n is a, c, g, or t
tcagtagtgtagatcacgaccggtgctcgatttagagtgagctcgttgggtttgggggtcagactcagtcaggacacagcatggacatggagggtccctgctcagctcctgggactcctgctgctcgtggcctcccaggtagcgggtgtgactattctgatcgacccagtcctccatccctccctgtctgctatcgtggtaggagacagagtcatcatcacgttcggccgganagtcgaggctaattaagaatgtattaggctaggtactcagacgaacgaaaccggaaggaaaccgtaccccgtaacgcctacctactacttacttaggtggtactactaacttaccgttaaacgtttaaccgaaacggttacgggttaccctaaagttaaacgtaacgttacggacggtccggtacgtaagggtacggtaacgtcgtacggactaaacgttacgtttaacctttacctaaccctttccgtaaccctaaccctaacgttaacccgacggtaccgaacccggtccgtaccggtaccgtaaccggtaccgttaacggttaaacgttttacgtttttaaccgaaccttttaaacttttaaccgtttaacgttaccgttaacttaaaccgtaagtttaaaccctttaaaccgttaacccgttttaccccgttacggtttaaccccggttaccgggaaaccggtaacgggtaaacccggtaaacggggtaacggttaaaccgtaaccgaaaaccggtaagttcggtaacgtcctacggtacctaaccgtgttaccg

SEQ ID NO: 57850 - DNA, 784 bp, Homo sapiens
  misc_feature: GYAE6OF01ARR0O.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctcctgggctcctgctgctctggctcccaggagccaaatgtgacatccagatgacccagtcctccttccacctgtctcgcatcgtgtaggacgacagacgtccaacctatctaccgttgggcccgggacctaaggttccgggaacttaattacggtaccgttggttcggtacccgtaggttactacaaaccgaagaaaaccgaagggaaaccgccccgtaacggtcctacggtactacgtactaggactcgtccctacctagtttacgggaacgtaccggggtaccctagtaccgtaaagggttccgaacggtccgggacgtaacggtacgttaagttccggtagggaactaacggtaaacttacctacgtacctaccgaacctacgtacctacgttaccgacccgttacaccgtaccgtccgtaacggtaacgtttacgtaacgtttttcggaacctttaacgtttaccgttacgttacggtaacctaacggtaccttaaccgttaaggttaacggtaggggtaccgtacgggtttaccggaccggttaacgggtaacgggtacgggttaggaacggtaacggaccgtaaaaccggtagtccgggttaggaccggttaccgacgtaacccgtttcgtacgttaacggttccctttaacgtccccgtttcggtaaccccc

SEQ ID NO: 57851 - DNA, 588 bp, Homo sapiens
  misc_feature: GYAE6OF01C15YV.37.33.C11.1.454.CMB.1.raw
  modified_base (272)..(272): a, c, t, g, unknown or other
  misc_feature (272)..(272): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttcaccctgtctgcatctgtaggagacagagtcaccatcacttgccgggccagtcggactattagtacctggttggcctggtatcaacagaaaccagggaaancccctaaaggtcctgatctatgatcgcctccactttaggaagcgggtacccatcaaggttcaggcggcagtcgtatcgtagggacagaattccacttctaccaaccatcagtacgacctgacacgcctagattagtattttcgacttaactttatttactcgttacagactaacttaagtaaagtgggtaagtacgttaccgggaccgggtaagggaccctagggggttacgaacggtaactaccgaaacggtacgtaggtaggcgttacgacctaacgaacttcgttacgttccttacctcgttcccttaccccg

SEQ ID NO: 57852 - DNA, 659 bp, Homo sapiens
  misc_feature: GYAE6OF01C8R45.37.33.C11.1.454.CMB.1.raw
tcagtagtgtagatcacgaccggtgctcgatttagagtgagctcgttggggtttgggggtcagactcagtcaggacacagcatggacatggagggtccccgctcagctcctggggctcctgctgctctggctcccaggagccaaatgtgacatccagatgaccagtctccttccacctgtctgcatctgtaggagacagacgtcaccatcacttggccggcaggtcgactattagtaccgtggtcgcctggtactacaacaagaaaccgagggaaaccgcccctaaaggtccagtactctaagtcgactcggcccttaccgtacgtttacgggaaaacgggtccgggggttaccctaagtacgtaacgggttcgaacggccggacgtagtggttacgtcgtagggaaactaggtaacttactactccgtacacctatacgtagtaacgtcctgacacgcctgtaacgtgttaattttcgaacttaactttaagttactgttacacgtctaactaagttaagaggggtagtaacgttccgggaccggaagggttaaccggagggttaaggaacgtaagtaaccgtaaaggaaccggttggtacgtcgtacgacctaaccgtattaccgttcggtacctttctaccgttccccgttacccg

SEQ ID NO: 57853 - DNA, 690 bp, Homo sapiens
  misc_feature: GYAE6OF01CT6CM.37.33.C11.1.454.CMB.1.raw
  modified_base (99)..(99): a, c, t, g, unknown or other
  misc_feature (99)..(99): n is a, c, g, or t
  modified_base (486)..(486): a, c, t, g, unknown or other
  misc_feature (486)..(486): n is a, c, g, or t
tcagtagtgtagatcacgaccggtgctcgatttagagtgagctcgttgggtttgggggtcagactcagtcaggacacagcatggacatgagggtccccntcagctcctggggctcctgctgctctggctcccgaggagccaaatgtgacagtccagatgacccagtctccttcacctgtctgcatctgtagagacagatcaccatcacttgccggccaggtcggtactagttgtaccgtggttcggcctaggtatcaacgagaaaccgagggaacgccccgtaaggtcctgatctatgactcgcctacctagtttaggaacgtccgggtaccatacgaaaggttcaacgtcggacgagttgtaacgtcgtagggaactaacgtaactttccgaaccttaccgtactaacccctagtacgtaagtaccggtacccgtaggaccacgtccgtaagtcgttaacgttactttacgaaccgtttaacttntttaaccgtcgtacgacgtacttaacgtattaaacgggtggtaacgttaaccgtcgggaaccgtaggggtaaccgttacggggtagttaaacggtaacctttaaaccgggaaaacgtacggttacgggacggtacgttccgacccttaacccgttagttaccccgttagttccctttacccggtcctttcccccggttaacccg

SEQ ID NO: 57854 - DNA, 543 bp, Homo sapiens
  misc_feature: GYAE6OF01EESQP.37.33.C11.1.454.CMB.1.raw
  modified_base (139)..(139): a, c, t, g, unknown or other
  misc_feature (139)..(139): n is a, c, g, or t
  modified_base (352)..(352): a, c, t, g, unknown or other
  misc_feature (352)..(352): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
tcagtagtgtagatcacgaccggtgctcgatttagagtgagctcggttgggtttgggggtcagactcagtcaggacacagcatggacatgagggtccccgctcagctcctggggctcctgctgctctggctcccagganccaaatgtgacatccagatcgacccagtcctccttccaccctgtctgcatctgtaggagacagagtcaccatcacttcgccggccagtcgactattagtacctggttggcctggtatcaacagaaaccagggaacgcccctaaggtcctgatctatgactcgcctccgactttagggaacgccggggtacccaatcgaaggttcacggcggcngtgtactcgtgggacagtacttcacctctacacctatcacgtcgcctgacacgcctagatgtattttgactaactttatacgtntcatcactatagnggatcgttcggcgaggcgtaggtgagtactacgaaacgtgtggtagctcggacacccgtagttcttacgttaccttctaccgttccctaccccg

SEQ ID NO: 57855 - DNA, 642 bp, Homo sapiens
  misc_feature: GYAE6OF01CQPAH.37.33.C11.1.454.CMB.1.raw
  modified_base (411)..(411): a, c, t, g, unknown or other
  misc_feature (411)..(411): n is a, c, g, or t
  modified_base (626)..(626): a, c, t, g, unknown or other
  misc_feature (626)..(626): n is a, c, g, or t
  modified_base (633)..(642): a, c, t, g, unknown or other
  misc_feature (633)..(642): n is a, c, g, or t
tcagtagtgtagatcacgaccggtgctcgatttagagtgagctcggttggggtttgggggtccctgagactctcctgtgcaacctctggattcagttgtagtgattgttggatgggttgggtccgccaggctccgagggaaggggctggacgtgggtggccaacataaagcgagatggaagcgaagaaatactatgtggactctggtggaggggccgaattcaccatctcacagacaacgcaagaaatcaattctttttagacaaatgaacaggtctagagagtcgaaggacacggcatgtatactgtacgagagaacagacgttggggccacgggaaccctggtaccaccggtcctcctcacgcctacccaaccgaaacgggccccaagtcccggttacccttcccccgnggtcccgtccccttcggcctccggaaggacgaccctaccgtcccggaacggacgaccgaaccgacggacccggtcccggtcggggtcctccggtcccgttagggttaccgaaacggttacccgttaaccctttaccgaacttacccgtaaccaaccgttaccgttgggaaccgcggggtacgtacggaccgaaacggcgaccgagttaaggcagngtcacgnnnnnnnnnn

SEQ ID NO: 57856 - DNA, 538 bp, Homo sapiens
  misc_feature: GYAE6OF01C7XGR.37.33.C11.1.454.CMB.1.raw
  modified_base (515)..(538): a, c, t, g, unknown or other
  misc_feature (515)..(538): n is a, c, g, or t
tcagtagtgtagatcacgaccggtgctcgatttagagtgagctcgttgggtttgggggaagaggaagactgacggtccgccaggctccagggaaggggctggagtgggtggccaacataaagcgagatggaagcgagaaatactatgtggactctgtgagggccgattcaccatctccacagacaacgccaagaaatcaatctttttgcaaatgaacagtctgagagtcgaggacacggccatgtattactgtacgagagaacagacgttggggccagggaaccctggtccaccgtctcctcgacgccctccaaccgaacgggtccccacgttccggtcccttcccccgtggccgcccctcgcctccgaggacgccaacccgtcgaacgacgccacgacgcccggcccgtgggcctcgccgttggtaccgaaaggtccttaaccttcctactccgttaacctacttaaccgtggaacggtcgggcgttacgggccgaaaggccgacacttaggcnnnnnnnnnnnnnnnnnnnnnnnn

SEQ ID NO: 57857 - DNA, 755 bp, Homo sapiens
  misc_feature: GYAE6OF01EBPSH.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagacgtcaccatcacttgccgggccagtcggactattagtaccgtggttggcctggtatacaacaagaaaccgaggaaacgcccctaaggtcctgatctatgatcgcctccgtacgtttaggaaagtccgggtacctaagtacgtaagggttcaaggccggcgtagttacgttacgtcgtagggtaactaacggtaactttacctaaccttcctaccaacccgtaattccgtaacggttacgacccgttaggcccgtaacggtcccttaaggtaactttacggttaagtttttacgtaaccctttaaaacgtttttacctttaaccgtttacggttaccgtaacgtaacccgttaaacgtttaaagttaaacgggttacgggggtaaacggttaccgggttttacccggggaacccggggttaacgggggtaaccccggttaagggggttaggaacggtaacgtaaacccgtaaaacggttaacggtaggttcgggtaccgttccgaccgtaaccctagttccgttcttaccctttactccgttccccgttacccccg

SEQ ID NO: 57858 - DNA, 530 bp, Homo sapiens
  misc_feature: GYAE6OF01BXVNH.37.33.C11.1.454.CMB.1.raw
  modified_base (372)..(372): a, c, t, g, unknown or other
  misc_feature (372)..(372): n is a, c, g, or t
  modified_base (465)..(465): a, c, t, g, unknown or other
  misc_feature (465)..(465): n is a, c, g, or t
  modified_base (517)..(517): a, c, t, g, unknown or other
  misc_feature (517)..(517): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaacgcccctaaggtcctgatctatgatgcctcactttggaagcgggtccatcaagttcagcgcagtgtatcgtgggacagtaactcactctcacatcagtancctgcagcctgattgtattttcgactaacttattactgtcagtcctaataataagtgggagtacgttcggaccggtagggaccgtagggttanagtaatacgaaaacgtacgtggtagcgtcgacgacctagttctagttcttcncttccgtaccccg

SEQ ID NO: 57859 - DNA, 667 bp, Homo sapiens
  misc_feature: GYAE6OF01BMI12.37.33.C11.1.454.CMB.1.raw
tcagtagtgtagatcacgaccggtgctcgatttagagtgagctcggttgggtttgggggtcagactcagtcaggacacagcatggacatgagggtccccgctcagctcctggggctcctgctgctctggctcccgaggagccaaatgtgacatccagatgacccagtctccttccaccctgtctgcatctgtaggagacagagtcacatcacttcgccgggccagtcggacttattacgtaccgtggttggcctggtactacaaacaagaaaccgagggaaacgccctaaggtcctagactctatgatcgcccttcctaacgtttagggaaacggtccggggtacccacgtcgtaacggttccaggcggacagttcgtagttcgtagggaactaggtaacttcgacctctaccgacctatacgacgtaccgtccgtagcctacgtcctagtaacttggttaacttttcggaaccttaaacgtttattaccttacgtactaacgtctaacgttaagttaacggtagggaacgtacgtttaccgggggaccgtaacggggtaccttagggggttacgaaggtaacgtaacgaaaccggtacgtcggttaggaccgttacgacctaaccgtacgttcgttagttacccttacgtaccttcccgtaccccg

SEQ ID NO: 57860 - DNA, 699 bp, Homo sapiens
  misc_feature: GYAE6OF01A3GWM.37.33.C11.1.454.CMB.1.raw
  modified_base (348)..(348): a, c, t, g, unknown or other
  misc_feature (348)..(348): n is a, c, g, or t
tcagtagtgtagatcacgaccggtgctcgatttagagtgagctcgttgggtttgggggtcagactcagtcaggacacagcagtggacatggacgggtccccgctcagctccgtgggcctcctgctgctcgtggcctcccgaggacgaccaaatgtagacactccagatcgaccctagtcctccttccaccctgtctgctatcgtaggtaggagacagacgtaccacctatccgtacgttcggccgggaccaggtccgaacttacgttacgtaccgttgggttcgccgtaggtactaccaacgaacgaaaccgaaggaaaccgaccccgtaagtcctagtactactagngtactccgtcctacctacgttaggaacggtccgggtaccagtacgtaaggtcacggtcgctagtgtacgtcgtaggactaacgtactccactctccaactatacgtacgtacgctacgctagtcctagtacgttacgttagtttacgactttaactttagttacgtgtacacgttactaacgttaagtaacggtacggtagtaccggttaccgggtaccggacgggtaaccgtaggggtacgaacgtaaccgtaaacgtaaaccggtagtcggggttacgtacgtaccgtaccctaaccggttactttacccggttcgtttaacctcccgttaaccgtccccggttacccg

SEQ ID NO: 57861 - DNA, 692 bp, Homo sapiens
  misc_feature: GYAE6OF01ESP5B.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaaatgtgacatccagatcgaccagtctccttccacctgtctgcatctagtaggagacagagtcacatcacttggccggtccagtcgacttatagtacctggttgccttggtatacaacgagaaaccgaagggaaacgtccccgtaaacggtctaggatacctatcggaatcgacccttaccgaacgttttaacgggaacggtccggggtcccctaagtaccgtaacgggttccaacggtccggtacgtaggtggtactcggttaggaacgtaaagtaactttccaacgtccttacgactaacgtcagtacgcctgactcgtccgtagtacttaggttacttttacgaactttaaactttacgttacttacggtactgtaaccctaattaagttaaccggtagggtaactaccgggttacgggaccggaaggggttacccgtaaggggtttacgaaacgtagtaaaccgtaaacgggttaacgtagggttacggtacgtacgtaccaaccgttacgttccttactttacgacctaccgttcccgttaaccccg

SEQ ID NO: 57862 - DNA, 566 bp, Homo sapiens
  misc_feature: GYAE6OF01BKMJH.37.33.C11.1.454.CMB.1.raw
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttcgccggccagtcggactattacgtacctggttcggcctggtatcaacagaaaccgaggaaacgcccctaaggtcctgatctatgatcgcctcacgtttggaaacgcgggtccagtcgaaggttcaggcgcagtgtagtcgtggacagtaattcactctcaccatcgacgtatcctgcctagctgtatcgtatttagactaactttattactgtacanctaacttanaacgtggaacgtacgttcgggccggaacgggaccgtagggttacaaggtactacggaaacgtaacgtggtaggacctggaccctaacgccttacttcggttacctttaccgaccttcccgtaccccg

SEQ ID NO: 57863 - DNA, 769 bp, Homo sapiens
  misc_feature: GYAE6OF01EH3G1.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaaatgtgacatccagatcgaccctagtcctcccttccaccctgtctgctatctggtaggagacagagtcacctatcctacgttcggccggcctagtccggaacttagttacggtccgttggttacgcccgttaggtactacaaacgaacggtaaaacccgaaggggaaaccgacccccgttaaggtaccccgtaggtaacttaccgtacgtaggtacttaccgtcccttacccgttaacgtttacggggaaacggtcccggggtaccctaagtaccgtaaacgggttccgaacgggtacggtacgtaggttacgtacgttacgggtacgggtaactaacggttaaacttccaccgttcctaaccgaacctaataccgtaagtaccgtcctacgcgtacggtaccgtagtaacgttacgttacgttttaccgaactttaaccttttaacgttaccttacgttaccgtaacgtaaccttaagtaaacggttaaggtacggggtaacggtttaccggtacccgggtacgggtaaccgggttacggtaacgggttgaaacgtaccgtaacgtaaacggtcgttaggcgtacacgtacctactacgttcgtcttacttctactccccgttaccg

SEQ ID NO: 57864 - DNA, 597 bp, Homo sapiens
  misc_feature: GYAE6OF01AGMY6.37.33.C11.1.454.CMB.1.raw
  modified_base (283)..(283): a, c, t, g, unknown or other
  misc_feature (283)..(283): n is a, c, g, or t
  modified_base (410)..(410): a, c, t, g, unknown or other
  misc_feature (410)..(410): n is a, c, g, or t
  modified_base (460)..(460): a, c, t, g, unknown or other
  misc_feature (460)..(460): n is a, c, g, or t
  modified_base (585)..(585): a, c, t, g, unknown or other
  misc_feature (585)..(585): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacgttgccggcagtcggactagttacgtaccgtggtcggtcctaggtactacaacaagaaaccgagggaaaccnccccgtaaggtcctagatctatgactcgcctactacgttggaacgcgggtaccagtacgaaggttcgacgcggtactagtacgtacgtgacgggacagtaacttcactctacacctatcgagttacncctgacacgtacctagtacttagtacttttagacttaactttacttacgngtactaacgtactaacttaagtaagtacgggtagtaccggtttaccgggacggtacgggaccgtagggtacgtagtactaacgaaacgtggtcgtggactcacgtacgtgttcgtcgttactacncttccgtacccg

SEQ ID NO: 57865 - DNA, 667 bp, Homo sapiens
  misc_feature: GYAE6OF01D75EY.37.33.C11.1.454.CMB.1.raw
  modified_base (395)..(395): a, c, t, g, unknown or other
  misc_feature (395)..(395): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctggtaggagacagagtcaccatcacttgccgggccaggtcgatattacgtcctggttgcctggtatcaacagaaaaccagggaagacccctaaggtcctgattctatgatcgacctccacgtttggaaacgcggggtcccagtaccaggttcagcggcagtgatcgtggacagaattcactctcacatacacgtagacccttgaccgngcccttagtagttgaacgtttttacgacctaacgtttattacgtacgttacctaggtaacctaacttagtaaacggttcggggtaaacggttacgtttacccgggggcccggtaaggggggtaaccccgtagggggtttaacggaagggtaaaacgttacccgtaaaaaaacgggtcgttacggggttaaccggttcggtaacgggaccctaaccccgaatttccgggttacgttaccttttaccgaacgttttccccgtttaaccccccgg

SEQ ID NO: 57866 - DNA, 641 bp, Homo sapiens
  misc_feature: GYAE6OF01ECIRB.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaaatgtgacatccagatgacccagtctccttccaccctgtctgcatctgtaggagacagagtcaccatcacttggccgggccagtcggactattacgtacctggttggcctggtatcaacagaaaccaagggaaacgcccctaaggtcctgactctatgatcgcctcgtacgtttaggaaacgtcgggtacccagtcgtaaggttcacggcggctaggtgtacgtcgtagggaacaacgtaacttccactctaccacctataccgagtacgccttggactacgtccgttagtacgtagttattttacgtacttaaacgttttatacgtgtacagtactaacttaagttaagtagggtagtacgttacgggaccggtacggggaccgtaggggttaggaacgtacgtaaacgaaaaccggtagttcgggtacggtaccgttacgacccgtaaccgtacgttcgttacgttacccgtttaccttaccgttcccgttacccccg

SEQ ID NO: 57867 - DNA, 705 bp, Homo sapiens
  misc_feature: GYAE6OF01DOZEV.37.33.C11.1.454.CMB.1.raw
  modified_base (401)..(401): a, c, t, g, unknown or other
  misc_feature (401)..(401): n is a, c, g, or t
tcagtagtgtagatcacgaccggtgctcgatttagagtgagctcgttgggtttgggggtcagactcagtcaggacacagcatggacatgacgggtccccgctcagctcctggggctcctgctgctctggctcccaggagccaaagtgtcggactagtccaaggactacgaccctagtctcccttccaccctgtctgcatctgaggagacagagtcaccatcacgttggccggccaggtcggtactattacgtaccgtggttcggccttaggtactacaaacgaacgaaaaccgaagggaaaccgtcccccgttaaggtccctagtacttacgtatcgactcggtccctaccgtacgtttagggaaccggtccgggtacccagtacgaacggttcgagcggngaggtgtacgtcggtaggaactagtaactctacctctacgacctagtacgtacgtacgtccgttacgaccgtacgtacccgttagtacttaggtttaactttagtacctttaaactttaacgttcgtacgttaccacgtactaacgttaagtaaggttagggacgttacgggtaccggtaccgggtacggggtaaccggttagggttagaacgtaacgtaaccggtaaagtacgttaagggtcggtaccgttacgaccacgttacgtaccgttacgttcccttacgtccgtttcccgtaccccg

SEQ ID NO: 57868 - DNA, 568 bp, Homo sapiens
  misc_feature: GYAE6OF01BC2FS.37.33.C11.1.454.CMB.1.raw
  modified_base (405)..(405): a, c, t, g, unknown or other
  misc_feature (405)..(405): n is a, c, g, or t
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagatcaccatcacttgccgggccagtcggactattagtacctggttgcctggtatcaacagaaaccagggaaacgcccctaaaggtcctagactactaatgatcgccttccgtacgttttagggaaacggcgggtccccaatcgtaaaggttcagcggctagtgtatcgtagggacaagtaattccactcctacacctatacagtacncctgcagcctagtatgtatttnactaactttnttacgttgtcagtctaacttaatacgtagggatacgttcggaccgtagggacctagggtagagacgtacaaacggtactcggtaggcttcggacctacagttaccgttgtaccttctagttcccctacccg

SEQ ID NO: 57869 - DNA, 622 bp, Homo sapiens
  misc_feature: GYAE6OF01BS2P3.37.33.C11.1.454.CMB.1.raw
  modified_base (100)..(100): a, c, t, g, unknown or other
  misc_feature (100)..(100): n is a, c, g, or t
  modified_base (347)..(347): a, c, t, g, unknown or other
  misc_feature (347)..(347): n is a, c, g, or t
  modified_base (386)..(386): a, c, t, g, unknown or other
  misc_feature (386)..(386): n is a, c, g, or t
  modified_base (545)..(545): a, c, t, g, unknown or other
  misc_feature (545)..(545): n is a, c, g, or t
tcagtagtgtagatcacgaccggtgctcgatttagagtgagctcgttgggtttgggggtcagactcagtcaggacacagcatggacatgagggtccccgntcagctccgtggggttcctgctgctctggctcccaggagccaatgtgacatccagatgacccagtcctcctccaccctgtctgcatcgtgtaggagacagagtcaccatcacgtgccggcagtcgacttatagacgtgtcgctggtatacaacaacgaaacgaggaacgcccgtaaggtcctgtatctatgattcgaccttacgtacgtttagggaacgtccggttaccatacgtaacggtcacggnggacctagttcgaagtcggtaggaactagtaacttaccncttactaccgaactagtacgagtaccgcgtacgactacgctagtattagttactttacgaactttaactttagttacgtacgtactacgtaccttaagttagttaacgggtacggtaacgtacggtaccggggaacggttaacgggtacggttaagggnaaacgtaactacggaaacgttgtaggtccgtcacgtactaccgtcttcgtccttacttaccttcgtcccgtcccgta

SEQ ID NO: 57870 - DNA, 456 bp, Homo sapiens
  misc_feature: GYAE6OF01CATLC.37.33.C11.1.454.CMB.1.raw
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (442)..(456): a, c, t, g, unknown or other
  misc_feature (442)..(456): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtggaggggccgattcaccatctccacagacaacgccaaagaaaatcaaattctttttgcaaatgaacagtctgagagtcgaggacacggccatgtaattactgtacgagagaacagacttggtggccaagggaaccctggtcaccgtctcctcacgcctccaaccgaacgggccccatccggttcctttcccccgngggccncccctgcctccgaggagacctacctccgagacgcacgacggcgcccgtggctgcctggcaaaggtctacttccatcacatacgtgacgcggctaggcaaggcacatagnnnnnnnnnnnnnnn

SEQ ID NO: 57871 - DNA, 415 bp, Homo sapiens
  misc_feature: GYAE6OF01DPVE2.37.33.C11.1.454.CMB.1.raw
  modified_base (327)..(327): a, c, t, g, unknown or other
  misc_feature (327)..(327): n is a, c, g, or t
  modified_base (410)..(415): a, c, t, g, unknown or other
  misc_feature (410)..(415): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatccggtcttccccctggcgccctgctccaggngcacctcgagagcacagcggccctgggctgcctggtcaaggctactccatctacactactgagcggctggcaaggcgcatagnnnnnn

SEQ ID NO: 57872 - DNA, 566 bp, Homo sapiens
  misc_feature: GYAE6OF01C6TKF.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagctgggttttccttgttgctattttagaaggtgtccagtgtgaagtgcagctggtggactcgtgggggaggcctggtccagccgtggggggtccctgagactctcctgtgcaacctctggattcagttgtagtgattgttggatgggttgggtccgcaggctccgagggagggctggagtgggtgccaacataagcgagagtggaagcgaagaaatacatgtgatcgtgtgcgggcattcaccatctaccacagacaaaccgaccaagaaactactaattctttttagactaaatgaacagtactagagagtacgaggaccgacggacagttagtacgttactaggtaacgaagacgaaacgacggtacgttacggggaccgaacgggacccgtacggtcccgtacccggttacccg

SEQ ID NO: 57873 - DNA, 647 bp, Homo sapiens
  misc_feature: GYAE6OF01DV33I.37.33.C11.1.454.CMB.1.raw
  modified_base (404)..(404): a, c, t, g, unknown or other
  misc_feature (404)..(404): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgaccagtctccttccacctgtctgcatctgtaggagacagagtccacatcacttggccggccaggtcggactattagtaccgtggttggcctggtactacaacaacgaaaaccgagggaaacgaccccgtaaaggtccctagactactatgactcgcctacctacgtttaggaacggtccgggtcccagtacgaaggttcaggcggcgtagtgtatcgtgggacagtaacttcactctacacactanacgtacgcctcgctacgcctagtagttgttatttgtacttaactttacttacgtgttaccaacgtactaacgttaagttaacgtgggtaacgttacggttaccggggaccgggaacgggtaaccggtaggggttacgtaacggtaacgttaaaccgaaaacggttaccgtagggtacgggtccgtacgtaccgtactacgtttccgttacgtttacttacccttaccgttccccgttaccccg

SEQ ID NO: 57874 - DNA, 719 bp, Homo sapiens
  misc_feature: GYAE6OF01DHVTQ.37.33.C11.1.454.CMB.1.raw
  modified_base (192)..(192): a, c, t, g, unknown or other
  misc_feature (192)..(192): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgaccagtctcctcaccctgtctgcatctgtagganacagagtcaccatcacgttgccgggcagtcggactagttagtccgtggttggccttggtactacaaacgacgaaaccgaagggaaacgacccctaaggtcctgatctatgactgcccttacactttaggaaaggtcggttcgtacccattaccgaagggttcagtccggactacggttagtagtccgtagggaacctaagtaacttccacgtcctactaacccgtataccgtacggttacgacccgttaggacctaacggtcccttagtaagttttacggttacgtttttacggaactttaaaccgtttaactttacgttacgttaacacgttaacctttaacgtaagttaacggtaggggtaacgttacggttccggggaacccgggttacggggtaccggtacgggggttaacgtaacggtaaacgtaaccggtaaaaacggtaaccgttaggggtacggttccggttaacgaccctaaaccgttaacgttcgttacgtttacccttccggtactttacccccgg

SEQ ID NO: 57875 - DNA, 437 bp, Homo sapiens
  misc_feature: GYAE6OF01DXXW8.37.33.C11.1.454.CMB.1.raw
  modified_base (431)..(437): a, c, t, g, unknown or other
  misc_feature (431)..(437): n is a, c, g, or t
tcagtagtgtagatcacgaccggtgctcgatttagagtgagctcgttgggtttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggccccatccggtccttcccccgtggccgccctgcctccgaggacgccaccctccgagacgcacacgcggcccgtgggctcgcctggtcaaggactactccatctacactactgagcggctggcaaggcacatagnnnnnnn

SEQ ID NO: 57876 - DNA, 541 bp, Homo sapiens
  misc_feature: GYAE6OF01AZVWQ.37.33.C11.1.454.CMB.1.raw
  modified_base (448)..(448): a, c, t, g, unknown or other
  misc_feature (448)..(448): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtagagacagagtcaccatcacttggccggccagtcggactattagtactggtggcctggtatcaacagaaaccagggaaacgcccctaaggtcctgatctatgatcgccttccacgtttagggaaacggtccggggtaccccataccgaaggtttcaaggcggcagtcgtatctgggacagtaattcactctcaccatcagtacgcctgcagcctgatgtatttgactaattacttactgcagctaatagtaagtgganacggttcgaccggtggacgtagggtgagtatacgaaacgacgttggcggacgtgtccgaactcgtcttcgttcctactcgttcccgtaccccg

SEQ ID NO: 57877 - DNA, 746 bp, Homo sapiens
  misc_feature: GYAE6OF01AOSPA.37.33.C11.1.454.CMB.1.raw
  modified_base (167)..(167): a, c, t, g, unknown or other
  misc_feature (167)..(167): n is a, c, g, or t
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagcgtgttcgtgtagcgtnttagaggtntcagtgtgagtgcagngtggtggctcggtgggggacgcgtggtccaggtccggtcggggggtccctgacgctcctccgtgtcgacaccttcgtggcttnagttgtagtntntttggtggtgttgggttggtccacgtcgcgtacggaggggagggcgttgggaggttgggtacgaccgaaanagtaaacgggngaagtagagggaacgagaagtaagtagtagtcgtacgtacgttggtgggtacgggaccgggtactacgtaccgtactacgtacccgtaccgaaacgaaccggaaccgaaacccgtaaaccgtaaacgtaaacttacgtttaaacgttttaccgtttaacgaaacgtttaaaccggttaacgaacgttaacgttaacggtagtaacgggtaacgggttaacggaaaccgggaaccggtaacgtaaccgtttaagttaacggtttaaccgttacgggtaaaccggtaacggaaagtaaacggtaacggtacgggttaaccgggttaccgggaacccggttaccgggtaaacccggttccggttacccgtacccggtccg

SEQ ID NO: 57878 - DNA, 556 bp, Homo sapiens
  misc_feature: GYAE6OF01BJWI8.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggccagtcggactattagtacctggttgcctggtatcaacagaaaccaggaacgcccctaaggtcctgatctatgatcgcctctactttaggaaacgcgggtccatcgaaggttcagcggctagtgtatcgtgggacagtaattcactctacacatcagtcgcctgcagcctgtatgtatttcgacttaactttacttactgtcaagtactaacgttaactaagtgggtaagtcggttaccggaccggtaagggaccgtagggttacgaagacgtacgaaaacgtacgtggtggacgtgaccaccgtaacgtcttcgttacttctacttcccgtaccccg

SEQ ID NO: 57879 - DNA, 717 bp, Homo sapiens
  misc_feature: GYAE6OF01DI7NA.37.33.C11.1.454.CMB.1.raw
  modified_base (588)..(588): a, c, t, g, unknown or other
  misc_feature (588)..(588): n is a, c, g, or t
tcagtagtgtagatcacgaccggtgctcgatttagagtgagctcgtttgggtttgaggtctcagagaagagccttagccctggactccaaggccctttccacttggtgatcagcactgagcacagagactcaccatggaattggggctgagcgtggttttctgtagctatttagaagtgtcagtgtgaagtgcagcgtggtggactcgtgggggagtcctggtccagccggtcgggggtccctggaacgtctctcctgtcgaccaaccgtctggattccgtaagtttgtagtgtatttggttggaggttcggggttcgggtcccgcgtacggtccgtaccggaagggggacggggtcgtggggtaaggtttcggggacgggaccccaaaacgtaagtaaaacgggccgtaaggtaaggtaagggaaaacggcgtaaaagtaaaagtttaacgtaagttcgggtacggtaaccttcggttagggtacgggaacggggtcccgtacttaccaccgtacttcgtacccagacgaaccaacgaccaagtaactactaactttcgttttacgaactaagttcgaactacggtntaggacgtagggtacggacggaccgtaccggacctattaggtacttacgtaggaaccggaagtaacggaaacgaggttaccggttacggggaaccgaacgggtacccttcggtccgtaacccgttcccg

SEQ ID NO: 57880 - DNA, 541 bp, Homo sapiens
  misc_feature: GYAE6OF01DGJ93.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctcactttggaagcgggtccatcaaggttcagcggcagtgtatcgtgggactagaattcactctcaacatcagtagcctgcagcctgatgtatttcgactaactttattactgtacagactaactagtaagtgggagtagttcggaccggtacgggacgtagggttacgagtaactacgaaacgtacgtggtcggactcggacctactattccgttagttccttaccactttcccgttaccccg

SEQ ID NO: 57881 - DNA, 793 bp, Homo sapiens
  misc_feature: GYAE6OF01B12E2.37.33.C11.1.454.CMB.1.raw
tcagtagtgtagatcacgaccggtgctcgatttagagtgagctcggttgggtttgggggtcagactcagtcaggacacagcatggacatgagggtccccgctcagctcctgggctcctgctgctctggctcccaggagccaaatgtgacatccagatgacccagtcctccttccacctgtctagcatctgtagagacagatcaccatcacttcgccggccaggtcgacttagttacgtaccgtggttcgtctggtatacaaacgtaacgaaaaccgaggggaaacgtcccccgttaagggtccctaggacttaccgtaatcgtaatccggtcccttacctacggttttagggaaaacggtcccggggtaccctaagttaccgaaacgggtttccaacggccgggtacctagggttagttaacggttcggtacgggggtaaactaacgggttaaacgtttccctaacctttaccacccgttaaacctacttaccgtaacggttaaccggtcccgttacggaccgtaacggtcccgttagttaacgttaggttacgtttttaacgaccgtttaaacctttagtttaccgtacgtaccaaggtacctaaacgttaagtaacggtagggtaacgttacggggttaccgggacccgggtaaggggtacccgtagggggtttaacgaacggtaacgtaaccgtaaaaccggtaggttaacgggttggacccggtacggtacccttaacccgtattaccgttacgttacccgtttcgtaaccgtttcccttaacccccgg

SEQ ID NO: 57882 - DNA, 549 bp, Homo sapiens
  misc_feature: GYAE6OF01BOTIV.37.33.C11.1.454.CMB.1.raw
  modified_base (509)..(509): a, c, t, g, unknown or other
  misc_feature (509)..(509): n is a, c, g, or t
  modified_base (534)..(537): a, c, t, g, unknown or other
  misc_feature (534)..(537): n is a, c, g, or t
  modified_base (539)..(549): a, c, t, g, unknown or other
  misc_feature (539)..(549): n is a, c, g, or t
tcagtagtgtagatcacgaccggtgctcgatttagagtgagctcgttgggtttgggggggtccctgagactctcctgtgcaacctctggattcagttgtagtgattgttggatgggttgggtccgccaggctccagggaaggggctggagtgggtggccaacataaaagcgagatggaagcgagaaatactatgtggactctgtgaggggccgattcaccatctccacagacaacgccaaagaaatcaatctttttgcaaatgaacagtctgagagtcgaggacacggccatgtattactgtacgagagaacagacgttggggccagggaaccctggtaccaccgtctcctcacgcctcccaccaacgggcccctagtccggtccttcccccgtggcccgccctgcctacccgaggacgccacctccgagacgccacgacggccggcccgtgggcctgcccgtggtaccaaggacctacttccatcctacactacgtgacggcgggtcncgggacaacgggccgacgtagtagnnnngnnnnnnnnnnn

SEQ ID NO: 57883 - DNA, 424 bp, Homo sapiens
  misc_feature: GYAE6OF01D5LNN.37.33.C11.1.454.CMB.1.raw
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (338)..(338): a, c, t, g, unknown or other
  misc_feature (338)..(338): n is a, c, g, or t
  modified_base (414)..(424): a, c, t, g, unknown or other
  misc_feature (414)..(424): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaaggcccatccggtcttccccnggcnccctgctccgaggacgcacctccgangcacagcggccctgggctcgcctgggtcaaggcctaccttccatcacactactgagcggctggcaaggcgcatagnnnnnnnnnnn

SEQ ID NO: 57884 - DNA, 695 bp, Homo sapiens
  misc_feature: GYAE6OF01DIC82.37.33.C11.1.454.CMB.1.raw
  modified_base (233)..(233): a, c, t, g, unknown or other
  misc_feature (233)..(233): n is a, c, g, or t
  modified_base (422)..(422): a, c, t, g, unknown or other
  misc_feature (422)..(422): n is a, c, g, or t
  modified_base (641)..(641): a, c, t, g, unknown or other
  misc_feature (641)..(641): n is a, c, g, or t
tcagtagtgtagatcacgaccggtgctcgatttagagtgagctcgttgggtttgggggtcagactcagtcaggacacagcatggacatggacgggtccccgctcagctccgtggggctcctgctgctcgtggcctcccgaggacgacctaaagtggtcggacctacgtaccgaaggacgtaccgacccgtagttccttcccttaccaccctgtcctgctattcgtggtagganacgagacgtaccaaccacctacgttcggcccgggactacggtacgtaacttagttacgtaccgttgggtcgcctaggtactacaaacgaacgaaacgacgggaacctcccgtaaggtccagtatactagtcgtactccgtacctacgtacgtttacgggaaccggtccggtacagtacggtacgtgcgngctagtgtacgtcgagactatacgtctactctacactactcgacgtacgtcacgcgacgtactgtacgttagttacgttactaccgttaactttcgttaacgtcgtacaacgttaccgtaattaacgggtaacggtacggtacgtacggtaccggggtaacggtaacgggtacggttagggtacgaacgtactaaacgggaacgtacggtgggttaccncggtactaccgtaccgtagtccgttacgtaccttactaccgtttccacccgtac

SEQ ID NO: 57885 - DNA, 704 bp, Homo sapiens
  misc_feature: GYAE6OF01B9085.37.33.C11.1.454.CMB.1.raw
  modified_base (100)..(100): a, c, t, g, unknown or other
  misc_feature (100)..(100): n is a, c, g, or t
  modified_base (193)..(193): a, c, t, g, unknown or other
  misc_feature (193)..(193): n is a, c, g, or t
tcagtagtgtagatcacgaccggtgctcgatttagagtgagctcgttgggtttgggggtcagactcagtcaggacacagcatggacatgagggtccccgntcagctctgggctcctgctgctctggctcccaggagccaaatgtgacatccagatgacccagtcctccttccacctgtctgcatctggagganactagagtcacctatccgacgttcggcccgggtaccaggttccggtacttagttacggtacccgttgggtttcggcccttggtaactaccaaaacgaacggtaaaaacccgaaggggaaaaccgcccccgttaaagggttcccctaggaacttccgtaagtggtactcggtacccttaccgtaacgtttagggaaacggtccgggtaccctaagtacgaaggttcacggtcggactaggttcgtactcggtacggaactaagtaactcgtacctacctacaccctagtaccgtaggtacgtccgtagaccgtacgtcgttagtaacgttgttaagtttccgaacttaacgttttaataccgtgtaccagtactaacgtaagttagtacgggtagtaccgggttacgggaccggaagggtaccggtaggtaggaataacgtaacgaaaggacgttggtacgcgtacgaccgtaacgtacttacgttccgttacttacgtcttccccgtaccc

SEQ ID NO: 57886 - DNA, 790 bp, Homo sapiens
  misc_feature: GYAE6OF01CZU4I.37.33.C11.1.454.CMB.1.raw
  modified_base (100)..(100): a, c, t, g, unknown or other
  misc_feature (100)..(100): n is a, c, g, or t
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
tcagtagtgtagatcacgaccggtgctcgatttagagtgagctcgttgggtttgggggtcagactcagtcaggacacagcatggacatgagggtccccgntcagctcctgggctcctgctgctctggctcccaggagccaaatgtgacatccagatcgacccagtcctccttccaccctgtctgcatctgtacgganacagagtccaccatcacttcgccgggcagtcggactagttacgtaccgtggttcgcctggtactcaacagaaaccagggaacncccgtaaggtcctagactcgtaatgactcgccctaccgtacgtttaggaacggtccgggtacccaagttaccgtaaggttccaggccggtatacgtacgttaagtccgttgggaactaaggtaactttacctaccgttacttaaccgaaccttaagtacccgtaaggttaaccgtcccgtcggtaaccacggtcccgttaagtaacgtttacgggttaaactttttacggaaccgtttaaaccgtttaacgttttaccgtacgttaaccgtaaccgtaacgttaaacccgtttaagggttaaacggttacggggtaaacgtttaacgggttacccggggaaccgggtaaccggggttaacccgtagggggtttaaaccgaaacggttaaccgtaaccgggtaaaaaaccggttacgttacgggttaaccggtacgtaccggtaaacccgttacccgtaacgtttcccttaacggtttcccttaacctcccggtttccctttaccccccgg

SEQ ID NO: 57887 - DNA, 473 bp, Homo sapiens
  misc_feature: GYAE6OF01B2REN.37.33.C11.1.454.CMB.1.raw
  modified_base (354)..(354): a, c, t, g, unknown or other
  misc_feature (354)..(354): n is a, c, g, or t
  modified_base (427)..(427): a, c, t, g, unknown or other
  misc_feature (427)..(427): n is a, c, g, or t
  modified_base (455)..(473): a, c, t, g, unknown or other
  misc_feature (455)..(473): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtggaggggccgattcaccatctccacagacaacgccaaagaaatcaattctttttgacaaaatgaaacagtctgagagtcgaggacacggccatgtattactgtacgagagaacagacgttggggccagggaccctggtccaccgtctcctcacgccctaccaaccgaacgggccccagtccggtcccttccccccgtggcccgtccctcgcctccgaggacncctacccgtcgagacgccacgacggccggcccgtgggctcgcgtgacaaggtcctactccatcctacactagngacgcgggtctggacgaggcacgatagnnnnnnnnnnnnnnnnnnn

SEQ ID NO: 57888 - DNA, 496 bp, Homo sapiens
  misc_feature: GYAE6OF01BD8UG.37.33.C11.1.454.CMB.1.raw
  modified_base (446)..(446): a, c, t, g, unknown or other
  misc_feature (446)..(446): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (477)..(496): a, c, t, g, unknown or other
  misc_feature (477)..(496): n is a, c, g, or t
tcagtagtgtagatcacgaccggtgctcgatttagagtgagctcgttgggtccgccaggctccagggaaggggctggagtgggtggccaacataaaagcgagatggaagcgagaaatactatgtggactctgtgaggggccgattcaccatctccacagacaacgccaaagaaatcaaattctttttgcaaatgaacagtctgagagtcgaggacacggcatgtattactgtacgagagaacagacgttggggccaaggggaaccctggtccaccgtctcctcacgcctccaaccgaagggccccaagtccggtaccttccccccgtgggccgtcccctgccctaccagggacgccaacccgtcccggaagacgaccacgtacgccggaccctggggacctggccctgggtaccaaaggtacctacttcccatctaaccgactacngaacgcgggctgggcaaggcganaatagnannnnnnnnnnnnnnnnnnnn

SEQ ID NO: 57889 - DNA, 695 bp, Homo sapiens
  misc_feature: GYAE6OF01EEVCE.37.33.C11.1.454.CMB.1.raw
  modified_base (192)..(192): a, c, t, g, unknown or other
  misc_feature (192)..(192): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagcctaagtgtcggactagtaccgaaggacgtacgaacccgtagtcctccttaccnccctgtctcgcactcttggagacgacagatcacatctactcgccggaccagtacggtactagtacgtccgtggtgcctggtactacgaacgaacgaaccgagggaacgtacccttaaggcctgactagtatgcttcggacctcgtaacgttcggaagggtcccggtacagtacgtaacggttcgaggccgacgtaggtctacggttcgacggtagtaaactcgtacacctccgttacacgtactacggtaacgtcgtaccgtacgccgtaggtccctaaggtaagttcgttaaacgtttcgtaacgtttaaactttacgttaccctaagttccgtacgtaactaccggttaacgttagggagggtaacgttacggttcgggaacccgggttacggaacggttggggaaccttaggaaacaccgttaaaccggtagtacggtagtaccgttacacggttacccgaaattcgttacgtttaccctcggttccttcccgtaacccc

SEQ ID NO: 57890 - DNA, 593 bp, Homo sapiens
  misc_feature: GYAE6OF01DP5HX.37.33.C11.1.454.CMB.1.raw
  modified_base (97)..(97): a, c, t, g, unknown or other
  misc_feature (97)..(97): n is a, c, g, or t
  modified_base (132)..(132): a, c, t, g, unknown or other
  misc_feature (132)..(132): n is a, c, g, or t
  modified_base (166)..(166): a, c, t, g, unknown or other
  misc_feature (166)..(166): n is a, c, g, or t
  modified_base (199)..(199): a, c, t, g, unknown or other
  misc_feature (199)..(199): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (407)..(407): a, c, t, g, unknown or other
  misc_feature (407)..(407): n is a, c, g, or t
  modified_base (530)..(530): a, c, t, g, unknown or other
  misc_feature (530)..(530): n is a, c, g, or t
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
tcagtagtgtagatcacgaccggtgctcgatttagagtgagctcgttgggtttggggtcagactcagtcaggacacagcatggacatgaggtccccntcagctctgggctcctgctgctctggctccaggancctaagtgcggactgtcaggctcactgtctctcnctgtctgcatcgtgtacgatacagtagtcactntccgactcggccggtaccaggtcgactagttacgccgtggttcgctaggtctacacagaaccgtaggaacgccctaaggtccgtanacgtcgtacngtactcgcctctaggttacggaacgtccgggtaccagtcggtaacgtcgcggccgtacgagttacgtagacccggtaggaaactcggtaactccgactcttaaccgctacgngtacgctacgtcgctacgtcgtacgtactacgttattccgtataacgttacttcggtactacgtacggtactactagttacggagtaacgtacgggttaccgccgggtagtacggtcggttanaccgtcaacgtaacgtacggtcgtacgactcnccttaancgttctacgtctacgttgtccgtc

SEQ ID NO: 57891 - DNA, 672 bp, Homo sapiens
  misc_feature: GYAE6OF01AM5AS.37.33.C11.1.454.CMB.1.raw
  modified_base (100)..(100): a, c, t, g, unknown or other
  misc_feature (100)..(100): n is a, c, g, or t
  modified_base (145)..(145): a, c, t, g, unknown or other
  misc_feature (145)..(145): n is a, c, g, or t
  modified_base (331)..(331): a, c, t, g, unknown or other
  misc_feature (331)..(331): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaatgnggacagtccagagtcgaccagtctccttccaccctgtctgctatcgtgtaggagacagacgtcaccatccgacttggcccggccaggtcggacttagttacgtaccttgggttcgggtcctggttaacaccgaaacgacgaaaaccgaggggaaacctcccccgttaagggtcctgattactagtnatcgcctaccgtagtttagggaacggtccgggacctagtacgtaaggtcacgggcgctaggtcgtatccggtaggactaagtacttccactcctacacccgattcgaagtaccgctacgcgtaaccgtcgtagtacgtttgttaactttcgtaacttaactttgtaacttcgaatcgtacttacttaaggtacgggtaggtacggtaaccgttccggggaacggtaaccgggcgggtaaggtcggtaagaccgttaaacgaaaccgggtacgttgggaccgttagtcccgaccgttacgtacttccgttacgttacctcgttaccccgtttcgtaaccccg

SEQ ID NO: 57892 - DNA, 643 bp, Homo sapiens
  misc_feature: GYAE6OF01CV5HJ.37.33.C11.1.454.CMB.1.raw
  modified_base (250)..(250): a, c, t, g, unknown or other
  misc_feature (250)..(250): n is a, c, g, or t
tcagtagtgtagatcacgaccggtgctcgatttagagtgagctcgttggggtttgggggtcagactcagtcaggacacagcatggacatgagggtccccgctcagctcctggggctcctgctgctctggctcccaggagccaaatgtgacatccagatcgacccagtcctccttccaccctgtctgcatctggtaggagacagagtcaccatcactgccggcagtcgatatagtacgtggtcgctggtanacaacagaaaccgaggaaacgcccgtaaggtcctagtatactatgactcgccctacctacgtttagggaaacggtccgggtacccagtacgtaaggttcgagcggtctaaggttgtaacgtcgtagggacaggtaacttcactcctcaaccatcgaacgtacgcctagacctacgccgtagtacgttagttaacgtttttacgacttaaacttttactttaccgtgttacctaaggttacctaaagttagtaaacggttggggaacgtaccgttaccggggaccgggtaacggtaccgggtagggttagaacgtaacgaacgtaaaacggtacgtacggttcggactcggactaccgttacgttccgtcttaccctcttccgttccctacccc

SEQ ID NO: 57893 - DNA, 634 bp, Homo sapiens
  misc_feature: GYAE6OF01B3LBJ.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctgtaggagacagagtcaccatcacttggccgggcaggtcggacttattagtacctggttcggcctggtatacaacaagaaaccgagggaaacgccccgtaaggtcctgatctatgatcgcctacgtacgtttagggaacggtccggggtacccagtaccgtaaggttcgacggcggactacggtgtacgtcggtagggaacaaggtaacttccgactcctaccaacctatcgaagtacgccgtgcacgtcctagtattgtattttcgacttaactttacgttactgtacagtactaattaagtaagtagggtacgtacggttaccgggaccggaacggggtaccggtaggggttagaacgtaacgtaaccgaaaacggtacgtcgggtacggtactcggacctactacgttccgttacgttacctacttaccttcccgttaccccg

SEQ ID NO: 57894 - DNA, 662 bp, Homo sapiens
  misc_feature: GYAE6OF01C8OQB.37.33.C11.1.454.CMB.1.raw
  modified_base (142)..(142): a, c, t, g, unknown or other
  misc_feature (142)..(142): n is a, c, g, or t
tcagtagtgtagatcacgaccggtgctcgatttagagtgagctcggttgggtttgggggtcagactcagtcaggacacagcatggacatgacgggtccccgctcagctccgtgggctcctgctgctctggctcccgaggacnccaaatgtagacatccagactcgaccctagtcctcccttccaccctgtctgctatctaggtaggacgacgagacgtccaccatccacgttcggccggccaggtccggacttacgttagtaccgtgggttcggccgtaggtactacgaaacacggaaaccgaagggaaaccgtccccgtaaggtcctagtactctatacgacgtcgtccctacgttacgttaggaaccggtccgggtacctagtacgtaacggttcacggcgtataggtagtagtcggtaggactaacgtactcactcaactacctatacgtacgtaccgtcgtacgcctacgtcgttagtacgttagtttactttacgactttaactttactacgtcgtacacgtactaagtagttaaggcgggtaagtcggtacggaccgggtaggtcggtaggttagacgtaccgaacgaacgttacggtcggtacgccggtacacctacgtacgttcttcttacccgtcttcccgttcccgtacccg

SEQ ID NO: 57895 - DNA, 785 bp, Homo sapiens
  misc_feature: GYAE6OF01CLAT7.37.33.C11.1.454.CMB.1.raw
tcagtagtgtagatcacgaccggtgctcgatttagagtgagctcgttggggtttgggggtcagactcagtcaggacacagcatggacatgacgggtcccccgctcagctccgtggggcctcctgctgctctggctcccgaggacgaccaaagtgtgacatccagatcgaccctagtcctcccttccaccctgtcctgctactctggtaggagacagacgtccacatccgtacgttcggccggcctagtcggtactagttacgtaccgtggttcggtaccgtaggtactacaaacgaacggaaaccgaacggggaaaccgtaccccgtaaggtccctagtacttacgtagtgtactccggtaccctaccgtacggttttaagggaaaccgggtcccggggttaccctaacgttaaccggtaaccggttacgagggtccggtacgtaggttacgtacgtaccggtagggaaactaacggttaacttcccgaacttcccgtacaaccgtattaccgtaaggtaccgtcccgtgacctacggtaccgttagtaagtttcgttaacgtttacgtaaccttaacgtttactttaaccgttacgtaacgtaccgacttaaagttaacgtaaggtaacggggtacgttacggttccggggaaaccggacgggtaaccgggttagggttaagaaacggttaaccgtaaacgaaacggttacggtgggtacggtacctcggtaacctaccttcggtacgtttaccgtttataccttttcccgtcccggttacccc

SEQ ID NO: 57896 - DNA, 697 bp, Homo sapiens
  misc_feature: GYAE6OF01EW3KA.37.33.C11.1.454.CMB.1.raw
  modified_base (289)..(289): a, c, t, g, unknown or other
  misc_feature (289)..(289): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccgagatcgaccctagtcctccttcccgaccctgtctcgctatcgtgtaggacgacagacgtcaccatcacgttcggccggacagtcgactattacgtacgtggtcgctgtatacaacgaacgaaccgagggaaaccncccgttaacggtcctagacttactatagtacgtccgtccgttaccgtaacgtttacggggaacggtacccgggtccctaacgtacggtaacggttcgaacggtcgtaacgtgtatacgtcggtaacggactaacgtcttaccgacttacaccgtacctacgtactaacgtacgtccgtacacgtaacggtccttaggtaaccgttcgtttaagtttacgaaccttaacgttttatacccgttagtacgaacgttacctaagttaacgtttaggaacggttacggttaaccgtaccgggaccgtaaagggtaaccggtaaggttacgaacgtaacgtaaccgttaaaggacgttcgacgacgtcgactccttacgttacttaccgttactcttacccgttccgtacccg

SEQ ID NO: 57897 - DNA, 596 bp, Homo sapiens
  misc_feature: GYAE6OF01BLWZ4.37.33.C11.1.454.CMB.1.raw
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtcctccttccaccctgtctgcatctgtaggagacagagtcaccatcacttggccggcagtcggactatacgtacctggttcgctggtatacaacagaaaccaggaacncccgtaaggtcctgatctangatcgcctctacgtttaggaaacggtccgggtacccagtccgaaaggttcacggcggtacaggttgtagtcgtaggacagtaacttcactctacacatcgagtcgctgcagtctagattagttatttagacttaatttactacgtgtacaacgtactaacgttaataaggtggtacgtacggtccgggacggtaacgggtaccgtagggtacaaggtaacgtaaaccaaacggttacgtggtacggacttacggaccctaacgtctttacgttcttacccttactcccgttcccgttaccccg

SEQ ID NO: 57898 - DNA, 742 bp, Homo sapiens
  misc_feature: GYAE6OF01C20Z7.37.33.C11.1.454.CMB.1.raw
tcagtagtgtagatcacgaccggtgctcgatttagagtgagctcgttggggtttgggggtcagactcagtcaggacacagcatggacatgacgggtccccgctcagctccgtggggctcctgctgctctggcctcccgaggacgaccaaatggtgacatccagatcgacccagtcctccttccaccctgtctgccatctgtagagacagagtcaccatcctacttcggccggacctagtcggactagttgttaccgtggttcgcgtaggtacacaacgaacgaaaccgaagggaaccgaccccgtaaggtccctaggtacttacgtagttacggacttccggtccctaccgttacggttttaacgggaaacggtccggggttacccaagttaccggaaacgggttccgaggaccggtacttacgggttagttacgtcggtaacgggtaactaagtaacctttccaccttacgtacccaaccttacgtaccgtacgtaccgtccgtacgtccgtacgtacccgttagtacgtttagttacgttttacgaacgttttaacctttaacgttaccgtacgttacgtaacgtacctaaagtttaacgtaaggtttaacggggtaacgttaccggttccgggaacccgggttagggtaaccggtacgggtaagtaacgtaacgtaaacgaacggtacgttgacggtacgtcgactacgacttcttacgtctttacctcttcccgtacc

SEQ ID NO: 57899 - DNA, 813 bp, Homo sapiens
  misc_feature: GYAE6OF01CW6IO.37.33.C11.1.454.CMB.1.raw
  modified_base (100)..(100): a, c, t, g, unknown or other
  misc_feature (100)..(100): n is a, c, g, or t
  modified_base (209)..(209): a, c, t, g, unknown or other
  misc_feature (209)..(209): n is a, c, g, or t
tcagtagtgtagatcacgaccggtgctcgatttagagtgagctcgttgggtttgggggtcagactcagtcaggacacagcatggacatgagggtccccgntcagctccgtgggcctcctgctgctctggctcccgaggacgaccaaatgtagacactccagtactcgaccctagtcctccttccaccctgtctgctatcgtagtagganacgagacgtcacctatccgtacgttcggcccgggcctaggtaccggtacttaacgttacggtaccgttgggtttcggtaccgttaggttaactaaccgaaaacggtaaaccggaaaaccggtaacggggtaaaccgtaccccgttaaaggtcctagtaacttacgtagtacgtacgttccgtacccttaccgttaacggtttaagggaaccggtcccgggttaccctaagtaccggtaaacgggttccgaaggtccgggtacgtaaggttacgttacgtacgggtacgggaactaacggtaacttcccgtaacgttccctaaccgtaacgtaacgttaccggagttaaccgtccgtacgtaccgtacgtccgttaggttaagtttacgttacgtttacgtaacctttaacgtttacgtaccgtagtacgtaactacttaaacgttaggtaacggtagggttacgtacgggtaccgggaccgggtaacggtaccggttagggtaagaacgtaacgtaaccgtaaggtacggttcgggaacgtcgtacgtaaccccgtattacccgttacttacccgttactaccgttccgttaccccgttacccg

SEQ ID NO: 57900 - DNA, 711 bp, Homo sapiens
  misc_feature: GYAE6OF01B4AVJ.37.33.C11.1.454.CMB.1.raw
tcagtagtgtagatcacgaccggtgctcgatttagagtgagctcgttgggtttgggggtcagactcagtcaggacacagcatggacatgagggtccccgctcagctccgtggggctcctgctgctctggctcccaggagccaaatgtgacatccagatcgacccagtcctccttccaccctgtctgcatctgtaggagacagagtccaccatcacgttcggcccgggccaggtcggacttagttacggtaccgttgggttcggccttaggtactaccgaaacgaacggaaaacccgaggggaaaccgtaccccgtaaggtccctagtactctaagtgactcgccctacgtacgtttaggaacggtccgggtaccagtacgtaacggttcaggccggacgtagtagtacgtcggtagggacaagtaacttccgacctactacaacctatacgagtaccgcctacggacctacgtcttagtacttacggttacgtttacgaactttaacgtttaacttacgtcgtacgtacgtaccgttaataaggttaacggtacgggtaacgttaccgggttaccgggaccgggtaacggggttaccgtaaggggttacgaacggtacgtaaaccggaaaaccgttcggtcggtacggtaccgtcgaccgttaacctcgtttcgttaccgttactttcccgtaccgtttccccgtaccccg

SEQ ID NO: 57901 - DNA, 827 bp, Homo sapiens
  misc_feature: GYAE6OF01AQ1J7.37.33.C11.1.454.CMB.1.raw
tcagtagtgtagatcacgaccggtgctcgatttagagtgagctcgttgggtttgggggtcagactcagtcaggacacagcatggacatgagggtccccgctcagctccgtggggctcctgctgctctggctcccaggacgccaaatgtgacatccagatcgacccagtcctccttccaccctgtctgcatcgtgtaggagacagacgtccacctatcctacgttcggcccgggacctaggtccggtacttaagttacggtaccgttgggttcggtccctgggttactaccgaaacacggtaaaacccgaggggaaaccgtcccccgtaaggtcctgacttctagtcgactcgtcctaccgtacgtttacgggaaacggtccggggtacccaagtaccgtaagggttccgacggtccggaccgtaggttacgttaacgtccggtaacgggaacgtaacggtaactttaccctaccttaccgtacccgtaacctacgttaccgtaacggtaccgtcccttacggacccgtaacggtccctaggtaacgtttacgtttacgttttacggacctttaaacgttttacgttaccgttacggttaccgtaacgtaccttaacgttaagttaacgggtacggggtaaacgttacgggttacccgggaccgggtaacggtacccggggttaagggttaaccgaacggtaaccgtaaaccggaaaaccgttacgggtacggttaccgggtacctaccgggaccccttaacccgttaacgtttcccggtttacgttaccccgttaccgttaacccgtttccccgttacccccccggg

SEQ ID NO: 57902 - DNA, 743 bp, Homo sapiens
  misc_feature: GYAE6OF01DI3WR.37.33.C11.1.454.CMB.1.raw
  modified_base (99)..(99): a, c, t, g, unknown or other
  misc_feature (99)..(99): n is a, c, g, or t
  modified_base (140)..(140): a, c, t, g, unknown or other
  misc_feature (140)..(140): n is a, c, g, or t
tcagtagtgtagatcacgaccggtgctcgatttagagtgagctcgttgggtttgggggtcagactcagtcaggacacagcatggacatgagggtccccntcagctccgtgggctcctgctgctctggcctcccgaggacncctaaagtcgtcgactagtccaggactcgacctagtcctccttccacctgtctagcatcgtggtaggacacagagtccaacctatccgacgttcggcccggactagtccggtaattagtacgtaccgttggttacgccgtaggtactacaacgaacggaaaaccgaggggtaaacctacccccgttaaggttaccctaggtactacgttatacgtacgtctacccgtctacgtttaacggaacggtccggtccaagtacgtaacggttcgaggtccgctaaggtcgttacgtacggtacgaacgtacgtaattccacgttcacgtacacgttacaagtaccgtctcggacctcgaccgttagtaacgttcgttaattcgtaaccttaacgtttacgtactcgtaacgtacgtacctagtaagtacggtacggtaacgttacgttaccggacgggtacggtaacggttacgggtttacgaacgtttaaccgaaaccggtaaaacggttcggttaacggtcggtaaccctacgggtaacccttaccggttcgtttaacctacccgggtttacctttaccgaacccgtttcccccgttaaacccgg

SEQ ID NO: 57903 - DNA, 448 bp, Homo sapiens
  misc_feature: GYAE6OF01A74VG.37.33.C11.1.454.CMB.1.raw
  modified_base (325)..(325): a, c, t, g, unknown or other
  misc_feature (325)..(325): n is a, c, g, or t
  modified_base (420)..(421): a, c, t, g, unknown or other
  misc_feature (420)..(421): n is a, c, g, or t
  modified_base (424)..(448): a, c, t, g, unknown or other
  misc_feature (424)..(448): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagccctccaccaaggcccatccggtctccccctggcgccctgctcaggnccacctccgagacgcacacgccggccctggggctgccctggtccaaggcctactccatctacactactgagcgggctggcgaacggcgacatagnnctnnnnnnnnnnnnnnnnnnnnnnnnn

SEQ ID NO: 57904 - DNA, 790 bp, Homo sapiens
  misc_feature: GYAE6OF01ECQDY.37.33.C11.1.454.CMB.1.raw
  modified_base (103)..(103): a, c, t, g, unknown or other
  misc_feature (103)..(103): n is a, c, g, or t
  modified_base (669)..(669): a, c, t, g, unknown or other
  misc_feature (669)..(669): n is a, c, g, or t
  modified_base (747)..(747): a, c, t, g, unknown or other
  misc_feature (747)..(747): n is a, c, g, or t
tcagtagtgtagatcacgaccggtgctcgatttagagtgagctcgttgggtttgggggtcagactcagtcaggacacagcatggacatggacgggtcccccgntcagctccgtggggcctcctgctgctcgtggcctacccgaggacgaccaaagtggcggactagaccgaggactcgaaccctagtcctaccttccacctgtctcgacctacttcgtaggtaaggagaaccgaggaaccgttaccaacccgtattaccgtaccgttcgggcccccgggactaagggtaccggtaacctttagttaacccggttccggttggtacggtcccgttaggtaaccctaacgaaaacgtaaaccggaaaaccggtaaagggggtaaacccctacccggtaacggttactaccggtaattacgttaagtccgaagtcccgtacctaaccgtacgtttaacgggaacggttccgggaccaagtcgtaaacggtcgaaggccgacgtagtacgtagttccggaaaggccttaaacgacttacgtactacctacggactaagacgtaagtccggactcgacgtttacgaacgttagtatacgggtttattaccgaactttaaaggttctttaaccgacgtttaacaaggttaacccggactttaaaagtaacggggngggtactttaccggggaccgtacgggaacggtaaccggttagacgttaagacgtacggaaacgtcggtaggactaccncggaactcgtcgttacgtacttaacgtctacccgtccgtaaac

SEQ ID NO: 57905 - DNA, 643 bp, Homo sapiens
  misc_feature: GYAE6OF01EO8QR.37.33.C11.1.454.CMB.1.raw
  modified_base (598)..(598): a, c, t, g, unknown or other
  misc_feature (598)..(598): n is a, c, g, or t
  modified_base (613)..(613): a, c, t, g, unknown or other
  misc_feature (613)..(613): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccagggagccaaatgtgacagtccagatcgacccagtctccttccaccctgtctgcatctgtaggagacagagtccacatcacttcgccggccagtcggactagttacgtaccgtggttgcctaggtactacaacaacgaaaccgaagggaaaccgccccgtaaggtcctagtacttctatgatcgccttaccgtacgtttacggaacggtccgggtacccagtacgtaacggttcacggcggacagttgtaactcggtaggacagtactctaccgtctacactatacgtagtacgccttagacgtacgtcgtagtacgttagttacttttacggaactttaacgtttactttacgtaggtttaccaagtacccgtaattaacgtaggttacgggtaacgttacggtaccgggtaccggtacgggtacgtacgggttagacgtaacgtaacgaaacgtagtcggtanacgttgacctacgtntaccgttcgtacttcgtcttcccggtaccc

SEQ ID NO: 57906 - DNA, 672 bp, Homo sapiens
  misc_feature: GYAE6OF01EFKMY.37.33.C11.1.454.CMB.1.raw
  modified_base (100)..(100): a, c, t, g, unknown or other
  misc_feature (100)..(100): n is a, c, g, or t
  modified_base (346)..(346): a, c, t, g, unknown or other
  misc_feature (346)..(346): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaaatgtgacatccagatcgacccagtctccttccacctgtctgcatctgtaggagacagacgtcaccatcacttcgccggccagtcgacttatacgtactggtgctggtatacaacagaaaccgaggaaacgcccctaaggtcctagactctatgatcgtcctcctacgtttaggaacggtcgggtaccagtacaaggttcagcgnagtgtatcgtagactagtactcactctacacctatactagtacnccttcgacncgtccgtgtacttagttactttacgacctttaactttatttaccgtcgttaccacgttacgttaaccttaagttaacggtacggggtaacgtacgggttaacccgggtaccgggaacggggttaccggttaacggggttacgtaaaccggttaaacgtaaacccggtaaaaccggtaacggtttacggttaacggtacccggttcgaaccctaaccttacggtttacccgttaccgttaccgtttaccttacccgttccccgtttaaaccccg

SEQ ID NO: 57907 - DNA, 438 bp, Homo sapiens
  misc_feature: GYAE6OF01DQ536.37.33.C11.1.454.CMB.1.raw
  modified_base (424)..(424): a, c, t, g, unknown or other
  misc_feature (424)..(424): n is a, c, g, or t
  modified_base (429)..(438): a, c, t, g, unknown or other
  misc_feature (429)..(438): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggccccatccggtccttcccccgtggccgccctgcctccgaggagccacctcgagagcacacgcgcccgtgggctcgcctggtcaacggactacttccatcctacactactgagccggctggcaaggcanatagnnnnnnnnnn

SEQ ID NO: 57908 - DNA, 510 bp, Homo sapiens
  misc_feature: GYAE6OF01BUC44.37.33.C11.1.454.CMB.1.raw
  modified_base (369)..(369): a, c, t, g, unknown or other
  misc_feature (369)..(369): n is a, c, g, or t
  modified_base (478)..(478): a, c, t, g, unknown or other
  misc_feature (478)..(478): n is a, c, g, or t
  modified_base (484)..(510): a, c, t, g, unknown or other
  misc_feature (484)..(510): n is a, c, g, or t
tcagtagtgtagatcacgaccggtgctcgatttagagtgagctcgttgggtttggggggaagaggaagactgacggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacgttggggaccagggaaccctggtccaccgtctcctcacgcctccaaccaacgggccctagtccggtccttcccccgtgggccgcccctgcctccaggacnccacctccgagacgcacacggccggcccgtgggcctggcccgttaggtccgaaagggtccttaaccttccagttacctaacacttacgtcgaggcgggctggacaggcnctatgnnnnnnnnnnnnnnnnnnnnnnnnnnn

SEQ ID NO: 57909 - DNA, 699 bp, Homo sapiens
  misc_feature: GYAE6OF01CXMV6.37.33.C11.1.454.CMB.1.raw
  modified_base (100)..(100): a, c, t, g, unknown or other
  misc_feature (100)..(100): n is a, c, g, or t
  modified_base (219)..(219): a, c, t, g, unknown or other
  misc_feature (219)..(219): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaaatgtgacatccagatgacccagtcctccttccaccctgtctgcatctgttagagacagatcacatcgcttggccggngagtcaggacatccgataattttgagtccgtggtaactcagacagacgaccgaggactaacgttccactaacttcttagactctatagtatcgactattctactagtttagggacgtccggtaacggggtctacgtacgttccgttacggttaccgaggttcgggacgtacgggacggtaacgtccggttacggggtacccttcctttacgacctttccgactaacctacgttaccaaccgtaccgtcctaccgacgtaccgtagaaacgtcgttagttacgaaccttaacgtttactttaacgtacgttaacgtaaacgtacttacgtacgtacggtaaccgttcggttacccggttacgggtaaccggttacccgggaacccggttaaagggaacccggttaaacggggtaaaccggttaaaaccggtacggtaaacgggtaaaccgttaaccggttgggtaccgtaccggtacccgg

SEQ ID NO: 57910 - DNA, 724 bp, Homo sapiens
  misc_feature: GYAE6OF01DCZS8.37.33.C11.1.454.CMB.1.raw
  modified_base (194)..(194): a, c, t, g, unknown or other
  misc_feature (194)..(194): n is a, c, g, or t
  modified_base (675)..(675): a, c, t, g, unknown or other
  misc_feature (675)..(675): n is a, c, g, or t
tcagtagtgtagatcacgaccggtgctcgatttagagtgagctcgttgggtttgggggtcagactcagtcaggacacagcatggacatggacgggtcccccgctcagctccgtggggctcctgctgctctggctcccaggagcaagtgtgactagccagagtcgacctagtcctccttccacctgtctgcactntaggtaggagacgagactacaccatctacgtcgggcccggctagtcggtacttagttacgtaccgttggtcggcctagtactaccgaaacaacgtaaaccggaacggggtaacaccccgttaaggtcctagtacttatagtgtactccgacctaccgttaaggttagggaaccggtccgggtaccagtaccggtaaggtcgacggcgtacgtagtagtacgtcggaacggacttacgtaactttccaaccttcctaaccgaccttagaccgtaacggtctccgagaccgtacgtctaggttaacttgttactttacgacctttaagttattacgttacgtactaacggttacctaacgtaagttaacgggtaacggtacgggttacccgggttaacggggaacccggggtaacgggttaaccgggttaaggggttacgaagtaaaccgggtaaaccgtaaacggtacgtggtaccggtacnccggacccttaggtcttccggttcttaccttcctaccgttccctacccg

SEQ ID NO: 57911 - DNA, 774 bp, Homo sapiens
  misc_feature: GYAE6OF01BTFC7.37.33.C11.1.454.CMB.1.raw
  modified_base (730)..(730): a, c, t, g, unknown or other
  misc_feature (730)..(730): n is a, c, g, or t
  modified_base (735)..(735): a, c, t, g, unknown or other
  misc_feature (735)..(735): n is a, c, g, or t
  modified_base (737)..(738): a, c, t, g, unknown or other
  misc_feature (737)..(738): n is a, c, g, or t
  modified_base (740)..(740): a, c, t, g, unknown or other
  misc_feature (740)..(740): n is a, c, g, or t
  modified_base (742)..(742): a, c, t, g, unknown or other
  misc_feature (742)..(742): n is a, c, g, or t
  modified_base (748)..(749): a, c, t, g, unknown or other
  misc_feature (748)..(749): n is a, c, g, or t
  modified_base (751)..(751): a, c, t, g, unknown or other
  misc_feature (751)..(751): n is a, c, g, or t
  modified_base (753)..(755): a, c, t, g, unknown or other
  misc_feature (753)..(755): n is a, c, g, or t
  modified_base (757)..(758): a, c, t, g, unknown or other
  misc_feature (757)..(758): n is a, c, g, or t
  modified_base (760)..(766): a, c, t, g, unknown or other
  misc_feature (760)..(766): n is a, c, g, or t
  modified_base (768)..(774): a, c, t, g, unknown or other
  misc_feature (768)..(774): n is a, c, g, or t
tcagtagtgtagatcacgaccggtgctcgatttagagtgagctcgttgggtttggggggaagaggaagactgacggtccgccaggctccgagggaaggggctggagtgggtggccaaacataaagcgagatggaagcgaagaaatactatggtggactctgtggaggggccgtattccacatcctccacagacaacgaccaaagaaatctaagttctttttgactaaatgaacagtctagagagtcggaggacgacggcagtgttatacgtgtaacggaagaagaacgaggtacggttacggggaccggaacgggtaacccgtggtaccgaccgttcctccctcgacgccctacccgaaccgaaccgggccctaccgttcccggttccccgtttcccccggtcgggccccgtccccgtacgtcccgtacccggtaacggacccggaccgtacccccggttaccggaaacggggaccgtaacccgaaccgggtaaccgggcccccgggtcccccgggtccgggggtcccgttcccgggtacccgggtttaccggggttaaacccggaaaaccccggggtttaaccctttaaccccgtttaccccgtaaccgttttaacccgtaaaccccgttaacccgtttacccgggtaacgggtaacccggggtaccgggggtacccggttacgggaacccgggtaaaccggggcccggttaacgaacgttaacgcggngacgngnngngngtagcnncngnnncnncnnnnnnngnnnnnnn

SEQ ID NO: 57912 - DNA, 755 bp, Homo sapiens
  misc_feature: GYAE6OF01EU40P.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtccttccttccaccctgtctgcatctgtaggagacagatcaccatcacttgcccgggcagtcgactattcgtactggttgctggtatacaacagaaccaggaacaccctaaggtcctgatctatgatcgcctcctacttaggaacgtccggggtccatcgtaacggtcacggcggcagtgtacgtcgtagggaactaaggtaacttctaaccgttcctacctaacccgtagttacctaggtaaccgtcccgtaggtccgtaacggtacccttaggtaacgtttcggttacgtttttaaccgtaactttaaaccttttaacgttttaacccgttagggtttacctaacgtaacccgtaagtttaaagttaaacggggtttacggggtaaacggtaccggttttacccgggggaccggggttaaaccggggtaacccggttaaagggggtttacgggaaaggttaaaccgttaaaccgggtaaaaacggtaccggtttgggtaccccggtaacggttacccggaacgttaaccccgtacgtttaccccgtttaggtttacccttttacccttccgttaccccgtttacccccg

SEQ ID NO: 57913 - DNA, 672 bp, Homo sapiens
  misc_feature: GYAE6OF01DG1B5.37.33.C11.1.454.CMB.1.raw
  modified_base (657)..(657): a, c, t, g, unknown or other
  misc_feature (657)..(657): n is a, c, g, or t
  modified_base (660)..(672): a, c, t, g, unknown or other
  misc_feature (660)..(672): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccgagggaaggggctgggagtgggtggccaacataaagcgagatggaagcgagaaatactatgtggactctgtggaggggccgattcaccatctccacagacaacgcaagaaatcaattcttttgacaaatgaacagtctagagagtacgacggaccgacggactagtagttattacgtaggtaacgaagaacgaacgtaggtacggttacggggaccgaacgggtaacccgtcggtaccctaccgtcctcctacgaccgtccctaccgaaccggaaccgggccctaccgttcccggtttccccgttccccggtcggtcccgtccccgtcgtacccgtaccggaacgggaccgcccgtacccgtaccggaacgaccggaccgaaccggaccgggcccggtcccggtcgggtccgtccggtccgtacgggtaaccgaaccggttaccttaccttactaccttacctaccgtaaccgttacgcgggaccgggtccggtacggtacgggacgaacggccacgacgtagngcnnnnnnnnnnnnn

SEQ ID NO: 57914 - DNA, 734 bp, Homo sapiens
  misc_feature: GYAE6OF01AZDHN.37.33.C11.1.454.CMB.1.raw
tcagtagtgtagatcacgaccggtgctcgatttagagtgagctcgttgggtttgggggtcagactcagtcaggacacagcatggacatgagggtccccgctcagctccgtggggctcctgctgctctggctcccaggagccaaatgtgacatccaagactcgaccctagtctccttccacctgtctgcatctgtaggagacagacgtcaccatcacgttcgccgggccaggtcgattagttacgtaccgtggttcggccttggtaactacaaacgaacgaaaaccgtaacggggaaaccgtaccccggtaacggttcctagtaacgttctaagtcgactcggcccttaccgtacgtttacgggaaacggtccggggtaccaacgttacgaacggttcgacggtcggtactaggttagtacgtcggtagggaacaagtaacttccaccgtccgttaccaaccgtagtaccgtaacggtaccgtcctacggtaccgtacgtccgttagtaagttcgtttaacgttttcgaaacctttaaaccgtttaacgttacccgttggttaccgtaacgtacgtaaacgttaagttaacggtagggtaacggttcgtaccgggaccggtaacggggtaccggtagggttaacgaacgtaacgtaaacgtaaaccgtagttcgggtgtacgtacacccgtactacgttcgttacgtactttcccgtacgtttccccgtaacccg

SEQ ID NO: 57915 - DNA, 715 bp, Homo sapiens
  misc_feature: GYAE6OF01AHG10.37.33.C11.1.454.CMB.1.raw
  modified_base (195)..(195): a, c, t, g, unknown or other
  misc_feature (195)..(195): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtagganacagacgtcaccatcacttggccggccagtcggactagttagtaccttggttggcctggtataccgaacgaacgaaaccgagggaacgtaccccgtaaggtcctgactcgtatagagtcgcctccgtaacgtttaggaacggtccgggtcccagttacgtaaggttacgacggtcggacgaagttgttaactcggtacgggaactaacgtaacgtttccaaccttccgtacctaacctagtaccgtaacgtaacgtccgtcgtaccgaacgtccgtacgtaagttacgttaagttttacgaccgtttaactttacgttaaccgttagtacctaagaacctaacgttaaagttaacggtaacgggtaacggtaccgtttaccgggaaccggtaacggggtaaccggttagggttaacggaacgtaacgtaaacccgtaaaacggtaaccgttaggtaccggtacgtacggtaccctaacctacgttacttacggttaccttacgtcgttcccgttaccccg

SEQ ID NO: 57916 - DNA, 751 bp, Homo sapiens
  misc_feature: GYAE6OF01CT4VZ.37.33.C11.1.454.CMB.1.raw
tcagtagtgtagatcacgaccggtgctcgatttagagtgagctcgttggggtttgggggtcagactcagtcaggacacagcatggacatggacgggtcccccgctcagctccgtgggggctcctgctgctctggcctcccgaggacgaccaaatgtgacatccagatcgaccagtcctcccttccaccctgtcctgcatctaggtaggacacagatacaccatcacgtcggccggacagtacgactagtacgtacgtggttcggcctaggtactacgaacaacgaaaccgaagggaaccgtacccgtaacggtcctagtactactagtacgtagtccgtcctaccgtacggtttaagggaacgggttcccgggtaaccctaagtaccgtaacgggttaccgaggtaccggtataacgggttacgttacgtacggttaacggggaacaacggtttaactacccgttacctaccgttaaccaaccgtactaccggtacgtacgtcccgcgtactaccgtctagttacttaacggttatttactacctttaaacttacgttaacgtacttacgaactacttaacgtaagtacggtagggacgttaccgggtaccgggtaccggtaacggggtaccgttaggtacgggaaataaccgaaaccgtaaacggttacggtggtacccggtactaaccggaccttaaccggtacttacccttaccgtttaccttaaccctcccgttccccggttacccg

SEQ ID NO: 57917 - DNA, 748 bp, Homo sapiens
  misc_feature: GYAE6OF01DHTVD.37.33.C11.1.454.CMB.1.raw
  modified_base (203)..(203): a, c, t, g, unknown or other
  misc_feature (203)..(203): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccgaggacgccaaagtgtgacatccaggatcgaccagtcctcctcccacctgtctgctatcgtagtaggganacagacgtcaccatacctacgttcggcccggactacggtacggtacttaagttacgttaccgttgggttcgaccgttggtaactacgaaacaaggaaaaccgacgggtaaacgtcccccgttaaaggtcctagtacttcgtatcggtaactccggtacctaccgtaaggtttacggaaacggccgggttacagtacgtaagggtccaggtccgacgtagtcgttaacgtcggtaaggactaaggtaactttcgactacccgttacaaccgtcttacgaaacgtcgtaccgtagaccgtacgtaccgtagtacgtttagttacctttagaacctttaacgttaacgttaccgttagtaactaacgtaccctaaaggttacgttaggaaccggtaggtccggtaacgggaccggtagggtaccgttagggaacgtcgtaaaagtaacccgtaaagggtaaccgttcggtacggtacccgtacggtaccctaaagttccggtacctttacggttaccccgttacttacccgttccccggtttaacccg

SEQ ID NO: 57918 - DNA, 482 bp, Homo sapiens
  misc_feature: GYAE6OF01EPIEE.37.33.C11.1.454.CMB.1.raw
  modified_base (194)..(194): a, c, t, g, unknown or other
  misc_feature (194)..(194): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (475)..(475): a, c, t, g, unknown or other
  misc_feature (475)..(475): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggngacagagtcaccatcacttgccgggccagtcggactattagtacctgttggcctggtatcaacagaaaaccaggaaagcccctaaggtcctgatctatgangctccactttggaaancgggtccatcaaggttcagcggcagtgtatctgggacagaattcactctcaccatcagtagcctagcagcctgatgatttgcaattagtactgtcagcatanaatggganttcgcgaggacagggtnagancaaagactgtggctggcaccagtctgtcttcanttacccg

SEQ ID NO: 57919 - DNA, 863 bp, Homo sapiens
  misc_feature: GYAE6OF01BQMPA.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccagtggaagttgggctgagtcgttgggttttccttgttgtcttagttttgggaaggttcgtccgaggttgtaggtaagtgcgaggtcgtgggtacggaccgttcgggtagggggacgtccgtggtacccgacgggtcccgggttacggggggtcccctggacgtaccgttccgtccgtgtccgacctaaccgttcgtaggtacttcgtaggtttgtaagtggtagtttggttacgggtaggttcgggggtttccgggtcccggaccggtacgggtaccgttaccggggaagggggtaacggggtccgttaggggtacgggttacggggtacggaacccgtaaagtaaacggtaaacggccggtaaaggtacggtacgggaaaacgtacggtaaaagtaaacgttacgtaaggtacggttacggtaccggttcggtagggtacggggtacccgggtaaccgtaactttcccgtaaaccgtacgttaccccgtaacccgaacgaaccggtaaaacccgaaccggtaaaccgtaaaggtaaacctttacgtaaacttttttccggtttaacgaactttaacgtaacggaacttgtaccgtaggacgtacgtacggaacgtacggtaccgtcttaagtcgttaacgttagtaaaccggtcggaaacgtaacggaacggttacggtaccgggtaccgggtaaccggaacggtacccgttgacccgtcccggttacg

SEQ ID NO: 57920 - DNA, 781 bp, Homo sapiens
  misc_feature: GYAE6OF01BUQ67.37.33.C11.1.454.CMB.1.raw
  modified_base (749)..(749): a, c, t, g, unknown or other
  misc_feature (749)..(749): n is a, c, g, or t
  modified_base (760)..(760): a, c, t, g, unknown or other
  misc_feature (760)..(760): n is a, c, g, or t
tcagtagtgtagatcacgaccggtgctcgatttagagtgagctcgttgggtttggggtcagactcagtcaggacacagcatggacatggacgggtcccccgctcagctccgtggggctcctgctgctcgtggcctcccgaggacgccaaatgtgacatccagatcgacccagttcctcccttccacccgttgtctcgcattctaggtaggaagacagacgtaccaccatcacgttcggcccggcctaaggtcggtaacttagttacgtaccgttggttcggtccgttaggtactaccaaacgtaacggaaacccggaaggaaaccgtacccccgtaggttaccctggaacttcgtagtacgacttcggtaccctaccggttaagtttaacggggaaaccggtcccggggttaccctaaagtttacccggtaaacggttcgagggtacccggggattaacggttgggtacgtaccggtaagggactaacgttacttcccacttacccgtaacacccgtataccggtacgtacgtccgtacgacgtaccgtacggttagtaatttacgttaacgttttacgaacttttaaccgtttaacttacgttaccgtaacgtactacgtaactttaagttaacggtagggtaccgttacgggacccgggtaaggtacccgggtaagggtaggtacgtaacgaaacgtaaccggaaagtcccggtagtccgggctagaccccgttaatcgtttaccgngttttaccccngttccccgttccgttaacccc

SEQ ID NO: 57921 - DNA, 512 bp, Homo sapiens
  misc_feature: GYAE6OF01BBBXG.37.33.C11.1.454.CMB.1.raw
  modified_base (342)..(342): a, c, t, g, unknown or other
  misc_feature (342)..(342): n is a, c, g, or t
  modified_base (501)..(501): a, c, t, g, unknown or other
  misc_feature (501)..(501): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggccctggtatcaacagaaaccaggggaaagccccctaaggtccctgatctatgatgcctccactttggaaagcggggtcccatcaaggttcagcggnagtgtatcgtgggacagaattcactctcaccatcagtgcctgcagcctgatgtattttgctaacttattactgtcagcactataatgggagtagttcggccgagggaccgagggttgagatacgaaacgaacgtgtggctgacgaccatctgtcttctntccgttacccg

SEQ ID NO: 57922 - DNA, 796 bp, Homo sapiens
  misc_feature: GYAE6OF01C9E30.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctccgtgggctgctaatgctcgtggtctctggatgcgaggtgggatagttgtgatgcatcacgtccccactcctcccgtcgcccgtccaccccgtggacgaccggcccgtccctaccacttccctccgtcgaccgtacggttcctacgtaccgaggtaccgtcccttccgtagactaaggtaaggtaaacgtcggaaacctaacttaaacgttttggttaagggttaagtttacgggttaacttcgtaggaaccgtaaaacggaaccggaccggaacggggtacctaacggttaccctaccctaaactaacccgttacgttacgtaacgtttaccggtttaacggttttccgggttaaccttaaccggggttccccggggttccccggtttaccccggggggtaccctacgggtaaccggtttacggtttaccggacggggttcgggtaccgttagggtacgggtactaccgggaacggtacgtaacgtaacgttacgtttaccaacgtaacgtaacgtaacgtacgtacaggtacgaggacggtggacgtcgtaggtaggtagtttggttaggttatcgtagtacgtagacgtacgtacgtacgtaacgtaccgtccgtacgacgttaccgaccggttagacccggaaggtacctacgtacggtaacgtaagtaaccgtaaggtcgtcggg

SEQ ID NO: 57923 - DNA, 750 bp, Homo sapiens
  misc_feature: GYAE6OF01E4LRX.37.33.C11.1.454.CMB.1.raw
  modified_base (179)..(179): a, c, t, g, unknown or other
  misc_feature (179)..(179): n is a, c, g, or t
tcagtagtgtagatcacgaccggtgctcgatttagagtgagctcgttgggtttgggggtcagactcagtcaggacacagcatggacatgaggtccccgctcagctcctggggctcctgctgctctggctcccaggagccaaatgtgacatccagatgaccagtctccttccacctgtcngcatctgtaggagacagagtcaccatcacttggccggccagtcggactattagtaccgtggttcggccttggactcaaacgagaaaccgagggaaacgccccgtaaaggtcctagactctatgagtcgtcctacctacgtttacgggaaacgtccggggtacccagtacgtaaacggtttcacggtcggacgtacgtagttacgtcgttaggggaacctaaggtaactttacgacctaccgtaccaaccgtacgtaccgtaaggttaaccgtcccttacggaccgtacggtaccccgttaggtaaacgttacggtttaacgttttacggtaccctttaaacttttaacgtttaccgttacggtaccgtaacgtacctaacgttaacgtaacggtaacggggtaacgttaaccggggttaccgggaaccgggtaacggggtaaccggtaaggggtttaccgaaaggtacctaaaccggtaaaaccgtacgttacggttccgggaacttcggaccgttaacccgtacgttcctttacggttactttcccgtaccgtttaccccgttaccccgg

SEQ ID NO: 57924 - DNA, 608 bp, Homo sapiens
  misc_feature: GYAE6OF01DSNJO.37.33.C11.1.454.CMB.1.raw
  modified_base (194)..(194): a, c, t, g, unknown or other
  misc_feature (194)..(194): n is a, c, g, or t
  modified_base (290)..(290): a, c, t, g, unknown or other
  misc_feature (290)..(290): n is a, c, g, or t
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacatccagatgacccagtctccttccaccctgtctgcatctgtagganacagacgtcacctatccacttcgccggcagtcgacttattgtacctggttcgcctggtactacaacaagaaaccagggaacaccccgtaaggtccngtatctatgatcgtcctccgtacgtttggaacgtccgggtaccatacgtaaggttcgagcggtactagtcgtagtcgtagggaactaaggtaacttacactctacaacctagtcacgtacgtcctagcctagtacctagtacgttagttactttcgacttaactttatactgtacagtactactagtagtggagtacgttcgggaccggtaaggtacggtaggttagagtacgtaacgaaacggtacgtagtgtaccgtcggaaccctacgttacgttaccttcggtttaaccctttcgccgtttcccgttaaccccg

SEQ ID NO: 57925 - DNA, 604 bp, Homo sapiens
  misc_feature: GYAE6OF01BLN2T.37.33.C11.1.454.CMB.1.raw
tcagtagtgtagatcacgaccggtgctcgatttagagtgagctcggttgggtttgggggtcagactcagtcaggacacagcatggacatgagggtccccgctcagctcctggggctcctgctgctctggctcccaggagccaaatgtgacatccagactgacccagtcctccttccaccctgtctcgcatctgtagagacagagtcacatcactgccggcagtcggactattagtacctggtgctggtatcaacagaaaccgaggaacgccctaaggtcctagaatcgtatgactcgtccctccgtacgtttagggaacggtccgggtacccagttacgtaacggttcaggccggtacgtaggttagtacgtcggtacggactaaggtaatcgactctacgactagtctagtacgcctgcagcctgatgtatttgaccttacgtttatactcgtacacgtactaattataaggtacgggtaactacgttaccgggaccggtaacgggtaccggtaaggggttacgacggtaactaccggaaaacgtcggtcgggttagacggttcgactaccagttcgtcttacttcgacgttccccgtacccg

SEQ ID NO: 57926 - DNA, 660 bp, Homo sapiens
  misc_feature: GYAE6OF01AWGIL.37.33.C11.1.454.CMB.1.raw
  modified_base (276)..(276): a, c, t, g, unknown or other
  misc_feature (276)..(276): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgaccagtctccttccacctgtctgcatctgtaggagacagatcaccatcacttgccggccagtcggacttatacgtacctggttcggccttggtatcaacacgaaaccaggggaaacncccgtaaggtcctgactctatgatcgaccttccacgtttaggaaacggtcgggtacccatcgaaggttcagcggactagtgtacgtcgtagggactagtaatttccactccttcaacctntacagtacncctgcagtacctgtattcgtacttttgaccttaactttattacgtcgttacacgtactaaccttagtaacggttagggaacttaccgggttacggggacccggtaacgggggtaaccgttaagggggttcggtaaacggtaaccgttaaccggaaaaacggtaacggttcgggttaacgggtcgtaccggtaccgtaacccgttaattacccgggtttattacccctttacgtaaccgtttcccgttaacccccg

SEQ ID NO: 57927 - DNA, 490 bp, Homo sapiens
  misc_feature: GYAE6OF01BRYGF.37.33.C11.1.454.CMB.1.raw
  modified_base (365)..(365): a, c, t, g, unknown or other
  misc_feature (365)..(365): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (457)..(463): a, c, t, g, unknown or other
  misc_feature (457)..(463): n is a, c, g, or t
  modified_base (465)..(473): a, c, t, g, unknown or other
  misc_feature (465)..(473): n is a, c, g, or t
  modified_base (475)..(475): a, c, t, g, unknown or other
  misc_feature (475)..(475): n is a, c, g, or t
  modified_base (477)..(490): a, c, t, g, unknown or other
  misc_feature (477)..(490): n is a, c, g, or t
tcagtagtgtagatcacgaccggtgctcgatttagagtgagctcgttgggttgggtccgccaggctccagggaaggggctggagtgggtggccaaacataaaagcgagatggaagcgagaaatactatgtggactctgtgaggggccgattcaccatctccacagacaacgccaagaaatcaatctttttgcaaatgaacagtctgagagtcgaggacacggccatgtattactgtacgaagagaacagacttggggccagggaaccctggtaccaccgtctcctcacgcctccaccgaagggccccagtccggtccttcccccgtggcccgccctgcctaccgagggacgccacccgttccganacgcacacgccggcctgggctgcctggcaaggctactcatctacactactggagcgggctaggacaagggccgataagtagcnagncatgcnnnnnnncnnnnnnnnncncnnnnnnnnnnnnnn

SEQ ID NO: 57928 - DNA, 686 bp, Homo sapiens
  misc_feature: GYAE6OF01CA5XL.37.33.C11.1.454.CMB.1.raw
  modified_base (99)..(99): a, c, t, g, unknown or other
  misc_feature (99)..(99): n is a, c, g, or t
  modified_base (428)..(428): a, c, t, g, unknown or other
  misc_feature (428)..(428): n is a, c, g, or t
tcagtagtgtagatcacgaccggtgctcgatttagagtgagctcgttgggtttggggtcagactcagtcaggacacagcatggacatgagggtccccgntcagctctgggctcctgctgctctggctcccaggagccaaatgtgacatccagatcgacccagtcctccttccaccctgtcctgacatcgtgtaggagacagactacactatcacgttcggccgggaccaggtcggtaacttacgttacgtaccgtgggttcggaccgttaggtaactacaaacgaaacggaaaaccgaacgggtaaaccgtaccccgttaaggtcccgtagtacgttactagtacgtactccggtaccctactaacggtttacggaaaccggtccgggttacccagttaccgaaggttccgaggtccggtactaggtntacgtcggtaggactagtaaacttctacttacactaacctactacgtacgtacgtacctggaacctcgtccttaggtaattccgttaatttcgaacttaacgttacttacgtgtacatactaacgttaatacggtggtaacgtgttaacccgggacggtaggtaaccgtaggtacggagtaactaaccggaaactaggtcggtacgtcgtacgtacaccgtacgttctacgttccttaccgtacgttcccgttacccg

SEQ ID NO: 57929 - DNA, 740 bp, Homo sapiens
  misc_feature: GYAE6OF01CDFBJ.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagcttgggttttccttgttgcttattttggaaggtgtccagtgtgaagtgcagcgtggtggactcggtgggggaggtccgtggtccaggtccggtcggggggtccctggacgtacctctccgtgtcgacctaacctcgtggtattcgagttgtagtgtatttggttggagtggggttcggtccgcgtacggccgtaccggaggggaacggggtcgtagggacgggttgggtacggacccaaagtaagtaaaggacggagtagtagggaagacggaaagtaaagttactagtaggtgtaccgttcgtgggtagggacggggtacccgttaagttacccgaacctacgttccctaacccgaacgaacgtaacccaaaccggtaaccaaaaggtaaaccttccttaaattttcgttttaagaactaaagtacgaactacgtacgtaggaaggtacggtacggaacggtaccgaaccggtctagttacgttacttaacggtacggtaacggaagaacgtaacggacggtaaccgggttccgggggaacccgtaaccggggtaaccccgttcgggttaccccgtcccggttaccccg

SEQ ID NO: 57930 - DNA, 645 bp, Homo sapiens
  misc_feature: GYAE6OF01ESA80.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagcttgggttttccttgttgctattttagaaggtgtccagtgtgaagtgcagctggtggactctgggagaggcctggtccagccgtggggggtccctgagactctcctgtgcaacctctggattcagttgtagtgtattggttggagtggggtttcgggtcccgccgagggcctccgaggggaacggggctgggaggtgggtggaccaacagtaaagcgagagtggaagacgaagaaatacgtatggtagggtactcgtggtggacgggggtccgtaattccaccatcctacccaactacgaacaaccgacaaacgaaaactcaaagtttcttttacgaactaaagtcgaactagtcctaggtagacggtacgaaggacccgtacggaccctagttacggtaatttacgtacggtaacggaaggtaaacgaaaccggtaagtaacccggttacggggacccgtaaacggggtaaccccttaaggtcccgtaacccgg

SEQ ID NO: 57931 - DNA, 650 bp, Homo sapiens
  misc_feature: GYAE6OF01BG8C2.37.33.C11.1.454.CMB.1.raw
  modified_base (239)..(239): a, c, t, g, unknown or other
  misc_feature (239)..(239): n is a, c, g, or t
  modified_base (606)..(606): a, c, t, g, unknown or other
  misc_feature (606)..(606): n is a, c, g, or t
  modified_base (611)..(614): a, c, t, g, unknown or other
  misc_feature (611)..(614): n is a, c, g, or t
  modified_base (616)..(616): a, c, t, g, unknown or other
  misc_feature (616)..(616): n is a, c, g, or t
  modified_base (618)..(620): a, c, t, g, unknown or other
  misc_feature (618)..(620): n is a, c, g, or t
  modified_base (622)..(650): a, c, t, g, unknown or other
  misc_feature (622)..(650): n is a, c, g, or t
tcagtagtgtagatcacgaccggtgctcgatttagagtgagctcgttgggtccgccaggctccagggaaggggctggagtgggtggccaacataaaagcgagatggaagcgagaaatactatgtggactctgtggaggggccgattcaccatctccacagacaacgccaaagaaatcaattctttttagcaaatgaacagtctgagagtcgaggacacggcatgtattatgtacgaganaacgagacgttcggggaccacgggaacccgttggtaccgaccgttcctcccgtcgaaccgtccctacccgaacccgaaacgggccccctacggttcccgggttaccccttttcccccccggcgggtcccccggtccccgtccgtaccccgttacccggaagggaccgtacccaacccccgttccggaaacggacggaccgaccgacggtcccggggacccccgtggggccgtcggtaccccgttggtaacccgaaacgggttacctaacccgtttcccaacgtttaacctaccgtaaccgttacggtacgggaaccggtccgggggtcctaggggaaccggtaacgggtcccgaacaaggtaccggntacgnnnnanannnannnnnnnnnnnnnnnnnnnnnnnnnnnnn

SEQ ID NO: 57932 - DNA, 923 bp, Homo sapiens
  misc_feature: GYAE6OF01DV8X3.37.33.C11.1.454.CMB.1.raw
  modified_base (444)..(444): a, c, t, g, unknown or other
  misc_feature (444)..(444): n is a, c, g, or t
tcagtagtgtagatcacgaccggtgctcgatttagagtgagctcgttgggtttgggggtcagactcagtcaggacacagcatggacatggacgggtcccccgctcagctccgtggggcctcctgctgctcgtggctcccgaggagccaaagtgtggacagtccaaggacacgaccctagtcctccttccaccctgtctgacatctggaggagacagactacactatccgtgttcggccggacctagtacggacttagttacggtaccgtggttcgccgttaggtaactacaaacgaaggtaaaaccgaagggtaaaccgaccccgttaaaggtcccttaggaacttacggttaacgtactacgtttccggaccccttacggttaacggttttaacggggaaacggggtcccgggttaccctaaggttaccgtaagggttaccgngtaacgggtccgtacgtttaggtaaccttggggtaagggaaccaaggtttaaaacccttctaaacccggtttccgaaaccgttaacccgataacccgtaagtaccgttccgacggaacgtacggttcccggtaagttaacttcggtttaaacgttttacccaaggttttaaaaacctttttacttaaacgttccggggttaaaccacgttaaaccgttaaaccggtttaaacggttaaagggtttaacggggaaccggtttaacggggtttaacccggggaaacccccgggggttaaggggggaaccctttaagggggggtttaacaaaccggttaaccggttaaaaaccggtaaaacccggttagggtaccgggttttaaccgggacccgtttaccgggaaaccctaaaccctttacggttaaccttttccgggtttaaacctttcccccggtaaacggtttccccccttaaccccgg

SEQ ID NO: 57933 - DNA, 822 bp, Homo sapiens
  misc_feature: GYAE6OF01D7PF4.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccgaggagccaaatgtgacatccagatcgaccctagtcctccttcccaccctgtctgcatctaggtaggaagacagtacgtcaaccctatccacgttcggcccgggccaggtaccggaacttaatttaacggtaccgttgggttcggtccgtaggttaactaccaaaacgtaacggaaaacccgaaggggaaaaccgtacccccgttaaggttccctagtacttcttaagttcggaacttcgtcccttaccgtacgtttaagggaacggtccgggtaccctatacgtaacggttcacggacggtacgtagttacgtacgtacggtagggtaactaaagttaaccgttaccaccgtttacctacctaacccgtaacttacgtaacggtaccgtcccgttacggacccgtacgtacccgttagttaacgtttacggtttacgttttacggttaaccttaaactttttacgttaccgtttacgttaaccgtacgttaaccgtaactttaaacggttaaaggttacggggtaacgggttaccggttacccggggaaccggtaaccggggtaaccggttaggggttaacggaacgtaacgtaaaccggtaaacgtacggttcggtacggtacgtccggacctaccttacgttcgtttacgttacccgtttaccgttaccgtttcccggttaccccg

SEQ ID NO: 57934 - DNA, 610 bp, Homo sapiens
  misc_feature: GYAE6OF01AO6L9.37.33.C11.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagactcgacccagtcctccttccaccctgtctgcatctgtaggagacagagtcaccatcacttgccggcagtcgactattagtacctggtgcctggtatcaanagaaccaggaacnccctagtcctgatctatgatcgcctctactttaggaacgccgggtcccatacgtaaggttcaggcggctaggtctagtcgtaggacagtaactcactccacacctatacgagtctccgtgacgtgtacctagtagttcgtagttttcccgacttaaccgtttattacgtacgtactaacgaccttaatacttaaggtaacgggtagtaacggttccggtaacgggacggtaacccgggttagggttacgaacgcgtaaaccgaaacggtaacgttcggtaaggtccgtcgaacctacctaagttcccgtacgttaccttcacccgttttcccgtaacccgg

SEQ ID NO: 57935 - DNA, 742 bp, Homo sapiens
  misc_feature: GYAE6OF01CM1UX.37.33.C11.1.454.CMB.1.raw
  modified_base (464)..(464): a, c, t, g, unknown or other
  misc_feature (464)..(464): n is a, c, g, or t
  modified_base (726)..(726): a, c, t, g, unknown or other
  misc_feature (726)..(726): n is a, c, g, or t
  modified_base (729)..(730): a, c, t, g, unknown or other
  misc_feature (729)..(730): n is a, c, g, or t
  modified_base (732)..(733): a, c, t, g, unknown or other
  misc_feature (732)..(733): n is a, c, g, or t
  modified_base (735)..(735): a, c, t, g, unknown or other
  misc_feature (735)..(735): n is a, c, g, or t
  modified_base (737)..(742): a, c, t, g, unknown or other
  misc_feature (737)..(742): n is a, c, g, or t
tcagtagtgtagatcacgaccggtgctcgatttagagtgagctcgttgggtttgggggggtccctgagactctcctgtgcaacctctggattcagttgtagtgattgttggatggggttgggtccgccaggctccgagggaaggggctggagtgggtggccaacataaagcgagatggaagcgagaaatactatgtggactctgtggaggggccgattcaccatctccacagacaacgccaagaaactcaattctttttgacaaatgaaactagtctaggaagtaggtcggaaggaccgaccgggccaatcggtaatttacgtaggtaaccggagaaggaaacagggtacgtttacggggacccgtaacggggtaaccccttgggtaccctacccggtccttccctcgacgtcccgtaccaaccgaaacgggtcccccagttcccgggttcccttccccccggnggtccccgcccgttcgccgtacccgaggaccgaccgtaccccgtaccggaacggacgtaccgaaccgaaccggtcccgggccccgggttacgggccgttccggtaccccggttacggggtaaccgtaaaccggggttaaccctttaaccccgttaccccgtaaccgttacccgtttaaaccctaaccgttaaccgttaggggaccgggttaccggggccgttacgggaccggtaaacggggcccacgtaaccgaggtacggncgnncnncncnnnnnn

SEQ ID NO: 57936 - DNA, 378 bp, Homo sapiens
  misc_feature: GYAE6OF01BP3KD.37.33.C11.1.454.CMB.1.raw
  modified_base (100)..(100): a, c, t, g, unknown or other
  misc_feature (100)..(100): n is a, c, g, or t
  modified_base (351)..(351): a, c, t, g, unknown or other
  misc_feature (351)..(351): n is a, c, g, or t
  modified_base (377)..(378): a, c, t, g, unknown or other
  misc_feature (377)..(378): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaaatgtgacatccagatcgacccagtcctccttccaccctgtctgcatctgtaggagacagagtcaccatcacttgccgggcagtcgactattacgtacctggttggcctggtatcaacagtaaaccaaggaaagcccctaaggtcctgatctaatgaatgcctcctactttggaaacgcgggtccagtacgtaacggttcaggtcggacnggtagtatcgtggacagtaatcctann

SEQ ID NO: 57937 - DNA, 803 bp, Homo sapiens
  misc_feature: GYAE6OF01DO4R8.37.33.C11.1.454.CMB.1.raw
  modified_base (724)..(724): a, c, t, g, unknown or other
  misc_feature (724)..(724): n is a, c, g, or t
tcagtagtgtagatcacgaccggtgctcgatttagagtgagctcgttgggtttgggggtcagactcagtcaggacacagcatggacatgagggtccccgctcagctccgtgggctcctgctgctctggctcccaggagaccaaatgtcgacacgtaccagactcgacctagtcctccttccacctgtctgcatcgtagtaggagacgagtacgtaccacataccgtacgttccggacccggaccgtaaggttccggtaactttaacgtttacggttacccggttgggtttccggaccgtttaaggtactaaaccgaaaacgtaaaccggaaaacccgggaaaggggtaaaacccgtcccccgttaaagggttccctaggttaacttacgtagtacgtaagtcccgtacccttaccggttaaggtttaacgggaaccgttcccgggtaccaagtaccggtaaagtcgaagtcggatagtacgttacgtacggaggaactaagtacttaccacttaccgactaacccgagttacgaccgttacgcctacgaccgtacgtacccgtaggttacgttacgtttaacgtttacttaaacctttaccgttttaagtttaccgacgttaacgtacctaacggttaaacttaaacggtgggtaaccggtacgttacccgggttacggggaaccggtaacggggttaccgtaagggtaacgtaacggttaaanaacccggtaagttacggtcgtacgtactccgtaacgaaccttgttaccctgtttaacctcgtacccgttccgttacccg

SEQ ID NO: 57938 - DNA, 486 bp, Homo sapiens
  misc_feature: GYAE6OF01DA014.37.33.C11.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (348)..(348): a, c, t, g, unknown or other
  misc_feature (348)..(348): n is a, c, g, or t
  modified_base (450)..(486): a, c, t, g, unknown or other
  misc_feature (450)..(486): n is a, c, g, or t
tcagtagtgtagatcacgaccggtgctcgatttagagtgagctcgttgggtccgccaggctccagggaaggggctggagtgggtggccaacataaaagcgagatggaagcgagaaatactatgtggactctgtgagggccgattcaccatctccacagacaacgccaaagaaatcaaattctttttgcaaatgaacagtctgagagtcgagacacggccatgtattactgtacgagagaanagacgttggggccagggaacctggtcaccgtcnctcagccctccacgacggcccatccgtcctccccngccgccctncctccgaggtcgccaccgtcgagacgcacngccgccgtgggctcgccgtggacaaggaccttacgtcctatacgtaccactacgtcggacggtccgggcgtcgggacgaaacgggtccactaagtagctagnnnnnnnnnnnnnnnnnnnnnnnnnnnnnnnnnnnnn

SEQ ID NO: 57939 - DNA, 521 bp, Homo sapiens
  misc_feature: GYAE6OF01EL5HI.37.33.C11.1.454.CMB.1.raw
  modified_base (312)..(312): a, c, t, g, unknown or other
  misc_feature (312)..(312): n is a, c, g, or t
  modified_base (461)..(461): a, c, t, g, unknown or other
  misc_feature (461)..(461): n is a, c, g, or t
  modified_base (493)..(495): a, c, t, g, unknown or other
  misc_feature (493)..(495): n is a, c, g, or t
  modified_base (497)..(521): a, c, t, g, unknown or other
  misc_feature (497)..(521): n is a, c, g, or t
tcagtagtgtagatcacgaccggtgctcgatttagagtgagctcgttgggttgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacaccggccctctattacgtgtgcgagagatcaaggacggagtatagcagcagctctgtactacgtggggcccaaccggacccgtggtccaccgttcncctcacgccctccaccgaacggccagtccggtcccttccccgtgccacccctcctaccaacgcgccaccgtcggtcggggccacgtacggccggccgtgggccgtcgccgtcggacgaacggtccttacgtcccatcctactactacgngacggcggcgtggaacgcggcgacaaggtcannncnnnnnnnnnnnnnnnnnnnnnnnnn

SEQ ID NO: 57940 - DNA, 693 bp, Homo sapiens
  misc_feature: GYAE6OF01CDEJL.37.33.C11.1.454.CMB.1.raw
  modified_base (195)..(195): a, c, t, g, unknown or other
  misc_feature (195)..(195): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtagganacagagtcacatcacttgccggcagtcgactatcgtaccgtggttgcctggtatacaacaacgaaaccgagggaaacgcccgtaaggtcctgatctatgatcgcctaccgtacgtttagggaacgccgggtaccagtacgtaaggttcacggcggcgtaggtgtagtcgtagggaactagtaacttccactcctacaccatacacgtacgccgtagcctaagtcctagtacgttagttattttacgtacttaaacgtttactttacgtacgttacctaacgtacttaaacttaaggtaaggttacggggtaacgttaccgggtttaccggggaacccgggtaacggggttaacccgggtagggggttacggaaaccgtaaacggtaaacccggtaaaaacgggttacggttacgggtacgggtaccgttaccggaacccgttaaccgtaccgtttccgttacgtttaccgttaccttaccgttccccgttaacccccg

SEQ ID NO: 57941 - DNA, 620 bp, Homo sapiens
  misc_feature: GYAE6OF01E0WEK.37.33.C11.1.454.CMB.1.raw
  modified_base (528)..(528): a, c, t, g, unknown or other
  misc_feature (528)..(528): n is a, c, g, or t
  modified_base (577)..(577): a, c, t, g, unknown or other
  misc_feature (577)..(577): n is a, c, g, or t
  modified_base (600)..(600): a, c, t, g, unknown or other
  misc_feature (600)..(600): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(620): a, c, t, g, unknown or other
  misc_feature (616)..(620): n is a, c, g, or t
tcagtagtgtagatcacgaccggtgctcgatttagagtgagctcgttgggtttgggggggtccctgagactctcctgtgcaacctctggattcagttgtagtgattgttggatgggttgggtccgccaggctccgagggaggggctggagtgggtggccaacaataaagcgagatggaagcgaagaaatactatgtcggactcgtgtggagggccgtattccaccatcctccacacgacaacgaccaaagtaaactctaaatttctttttagactaaatcgaacagtctgagacggtcgaggaccgacggaccagttagttacttaacgtcggtaacgagaacgaacgacggtacggttcgggaccgacgggtaacccgtcggtacccaccgttcctcctaccgacgtccctacccgaaccggaacggtccccgacttcccggtccccttccccgcggtccctcccgtcgcctccgaggccgccacccgccgacgcgcccgaagccggccggtccgtggcctcgcgtnaccgacgtaccttactaccgtactacctactaccgtagtggcggtacgngtcggacgaaggccagtagacgncgtncgntagcncncnnnnn

SEQ ID NO: 57942 - DNA, 628 bp, Homo sapiens
  misc_feature: GYAE6OF01DCGMT.37.33.C11.1.454.CMB.1.raw
  modified_base (503)..(503): a, c, t, g, unknown or other
  misc_feature (503)..(503): n is a, c, g, or t
  modified_base (557)..(557): a, c, t, g, unknown or other
  misc_feature (557)..(557): n is a, c, g, or t
  modified_base (580)..(580): a, c, t, g, unknown or other
  misc_feature (580)..(580): n is a, c, g, or t
  modified_base (606)..(606): a, c, t, g, unknown or other
  misc_feature (606)..(606): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacagtccagatgacccagtctccttccaccctgtctgcatctgtaggagacagagtcaccatcacgttgccgggcctaggtcggactattacgtaccgtggttcggcctggtactacaacagaaaccgagggaaacgccccgtaaggtcctagtatctagtagtagtccgtccgtaacctacgtttacgggaaacgtcccggggtacctactacggtaaccggttgacggcggacgtagttgacttcggaggtactaagtactctaccgtctaccgactactacgtacggtaccgtcgtacgacgcgtaccgttagtagtacgtttactttaccgactttaacttattcgtactanactactacttagtaacggtggtaacgtcgtacggcgggaacggtcgtagggtanacgtactaaccggaaattacggnggttccgatccgactcgtattccgtnttacctctacttcccgtacccg

SEQ ID NO: 57943 - DNA, 668 bp, Homo sapiens
  misc_feature: GYAE6OF01AKV80.37.33.C11.1.454.CMB.1.raw
  modified_base (406)..(406): a, c, t, g, unknown or other
  misc_feature (406)..(406): n is a, c, g, or t
  modified_base (576)..(576): a, c, t, g, unknown or other
  misc_feature (576)..(576): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtcctccttccaccctgtctgcatctggtaggagactagagtccaccatcacgttcggccgggccaggtcggacttagttacgtaccgttggttcggcccgttggtaactaccaaacgaaggaaaacccgaggggaaacctccccgtaaggtcctagtactctaatcgtactcgtacccttaccgtaacgtttacgggaaacggtccgggtaccctagtaccgtaaggttccagggccggtntaaggttgtacgtcggtaagggactagtaacttcgaccttcctacactcttacgtaaggtccgtaccgttgacctacggtccgttagtacgttcgttaacgtttacaactttacctttatacctgtacacgtaactacgtaagtaggtaggtacggtgtaccggacgggnggtaccgtagggtacagtcgtaaaccgaagtacgtggtacgtacgtccgacctaagtcgttcccttgttccttaacctcttccccgttaccg

SEQ ID NO: 57944 - DNA, 664 bp, Homo sapiens
  misc_feature: GYAE6OF01CA76A.37.33.C11.1.454.CMB.1.raw
  modified_base (99)..(99): a, c, t, g, unknown or other
  misc_feature (99)..(99): n is a, c, g, or t
  modified_base (208)..(208): a, c, t, g, unknown or other
  misc_feature (208)..(208): n is a, c, g, or t
  modified_base (268)..(268): a, c, t, g, unknown or other
  misc_feature (268)..(268): n is a, c, g, or t
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
  modified_base (454)..(454): a, c, t, g, unknown or other
  misc_feature (454)..(454): n is a, c, g, or t
tcagtagtgtagatcacgaccggtgctcgatttagagtgagctcgttgggtttgggggtcagactcagtcaggacacagcatggacatgagggtccccntcagctcctggggctcctgctgctctggctcccagggagcctaaatggcggactagtccaaggactcgacctagtcctcctccacctgtctgcatctagaggagacagngacactaatcacttggaccggccaagtcggactagttagtacctggtcggcctgggttancgaacagaaaacgcggtaaaanccccgttaaggtccagaactcgtatagnttcgacctaccgtacttaggaaaacggcgggtaccctagtaccgtaaggttacccaaggccggtactagtcgggttaatccggttagggaaccaaggtaactttacactcgtaccaccggtattacgacggttacncgagacgtactcgtagtagtgtttacgttcgtaacttaacgttaatcttacgtactacgtataacttaacgtaaggtagaagtcgtaacgggtaccggtaaggtacccggtaggtaacggtaacgtaacgtaacgtaaacgtacgtacggtacctacggttaccacgttaaccgacttccgttacttaatccgttccgtacccggtaccc

SEQ ID NO: 57945 - DNA, 720 bp, Homo sapiens
  misc_feature: GYAE6OF01CALIY.37.33.C11.1.454.CMB.1.raw
  modified_base (295)..(295): a, c, t, g, unknown or other
  misc_feature (295)..(295): n is a, c, g, or t
  modified_base (324)..(324): a, c, t, g, unknown or other
  misc_feature (324)..(324): n is a, c, g, or t
  modified_base (714)..(714): a, c, t, g, unknown or other
  misc_feature (714)..(714): n is a, c, g, or t
tcagtagtgtagatcacgaccggtgctcgatttagagtgagctcggtttggggtttggggggtccctgagactctcctgtgcaacctctggattcagttgtagtgattgttggatggggttgggtccgccaggcctccagggaaggggctgggaggtgggtggtccaacattaaagcgtagatggaagcgagaaatactatggtggactcgtggtggaggggccgtattcaccgattcctccacagaccaacgccaaagaaactctaattcgtttttgactaaatagaactgtcngagacgtcgacgacacggcactgtattcnggtacgagagacgagacggttggggaccaacgggtacctggtaccaccgtactccgtcacgtccctaccaaccgaacgggccccaacggttcccggttaccccgttcccccggtgggccccgtaccccgtcggcctacccggacggaccgtaccccgacccgtacccgaacggtacgaccgtaaccgaccggccgggtaccccgtcggtccgttccgaccggttacggtaaccgtaacggttacctttaccgttaccctaacctaccgttaaccctaaccgtacgtaccgggtaacggtcccgggtaacggttacgggacccggaacggggtacccgaacgtaacgttaccggcgacggatacggcgtacgaacccggtcacgcgacgcncgcgcg

SEQ ID NO: 57946 - DNA, 598 bp, Homo sapiens
  misc_feature: GYAE6OF01B4395.37.33.C11.1.454.CMB.1.raw
  modified_base (104)..(104): a, c, t, g, unknown or other
  misc_feature (104)..(104): n is a, c, g, or t
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
  modified_base (552)..(552): a, c, t, g, unknown or other
  misc_feature (552)..(552): n is a, c, g, or t
  modified_base (576)..(576): a, c, t, g, unknown or other
  misc_feature (576)..(576): n is a, c, g, or t
tcagtagtgtagatcacgaccggtgctcgatttagagtgagctcggttggggtttgggggtcagactcagtcaggacacagcatggacatggacgggtccccgntcagcctccgtggggcctcctgctgctcgtcggcctcccagggacaccaaagtgcggacataccaggatcgaacccngtcctccttcccacctgtcngctatcgtagaganacagcacaccagtacncgtcggccggacaggctaatagtctcgtggtcggactggtaacacaaagaacgaacgaaggaaccncctaaggctagacttntangtaccnctaccctacgtagttaacgggacggtcccggtactaggtaccaagggtcgagccggagtacgagttcacgggacgattaaanacgttcactcgtaanaccttaanccgtaagtacncgngtaccgactatgtaattgttacttaactntaactttcagtctanacgtanataggttaaggngtaacgcgaacggcggtaagcgtagacgaagtacgaaacgtaagtcggngtacgactacgactactcttcgtnttacccacttcccgttcctacg

SEQ ID NO: 57947 - DNA, 739 bp, Homo sapiens
  misc_feature: GYAE6OF01A1W93.37.33.C11.1.454.CMB.1.raw
tcagtagtgtagatcacgaccggtgctcgatttagagtgagctcgttgggtttgggggtcagactcagtcaggacacagcatggacatgagggtccccgctcagctccgtggggctcctgctgctctggctcccaggagccaaatgtgacatccagatcgacccagtcctccttcccaccctgtctgcatcgtgtaggacgacagacgtaccacctatctaccgttcgggcccgggacctacggtcggtaacttagtttaacgtaccgttgggttcggtccgtaggtacgtaccaacgaaggaaaacccgaaggggaaaccgacccccgttaaggtcctagtactactagtgtactcgacccttaccgtaacgtttacgggaaccggtccgggtacccaagtaccgtaacggttccgacggtcggtacgtaggttacgtacgtcggtagggaactaagtaacttcacctcctacaaccctataccgtaagtccgtccgtacgacgtaccgtctagtacgttagtttacgtttaccgaacctttaactttacttaccgttacgtacgtaacgtacaacgtttaagtaaggttacgggaacgttacgggtacccgggtaccgggtaacgggtacggtaagggttcgtaacgtaacgtaacgtaaaccgtaggttcggttacggagtccgaacctacgtaccgttcgttacgttaccccttcttcccgttcccccgtacccg

SEQ ID NO: 57948 - DNA, 876 bp, Homo sapiens
  misc_feature: GYAE6OF01D2SFL.37.33.C11.1.454.CMB.1.raw
  modified_base (101)..(101): a, c, t, g, unknown or other
  misc_feature (101)..(101): n is a, c, g, or t
tcagtagtgtagatcacgaccggtgctcgatttagagtgagctcgttggggtttgggggtcagactcagtcaggacacagcatggacatgacgggtccccnctcagctccgtggggcctcctgctgctctggcctcccgaggacgacctaaatgtacgaactactaccgaaggactacgaccctacgttcccttccccttacccacccgtcgtctgctattcgtaggtaggacgacgagtacgtaccacctactctaccgttcggaccgggtaccgtaggtaccggtacttaacgttaaccggttcggttagggttcggtaccgttaaggtactaacccgaaaacggaacggaaaacccggaacggggtaaacctaccccggttaacgggtacctacgtattaccttaagtcggtaacttccggtaccttaccgtaacggtttacgggaaccgggttcccgggtaaccaagttaccgaaacggttcgacggacgtacgtagtagtacgtccggtaggaacttaacggtactttacacccgttactacccaaacttaccggtaacgtacgttacgtaccgtaccgtaccgtacgtacccgttagttaacgttacggttttaaccttacgggttaaccctttaaggtttaccctttaacggtaccgtacgttaacgtaacgtttaaacgttaaggtttaacgggtacgggtaacgggtaccgggttaaccgggtacggggaaccgggttacggttacgggttaacgaaccgttaaacggaaaccgtaaaggtaaccggttcggtaaccggtcttaaacgggacccctacgttaacttcggttaccttaccgttaaccttcccgtacccgttaccccgg

SEQ ID NO: 57949 - DNA, 663 bp, Homo sapiens
  misc_feature: GYAE6OF01A9PPW.37.33.C11.1.454.CMB.1.raw
  modified_base (373)..(373): a, c, t, g, unknown or other
  misc_feature (373)..(373): n is a, c, g, or t
tcagtagtgtagatcacgaccggtgctcgatttagagtgagctcgttgggtttgggggggtccctgagactctcctgtgcaacctctggattcagttgtagtgattgttggatggggttgggtccgccaggctccagggaaggggctgggagtgggtggccaacataaagcgagatggaagcgagaaatactatgtggactctgtggaggggccgattcaccatcctccacagacaacgaccaaaaactcactgtatctgacaaagtggacggcctagagactccggaggacacggctgtgtattattgtgcgagagtatttagactaacaaggtttcgagtgactggtatgatgtacttatagtactaccgnggggaccgaagggaccagtcggtactacccgtcttcctacaccgtccctacccgaacccgaacgggcccctacgtcccggttcccttcccccgcggcccgtccccgtgccctccgtacggcgtaccctaccgccggagacgccaccggacggtcccgggtcccgtcgggccgtacggtcccgtacgggtaccgaacggtacccttaccgttaccctaacttccccgtaactaacccgttaccgtacgggtacggggtcccgggaggtaccgggaccggaacgggtcccgg

SEQ ID NO: 57950 - DNA, 504 bp, Homo sapiens
  misc_feature: GYAE6OF01AM3GA.37.33.C11.1.454.CMB.1.raw
  modified_base (447)..(447): a, c, t, g, unknown or other
  misc_feature (447)..(447): n is a, c, g, or t
  modified_base (482)..(504): a, c, t, g, unknown or other
  misc_feature (482)..(504): n is a, c, g, or t
tcagtagtgtagatcacgaccggtgctcgatttagagtgagctcgttgggttgggtccgccaggctccagggaaggggctgggagtgggtggccaacataaaagcgagatggaagcgagaaatactatgtggactctgtgaggggccattcaccatctccacagacaacgccaagaaatcaatctttttgcaaatgaacagtctgagagtcgaggacacggcatgtattactgtacgagagaacaggtacgttcgggggaccgacggggaacccctggtcccgtaccgtcctcccttcacgccctacccaccgaacggggcccctaagtccggttcccctttccccccgtggccgtccccgtgccttccgacggcgcctacccgtccgagcgccacacggccgccgtggctcgccgtgtacgagtcctactccatctacacgtacgnggacgtcgggtcgtaggacgtacgggcacagtagnnnnnnnnnnnnnnnnnnnnnnn

SEQ ID NO: 57951 - DNA, 705 bp, Homo sapiens
  misc_feature: GYAE6OF01DT0FZ.37.33.C11.1.454.CMB.1.raw
  modified_base (124)..(124): a, c, t, g, unknown or other
  misc_feature (124)..(124): n is a, c, g, or t
  modified_base (164)..(164): a, c, t, g, unknown or other
  misc_feature (164)..(164): n is a, c, g, or t
  modified_base (198)..(198): a, c, t, g, unknown or other
  misc_feature (198)..(198): n is a, c, g, or t
  modified_base (332)..(332): a, c, t, g, unknown or other
  misc_feature (332)..(332): n is a, c, g, or t
  modified_base (691)..(691): a, c, t, g, unknown or other
  misc_feature (691)..(691): n is a, c, g, or t
tcagtagtgtagatcacgaccggtgctcgatttagagtgagctcgttgggtttggggggtccctgagactctcctgtgcaacctctggattcagttgtagtgattgtggatggggttcggtccnccgaggcctccgagggaaggggctggagtgggtgccaaanataaagcgagagtgggaaagcgaagaaattactntaggtggactctggtggacggggcctattccaccatccacgacacgaaccaaccgcccaagaactcatttgtatcgtagactaaaatacgaacagaccgtagaggaccggacggaacggaccacggtcttagtnttattacgtgtggacgagaggagaggctagtagtagtaagtggcgtcgtaccttatactactactaatacgagttcggacgtcggtaggggacgaaacgggtaccgaccgttccgtaccgtcctacccgaccgtactacccctaccgaaccggtaccggacccgtaccggtcccggttcccccttccccggtccgtacccccacccgttccgtacccgaactcccggaccgtccgtaccggggtaccgggaccaccggacgggcccggtaccgtcggtaccgtcgtacccggtacgacgtaaccgtaccttactacctactaacccgtactacgtaccgtagggacggtcggtacccgnggtaacccggacgg

SEQ ID NO: 57952 - DNA, 586 bp, Homo sapiens
  misc_feature: GYAE6OF01BCN2X.37.33.C11.1.454.CMB.1.raw
  modified_base (160)..(160): a, c, t, g, unknown or other
  misc_feature (160)..(160): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (550)..(586): a, c, t, g, unknown or other
  misc_feature (550)..(586): n is a, c, g, or t
tcagtagtgtagatcacgaccggtgctcgatttagagtgagctcgttgggtttgggtccgccaggctccagggaaggggctggagtgggtggccaacataaagcgagatggaagcgagaaatactatgtggactctgtgagggccgattcacatctccanagacaacgccaagaaatcaattctttttgcaatagaacagtctgaggagtcggagacaccggcctaatgttattactaggtacgaagagaaacacggtacggttacgggggacccgacgggtaacccttgggtcccaccggttcctcccgtcaaccgccctaccaccgaacgggtccccagttcccggtcccctttaccccgtccggaccctacccctccctaccaacgacgcctaccgttcgggacggggccaccgacggtccggccgtcggctcgcccggtgaacggtaacggtaccttacctacctaccgtaccttaccgaacctttcgagggtaaccggcggggacccttaccgggacgaaacggggtctacgaaagcgngtcngnnnnnnnnnnnnnnnnnnnnnnnnnnnnnnnnnnnnn

SEQ ID NO: 57953 - DNA, 709 bp, Homo sapiens
  misc_feature: GYAE6OF01BN1EJ.37.33.C11.1.454.CMB.1.raw
tcagtagtgtagatcacgaccggtgctcgatttagagtgagctcgttgggtttgggggtcagactcagtcaggacacagcatggacatgagggtccccgctcagctccgtggggctcctgctgctctggcctcccgaggagccaaatgtgacatccagatcgacccagtcctcccttccaccctgtctgctatctggtaggagacagagtccaccatctacgttcggcccggaccaggtccggtacttatttacggtaccgtgggttcggtccgttggtataccgaaacgaacggaaaaccggaacggggaaaccgtacccccgttaacggtccgtagtaacttcgttacgtgacttccgcccttaccgttacgtttacgggaaccgggtccggggtaccctagtacgtaacggttcgacggcggtcgtagttacgtagtcgtagggaacctaagtaacgttcctacctacctaccacctatacgtacgtcgtccgtacgctcgactgtagttgttagtttactaccttaatttacttcttacgtacagtacctaagttagttaaggaggtacgtacggtaccggggaccgtacgggtacggtagggtacgtaggtaaccgtaccgtaaacgttacggtaggttccgcgttccgacccgtaccttacgttcccgttacttacccgtttacttaccgttcccttaccccg

SEQ ID NO: 57954 - DNA, 526 bp, Homo sapiens
  misc_feature: GYAE6OF01B3E3Z.37.33.C11.1.454.CMB.1.raw
  modified_base (485)..(485): a, c, t, g, unknown or other
  misc_feature (485)..(485): n is a, c, g, or t
  modified_base (492)..(526): a, c, t, g, unknown or other
  misc_feature (492)..(526): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaattctttttgcaaatgaacagtctgagagtcgaggacacggccatgtattactgtacgagagaacagacgttggggccagggaaccctggtcaccgttctccctcacgccctccaccgaagggccccatccggtccttcccccgtggccgccctgcctccgaggacgccacccgtccgagacgccaacgacggccggccctggggcctcggcccgtgggtaccgaaacggtaccttacgttcccaattcctaacctaaccttaccgtggacggccggggtacgtcgggacgaaacgggccgacaagtagntagcagnnnnnnnnnnnnnnnnnnnnnnnnnnnnnnnnnnn

SEQ ID NO: 57955 - DNA, 783 bp, Homo sapiens
  misc_feature: GYAE6OF01AH2AI.37.33.C11.1.454.CMB.1.raw
  modified_base (571)..(571): a, c, t, g, unknown or other
  misc_feature (571)..(571): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctccaggagaccaaatgtgacatccagactcgacccagtccttcccttcccacccttgtctcgctacttcgtaggtaggacgaacgagacgttaccacctacttccgtaccgttccgggcccgggtaccgtacggtaccggtaacttaacgtttacggttaccggttagggttcggtcccgttaggttaaactaaccgaaaacgaaacggtaaaacccggaacgggggtaaaacccgtacccccggtaagggttccccttaggtaacttcctagttcggaacgttcccgtacccttaccgttaacggtttaacgggaaccgggtccgggttacccagtaccggtaacgggtcacgggtcgacgtaggttacgtacgtcggtaaggaacctagtaacctttaccaccgttactaaccctactacgtacgtacgtaccgtaccgngtaccgacgttaccgtagttacttacgttactttaccgtactttaacgtttacgttactacgtagacttactaacgttaagtacggtaggtacgtacgggtaccggacggtaacgggtacgtagggtacaggaactaacggaacgtacgtcgtacgtacgtcgaccgttaactcggttaccttcggtaccttacctccgttcccgtaacccg

SEQ ID NO: 57956 - DNA, 714 bp, Homo sapiens
  misc_feature: GYAE6OF01DA2VJ.37.33.C11.1.454.CMB.1.raw
  modified_base (284)..(284): a, c, t, g, unknown or other
  misc_feature (284)..(284): n is a, c, g, or t
  modified_base (326)..(326): a, c, t, g, unknown or other
  misc_feature (326)..(326): n is a, c, g, or t
tcagtagtgtagatcacgaccggtgctcgatttagagtgagctcggttgggtttggaggtctcagagaagagccttagccctggactccaaggcctttccacttggtgatcagcactgagcacagagactcaccatggaattggggctgagcgttggttttccttgttgcttattttagacggtgtccagtgtgaagtgcagctggtgactcggtggggagcctggtccagccgtggggggtccctgacgtctcctcgtagtgacctaacctcgtggtactttntagttagtagtgtagttggtggtacgttggggttcggaccgngtacggtctaccggaggggaggcgtagggacggtgggtacgacctaaagagtaaacgcgaagtagtagaaggacgaaagtaaatacgtaggtgtcggtaacgttcgtggttaagggccggaccgtattacccgaacacctacgtaccaacaccgaaaccgaaccggaaccaaaacgtaaactaaccttaaacttttacgtttttaacaaaccgttaaagtacgtaaacgttacgtaaccggttaggaaacgggttacgtaccgggtaacgaacccgtaaccgggccttaaacgttcggttaaacttacgtaacggtacggaaagtaaggacgtaacggttacgtaccgggacgtaacccggtaccgtacggtcccgtaccgttacccg

SEQ ID NO: 57957 - DNA, 663 bp, Homo sapiens
  misc_feature: GYAE6OF01AWD3F.37.33.C11.1.454.CMB.1.raw
  modified_base (195)..(195): a, c, t, g, unknown or other
  misc_feature (195)..(195): n is a, c, g, or t
  modified_base (567)..(567): a, c, t, g, unknown or other
  misc_feature (567)..(567): n is a, c, g, or t
tcagtagtgtagatcacgaccggtgctcgatttagagtgagctcgttgggtttgggggtcagactcagtcaggacacagcatggacatggagggtcccccgctcagctcctggggctcctgctgctctggcctcccgaggagccaaagtgtcgacatccaaggactcgaccctagtcctccttccaccctgtctncatcgtagtagacgacagtagacacctactcacttcggccggtaccaggtacgtactaattacgtaccgttggtggcctgtactacaacaacgaaaccgaagggaacctaccgtaacggtcctagtatacgtatgactccgtcctacctacgttaacggaacggaccgggttaccagtacgtaagtacgacggtcggactagtgtatacggtaggacaagtactacactctacacactacgagtcgctacggtcacgtctagtacttacgtacttttagaacttaacttacttaccgtattacaacgtacgaacttaagtaacgttagggaccgtacgggtaccggtacgggaacgggtacggtagggttanaacggttacgtaaaccgtaaaggaacgttacgggtacgtcgtacgaccgttaactcgttaccggttacttaccctttactcccgttcccggtaccc

SEQ ID NO: 57958 - DNA, 568 bp, Homo sapiens
  misc_feature: GYAE6OF01BOMMV.37.33.C11.1.454.CMB.1.raw
  modified_base (549)..(568): a, c, t, g, unknown or other
  misc_feature (549)..(568): n is a, c, g, or t
tcagtagtgtagatcacgaccggtgctcgatttagagtgagctcgttgggtccaccaggctccaggggaaggggctggagtgggtggccaaacataaagcaagatggaagtgagaaatactatgtggactctgtggaagggccgattcaccatctccagagacaacgcccagaactcattgtatctgcaaatgaacagactgagacgccgaggacacggctgtgtattactgtgcgagaggaggaggcgtattagtagtaaatggctgggccttctactactaactactacatggacgtcgtggggacaaacgggaccgacggtccaccgtctcctcacgcctaccaccgaacggcccactcggtcccttcccccgtcgaccacccctccctaccaaaggacgcctaacctcggtcggggggaccacgacgggcccggaccccgttcgggggcctcggcccgtacgggtacgaaacgggtaacctacttaccactacctaacctacctacgtcgacggccgggcgtggaccgaagggcgacaagtagcnnnnnnnnnnnnnnnnnnnn

SEQ ID NO: 57959 - DNA, 697 bp, Homo sapiens
  misc_feature: GYAE6OF01CPYNC.37.33.C11.1.454.CMB.1.raw
tcagtagtgtagatcacgaccggtgctcgatttagagtgagctcgtttgggtttgggggtcagactcagtcaggacacagcatggacatgagggtccccgctcagctccgtggggctcctgctgctctggctcccgaggagaccaaatgtgacatccagatcgacccagtcctccttccacctgtctgcatcgtgtaggagacagacgtaccaacattcacgttcggccgggcctaggtaccggtacttaagttacggtaccgttggttcggtacccttaggtactacaaacgaacggtaaaaccgaacgggaaccgtaccccggttaaggtcctagtacttctagtgacttccgccttaccgtacggtttacggaaccgggtaccgggtaccctaagtacgtaacggttcgacggtcggacgtacggttgtacgtcggacgggtaactaacgtaacttccacttacctactaactacgtacgtacgtacgtcctacggtactacgcttaggtacgttacgtttaattttacggaacctttaacttttaacgttcttacgactaacgtctaaacgtttagacgtagggtacgtaccggtcggaccgaagggtcgtagggtacagtacgtaacgaacgtagttcgggctacacgccctattacgttccttgttaccttccacgtttccccgtaacccg

SEQ ID NO: 57960 - DNA, 750 bp, Homo sapiens
  misc_feature: GYAE6OF01BRAZB.37.33.C11.1.454.CMB.1.raw
  modified_base (439)..(439): a, c, t, g, unknown or other
  misc_feature (439)..(439): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
tcagtagtgtagatcacgaccggtgctcgatttagagtgagctcgttgggtttgaggtctcagagaagagccttagccctggactccaaggcctttccacttggtgatcagcactgagcacagaggactcaccagtggaattggggctgagtcttgggttttccttgttgcttattttagaaggtgtcagtgtgaagtgcagtcgtggtggtacgtcggtgggggacggtcctcgggtccgtacggtcccggttcgggggggttcccctggaacggtaccttccgttcccgttggtaccgccgtaaacccttcgtacgggtacttcgtagtttggtagtgttagttggttggtagttggggttgggtcccgcgtacggtcctcggaaggggtagggtcgtgggtaggtgggtgaccaagagtaacgcgagcgtaggagnggaataagtactgtcggtgactgtggtggacgggctatcacgtntaccncagacgaacctaacgaccaagtaactacgtaactttcgtttacgaagtaacgtacgtaacgtcgttaacgtaggaaacgtacgggtaaccgggaacggtaaccgacccgggtacgtaacgttacggttaacgtttaaccggtaacggtaaccggtaaaggtaaccggtaaccggaaacgggttacccggggtaaccggtaaccccggggtaaacccggttaaccccgggttcgggtacccccgtaaccgggtttaacccccg

SEQ ID NO: 57961 - DNA, 700 bp, Homo sapiens
  misc_feature: GYAE6OF01EW006.37.33.C11.1.454.CMB.1.raw
  modified_base (175)..(175): a, c, t, g, unknown or other
  misc_feature (175)..(175): n is a, c, g, or t
  modified_base (495)..(495): a, c, t, g, unknown or other
  misc_feature (495)..(495): n is a, c, g, or t
  modified_base (685)..(686): a, c, t, g, unknown or other
  misc_feature (685)..(686): n is a, c, g, or t
  modified_base (688)..(688): a, c, t, g, unknown or other
  misc_feature (688)..(688): n is a, c, g, or t
  modified_base (690)..(691): a, c, t, g, unknown or other
  misc_feature (690)..(691): n is a, c, g, or t
  modified_base (693)..(695): a, c, t, g, unknown or other
  misc_feature (693)..(695): n is a, c, g, or t
  modified_base (697)..(700): a, c, t, g, unknown or other
  misc_feature (697)..(700): n is a, c, g, or t
tcagtagtgtagatcacgaccggtgctcgatttagagtgagctcgttgggtttggggggtccctgagactctcctgtgcaacctctggattcagttgtagtgattggttggagtggggttcgggtcccgccgaggcctccgaggggaagggggctgggaggtggggtggccaaanaataaagcgagagtggaagcgaagaaatactatgtggactcgtggtggaggggccgtattcaccactcctccaacagaaccaacgaccaaagaaactacctaattttccgtttttagaacctaaaattacgaaacgtagttaccttaggaacggaggtaccggaagggaccgacgggccctagttagttactttacgtggtaacgaaggtaagaaacgaggtaccggttcgggggacccacggggtaacccctgggtaccaccgttcctcctacgaccgcctccgaaccgacgggcccctagtccgttccccttccccgnggcccacccgtgcctccggagaccgccgaccgtacccgacggacaccgaccgaccggccggcccgtcgggcctcggtccgtacgggtacgaacggtacccttccgttacctacgttaccaactaccgtacggtacggaccgggtaccgggtcgtaccgggacgtaacggggccgtaacgtagtaggcagnngngnngnnnannnn

SEQ ID NO: 57962 - DNA, 663 bp, Homo sapiens
  misc_feature: GYAE6OF01CJ8ID.37.33.C11.1.454.CMB.1.raw
  modified_base (510)..(510): a, c, t, g, unknown or other
  misc_feature (510)..(510): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggacgccaaatgtgacatccagatcgacccagtcctccttccaccctgtctgctatctggtaggagacagacgtcaccatcacgttcggcccggcaggtcggactagttcgtaccgtggttcgcctggtactacaaacgagaaaccgagggaaaccgaccccgtaaggtcctagatacgtagtcgactccgtaccctaccgtacgtttagggaacggtccgggtaccagttacgtaacggttacacggtaccgggctaggttagtacgtcgtacgggaactagtaacttctaccgtctaccaactacgtacgtagtaccgtccgtggacacgtcctagtcgttagttactttgtacctaatttacttactacgtanacgtactaacgtagtaacggtaggtacgtacggtccggacggtacggacgtaggtacgtagacgtaacgtaaaccgtcgtggtacccggtagtaaccggtaccgtacttacgttcgttaccgttaccttccggtacctttccccgtaaccccg

SEQ ID NO: 57963 - DNA, 737 bp, Homo sapiens
  misc_feature: GYAE6OF01A1IFN.37.33.C11.1.454.CMB.1.raw
  modified_base (514)..(514): a, c, t, g, unknown or other
  misc_feature (514)..(514): n is a, c, g, or t
tcagtagtgtagatcacgaccggtgctcgatttagagtgagctcggttggggtttgggggtcagactcagtcaggacacagcatggacatggacgggtcccccgctccagcctccgtggggcctccgtgctgcctcgtcggctacccgaggacgaccaaagtgtgaaccactaccaggactacgaaccccgtattcccttcccttcccacccttgtcctgacctattccgtaggtaaggacgaacacgacgtaccaacctacttccgtaccgttccggcccggaccgtaacggttcgtaaccttagttacggtaccgtggtacgtccgtaggtaacacaaggaaccgaaacggtaacggaaccacccgttagtcctagctactgtacgtctccgtcctcttaaggttaggaaccgtccggtacctaacgtacgtacgtcgacgccggaactgttagacgtggacgtacagtactacgtacctctacacgtagacttcggacgtcacgtacgtancggtattagtctttaacgttcgtaacctttaaacgtttcttaaacgttccttaacgaccttaaccgttaagttaacgtacggttaccggaggttaacccggttaaccggggccggtaacgggtaacgggttacgggacttaacgacggtaaaccgtacgtaaggtccgacggactcgtacccagttcgttcgtttagtaccctttactcccgtaacccgtccg

SEQ ID NO: 57964 - DNA, 624 bp, Homo sapiens
  misc_feature: GYAE6OF01EOL65.37.33.C11.1.454.CMB.1.raw
  modified_base (606)..(607): a, c, t, g, unknown or other
  misc_feature (606)..(607): n is a, c, g, or t
  modified_base (610)..(610): a, c, t, g, unknown or other
  misc_feature (610)..(610): n is a, c, g, or t
  modified_base (612)..(614): a, c, t, g, unknown or other
  misc_feature (612)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(623): a, c, t, g, unknown or other
  misc_feature (620)..(623): n is a, c, g, or t
tcagtagtgtagatcacgaccggtgctcgatttagagtgagctcgttgggtttgggggtccctgagactctcctgtgcaacctctggattcagttgtagtgattgttggatgggttgggtccgccaggctccgagggaaggggctggagtgggtggccaacataaagcgagatggaagcgagaaatactatgtggactctgtggagggccgattcaccatctccacacgacaacgaccaaagaaatcaattctttttgacaaatgaacagtctgagagtcgagacacggccatgtatactgtacgagagaacagacgttgggaccgacgggaacctggtccaccgtcctcctcacgtccctaccaaccgaacgggcccacgttcccggttcccttccccccgtcgccctacccccgtaccctaccggaacgtaccgacctaccgtccggtacggggccaccggacgcccgggcccgtcgggctcggcccgttcggtaccgaacggtacccttaccgttcccaacgttccgtaacctaacgttaccggttacggaccgggtccggggtcgtaccgggacgtaaccgggcgaccgtaagccgtgctgnngcncnnncncngnnnnc

SEQ ID NO: 57965 - DNA, 542 bp, Homo sapiens
  misc_feature: GYAE6OF01BW2QY.37.33.C11.1.454.CMB.1.raw
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(507): a, c, t, g, unknown or other
  misc_feature (504)..(507): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (515)..(516): a, c, t, g, unknown or other
  misc_feature (515)..(516): n is a, c, g, or t
  modified_base (518)..(519): a, c, t, g, unknown or other
  misc_feature (518)..(519): n is a, c, g, or t
  modified_base (523)..(524): a, c, t, g, unknown or other
  misc_feature (523)..(524): n is a, c, g, or t
  modified_base (526)..(526): a, c, t, g, unknown or other
  misc_feature (526)..(526): n is a, c, g, or t
  modified_base (530)..(531): a, c, t, g, unknown or other
  misc_feature (530)..(531): n is a, c, g, or t
  modified_base (534)..(534): a, c, t, g, unknown or other
  misc_feature (534)..(534): n is a, c, g, or t
  modified_base (536)..(538): a, c, t, g, unknown or other
  misc_feature (536)..(538): n is a, c, g, or t
  modified_base (540)..(540): a, c, t, g, unknown or other
  misc_feature (540)..(540): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaaagaaatcaatctttttgcaaatgaacagtctgagagtcgaggacacggccatgtattactgtacgagagaacagacgttggggccagggaaccctggtccaccgtctcttcacgcctccaccgaacgggcccagtccggtcctttcccccgtggcccgcccctgcctccgaggacgccaccctcggagcgaccacacggccggccctggggcctcggccgtcggtacgaacggtaccttaccgttccaacttcctaactacctacgtcggacggccgggtactcgggacgagggccncgtaagtacgnagntacngtcantacgtcngncnnnncncangcnncnncgcnncngctnntcngnnngntg

SEQ ID NO: 57966 - DNA, 689 bp, Homo sapiens
  misc_feature: GYAE6OF01EE84O.37.33.C11.1.454.CMB.1.raw
  modified_base (139)..(139): a, c, t, g, unknown or other
  misc_feature (139)..(139): n is a, c, g, or t
  modified_base (199)..(199): a, c, t, g, unknown or other
  misc_feature (199)..(199): n is a, c, g, or t
tcagtagtgtagatcacgaccggtgctcgatttagagtgagctcgttgggtttgggggtcagactcagtcaggacacagcatggacatggagggtccccgctcagctccgtgggctcctgctgctctggctcccaggancctaaatgtgacatccagatcgacctgtcctccttccacctgtctgctatctagtagganacagacgtccaccatcacgttcgccggcctaggtcgatagttacgtaccgtggttgccgtaggtactacaacgaacggaaaccgtaacgggaaacgtaccccgttaaggtcctaggtacttacgtagtcggtattcgtcccttaccgtacgtttagggaaacggtccggggtaccctagtccgtaaggttccgaaggcgtacgtagttagttactcggtaggaacgtaagtaacttcgtacctctaccaactactacgagtacgcctagacgtacgtccttagacgttagttacgtttacgtacttaaacttttacttacgtagtaccgaagtacctaagttagttaacgtagggtacgttacgtaccggggaccggtacgggtaccgtagggttacgaaagtaacgtaaccgaaaccgtacggtcggttagggacttcgaccctactaacgttccgttacgttaccttaccttcgttcccgtaaccccg

SEQ ID NO: 57967 - DNA, 620 bp, Homo sapiens
  misc_feature: GYAE6OF01EKEOZ.37.33.C11.1.454.CMB.1.raw
  modified_base (233)..(233): a, c, t, g, unknown or other
  misc_feature (233)..(233): n is a, c, g, or t
  modified_base (360)..(360): a, c, t, g, unknown or other
  misc_feature (360)..(360): n is a, c, g, or t
  modified_base (584)..(584): a, c, t, g, unknown or other
  misc_feature (584)..(584): n is a, c, g, or t
  modified_base (592)..(620): a, c, t, g, unknown or other
  misc_feature (592)..(620): n is a, c, g, or t
tcagtagtgtagatcacgaccggtgctcgatttagagtgagctcggttggggtttggggggaagaggaagactgacggtccgccaggctccaggggaaggggctggagtgggtgccaacataaagcgagatggaagcgagaaatactatgtggactcttggtggaggggccgattccaccatctccacagacaacgccaaagaaatctaatttcgtttttgacaaatgaaacncgtcgtggaagacgtcggacggacaccggcctattcgttattacgtaggtaacgagaacgaacgagtaccggttcgggggacccgaacggggtaacccttgggtacccacccgttccgttccctacnccgtaccccacccaaccggaaccgggccctacggtccccggttacccttcccccgtggccccgttccctcggcctccgagggactcccgaccgcggagacgacaccgacggtcccggtccgtcggccgttacgccgttacggactaaacggtccttacccttcgtaacttccctaacctacgtccgtacggtacgggccggacgtaccggacgaacggccgtanacgtacgnnnnnnnnnnnnnnnnnnnnnnnnnnnnn

SEQ ID NO: 57968 - DNA, 1006 bp, Homo sapiens
  misc_feature: GYAE6OF01EK9EA.37.33.C11.1.454.CMB.1.raw
  modified_base (102)..(102): a, c, t, g, unknown or other
  misc_feature (102)..(102): n is a, c, g, or t
  modified_base (120)..(120): a, c, t, g, unknown or other
  misc_feature (120)..(120): n is a, c, g, or t
tcagtagtgtagatcacgaccggtgctcgatttagagtgagctcgtttgggtttgggggtcagactcagtcaggacacagcatggacatggacgggtccccntcagcctcgtggcctccngctgctcgtgcctccgaggacaccaagttgtacactactaccgaagtactaccgacccttacttcccttaccccttcccgacccgttgtcctcgtactacgtttacgtaggtaacggaaccgactaacggtacctacctaaccgtaccgttaccgttaccggttcccggggaacccgggtaaccgttacgggttaccggttaacttttaacggtttaaccggttacccgggtttggggtttaccgtccggtttaaggtaaccctaaaccgaaaaccggtaaaccggaaaaccggggaaccggtaaaccccgttaccccgtttaaaggtccccttaggtaactttacttacgggtacgttacccggtaccccgttacccgtttaacgggtaaccggtttaaacggggacccgggttaccccgttaccttaaggttaacccggttacgggtacgtaccggacggttacgttacgggttagttaccccgttagggaaccggttactaaacgtttaacctccctaacccttaccgtaacctaacgtttaccgaacggttaccgttaccgaccccggttaggttaacccgtacgttaccggttaattttaccggttaacgtttttaccgttaacggtttaaaccctttttaagttaacccgttttacgttaacccgaacgttaacgttaaccttagggtttaaacgtcgggttacggtaaccggtttacccgggtacggggtaaccggttaacgggtacgggtaagggtttacgaaaaccgttacgggtaaaccccggaaaggtttccggtacgggtacctaccggttaccgaccctttacggtcttttacccgacgttttacccgttactttacccccgtccttaacccg

SEQ ID NO: 57969 - DNA, 687 bp, Homo sapiens
  misc_feature: GYAE6OF01B52GB.37.33.C11.1.454.CMB.1.raw
  modified_base (97)..(97): a, c, t, g, unknown or other
  misc_feature (97)..(97): n is a, c, g, or t
  modified_base (206)..(206): a, c, t, g, unknown or other
  misc_feature (206)..(206): n is a, c, g, or t
  modified_base (543)..(543): a, c, t, g, unknown or other
  misc_feature (543)..(543): n is a, c, g, or t
  modified_base (558)..(558): a, c, t, g, unknown or other
  misc_feature (558)..(558): n is a, c, g, or t
  modified_base (598)..(598): a, c, t, g, unknown or other
  misc_feature (598)..(598): n is a, c, g, or t
  modified_base (609)..(609): a, c, t, g, unknown or other
  misc_feature (609)..(609): n is a, c, g, or t
  modified_base (622)..(622): a, c, t, g, unknown or other
  misc_feature (622)..(622): n is a, c, g, or t
tcagtagtgtagatcacgaccggtgctcgatttagagtgagctcgttgggtttggggtcagactcagtcaggacacagcatggacatgaggtccccnctcagctccgtggggctcctgctgctctcggctcccgaggacaccaaagtgtagaactataccagatcgaccagtcctccttccgacctgtctgctatctaggtagganacagtagcacatctacttcggaccgcagtcggacttaagttacgttaccgtggttcgaccgttggtatactaaaacgaaggaaaacccgttaggggaaaccgtaccccgtaaaggttcccctagtaacggtactaagtacgtacctacgttaccctaaccttacggtttacggaaacgggtccgggttaccccaattccggaaagtttcacggaccggtgttaaagtcgtaacgtcggtacggaactaatacgttaacacttaccgtacaacccgattacggacttacgccgtagctacgacctagtacctagtctttagaccttaattattaccanacagtcaacgttaanaacggtggtactagtccggacgtacgtaaccggtaggganaccggttaaanccgaaataccggngtacggtctacggaccccaatttccggtccttaacgtttccctaacctggttcccctaacccggg

SEQ ID NO: 57970 - DNA, 578 bp, Homo sapiens
  misc_feature: GYAE6OF01BY9UJ.37.33.C11.1.454.CMB.1.raw
  modified_base (395)..(395): a, c, t, g, unknown or other
  misc_feature (395)..(395): n is a, c, g, or t
  modified_base (540)..(541): a, c, t, g, unknown or other
  misc_feature (540)..(541): n is a, c, g, or t
  modified_base (544)..(546): a, c, t, g, unknown or other
  misc_feature (544)..(546): n is a, c, g, or t
  modified_base (548)..(578): a, c, t, g, unknown or other
  misc_feature (548)..(578): n is a, c, g, or t
tcagtagtgtagatcacgaccggtgctcgatttagagtgagctcgttgggtccggccaggctccagggaaggggtctggagtgggtaggccaaacataaaagcgagatggaagcgagaaatactatgtggactctgtggagggccgattcaccagtctccacagaccaacgccaaagaaactcaattctttttgacaaatgaacagtctgagtagtcgaggaccacggccaatgtattactgtaacgagacgaacaggtacgttcggggccaaggggtaacccctggtaccaccggttcctcctcacgtccctccaaccgaaggggccccagtccggtccttccccccgaggcccgtacccctggcctcccggaggacgacctaaccgtcgaagncaacgacggccggacccgtggggaccttcggacccgttggggaacccgtaaacggtaccttaacccttcccgtaaatttccctaaaccgtacttacccgtagacgggtcgggtacgtcggaacggaacggcgtcaagtgactcanncgnnncnnnnnnnnnnnnnnnnnnnnnnnnnnnnnnn

SEQ ID NO: 57971 - DNA, 482 bp, Homo sapiens
  misc_feature: GYAE6OF01CB5Z8.37.33.C11.1.454.CMB.1.raw
  modified_base (291)..(291): a, c, t, g, unknown or other
  misc_feature (291)..(291): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (448)..(450): a, c, t, g, unknown or other
  misc_feature (448)..(450): n is a, c, g, or t
  modified_base (453)..(482): a, c, t, g, unknown or other
  misc_feature (453)..(482): n is a, c, g, or t
tcagtagtgtagatcacgaccggtgctcgatttagagtgagctcgttgggttgggtcccgccaggctccagggaaggggctgggagtgggtggccaacataaaagcgagatggaagcgagaaatactatgtggactctggtgaggggccgattcaccatctccacagacaacgccaagaaaatcaaatcttttgcaaaatgaaacagtctgagagtcgaggacacggccatgtaattactgtacgagagaacagacttggggccaaggaaccctggtcaccgtctcctcancctccaaccaagggccccaatcggtacctttccccctagggccgcccctcgctcccgaggacgccacctccgagagcacacgcggcctgggctgccgtggtacaaggactacgtccatctacactactagngcggtnggacaacggcgacaagtagnnntannnnnnnnnnnnnnnnnnnnnnnnnnnnnn

SEQ ID NO: 57972 - DNA, 780 bp, Homo sapiens
  misc_feature: GYAE6OF01A48MO.37.33.C11.1.454.CMB.1.raw
  modified_base (100)..(100): a, c, t, g, unknown or other
  misc_feature (100)..(100): n is a, c, g, or t
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (493)..(493): a, c, t, g, unknown or other
  misc_feature (493)..(493): n is a, c, g, or t
tcagtagtgtagatcacgaccggtgctcgatttagagtgagctcgttgggtttgggggtcagactcagtcaggacacagcatggacatgagggtccccgntcagctcctgggcctctgctgctactggcctcccaggagaccaaatgtgacatccagatcgacccagtctcctccacctgtctgcatctgtagganacagtacgcaacntactacgtcggccggactacggtacgaacttagttacggtaacgtgggtcgtccgtaggttactacaacgaagtaaaccgaaggaacgtaccgtacggtcagtactgtacgtgtacgtcgtccgttaccgtacggttttaagggaaaaccgggtcccgggtaactacgtacgttaacgggttacgacggaccggtacgtcgtaggttaccggtcggtaacggacgttaagtaacgtacccttaactcccttaacgaactaacgtaccgtaaacgtccgcgtacnccgtaacgtccgttagtaagttactttaacgttagttaaccctttaaatttactaagggtaacctaccgtacggtaacccttaaaggtacggttaaagggtccggttaaacgggtaccttaacgggggaacccgtaacggggttaacggttacggttaaccgggaataaaaccgttaacccgggaaaaaccggttagtacccgggttacgggttaacctacccggttaaagcccgtttaagttacctttcgttaaccccttacgttacccgttcccggttaaacccc

SEQ ID NO: 57973 - DNA, 619 bp, Homo sapiens
  misc_feature: GYAE6OF01BOGOW.37.33.C11.1.454.CMB.1.raw
  modified_base (544)..(544): a, c, t, g, unknown or other
  misc_feature (544)..(544): n is a, c, g, or t
  modified_base (559)..(559): a, c, t, g, unknown or other
  misc_feature (559)..(559): n is a, c, g, or t
  modified_base (566)..(566): a, c, t, g, unknown or other
  misc_feature (566)..(566): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(586): a, c, t, g, unknown or other
  misc_feature (585)..(586): n is a, c, g, or t
  modified_base (588)..(588): a, c, t, g, unknown or other
  misc_feature (588)..(588): n is a, c, g, or t
  modified_base (595)..(595): a, c, t, g, unknown or other
  misc_feature (595)..(595): n is a, c, g, or t
  modified_base (598)..(598): a, c, t, g, unknown or other
  misc_feature (598)..(598): n is a, c, g, or t
  modified_base (608)..(608): a, c, t, g, unknown or other
  misc_feature (608)..(608): n is a, c, g, or t
  modified_base (613)..(613): a, c, t, g, unknown or other
  misc_feature (613)..(613): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtggaggggccgattcaccatctccacagacaacgccaagaaatctaattctttttgacaaatagaacagtctagagagtcgaaggacacggccatgtattactgtacgagagaacagtacgttcggggaccgaacgggacccttggtaccaccgtctccctcaacgcccttcccaaccgtaacgggccccacgttccggtaccctttccccccggaggccccgtcccgtcgccgttcccgaacggtcgacccgtaaccctccgggaagacgaccgaacgacggacccggcccgtagggtcctggtccccgtgggtacctaaaacggtccctaacctttcccgaacttcgtaaaccctacttacggtcgacgggtccgggacttaccgggacgaacgggccggaataagtcganctagagctgcagtcngactcgntcgacgtancacgtnangnncngagtganacnacgtgacgtnacagntgngtn

SEQ ID NO: 57974 - DNA, 791 bp, Homo sapiens
  misc_feature: GYAE6OF01B14WI.37.33.C11.1.454.CMB.1.raw
tcagtagtgtagatcacgaccggtgctcgatttagagtgagctcgttgggtttggggtcagactcagtcaggacacagcatggacatggacgggtccccgctcagctccgtgggctcctgctgctctggctcccaggagccaaatgtgacatccagatgacccagtctccttccgaccctgtctgctatcgtgtaggacgacgtagacgtcaaccataccgtacgttcggccggcctacgtacggtacttaacgttacgtaccgttcggttacggccgtacggtactacaaaaccgaagaaaacccgaacgggaaaccgtacccccgttaaggtacctaggtacttacgtatacgtacgttcgtcccttaccgtaacggttttagggaaaacggtccggggttaaccctaacggttaccgtaaacgggttccgaacggtaccggtcgtaacggtacgtttaaagttcggtacggaaacgtaaacggttaactttaccgtaaccttacccgtaacgtaacctacgtaccgtaacggtaaccgccgtacgacgtacggtccgtagtaagttacggttaacttttacgaacttaaactttttatacgtacgttaacgacgtactaacgtaaacgttaaaggcgggtaacgtacgggttaccgggaaccgggtaacggggtaccggtaagggttacgaaacgttaaccgaaacggtaaaacgttacggtcggtaaacgccgtaacgacctaaccgttacttacgtttcgaccttttcgacttccccgttaacccg

SEQ ID NO: 57975 - DNA, 856 bp, Homo sapiens
  misc_feature: GYAE6OF01AJGRG.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccagtggaagttggggctgagtcgttcgggtttttccttgttgcttattttagaggtgtcctagtgtaggaagtgcaggcgtgggtcggtacgtccggtgggggacggtccgttcgggtcccaggtcccggtcggggggtcccctggacggtaccttctccgtgtcgctacccgtcgttaggtacttcgtacggttaggttaggtggtagtttggttagggtacggttgggggtttcggggttcccgcccgaggggtcctaccggggaggggtaacggggtccggtaggggtacgggtcggggtccggacccgaaagtaagggtaaacgtacggaagaagggtaggaaacgcggtaaaacgtaaacgttacgttaggtcgggttacggtaaccgttcggttcggtacggggtaaccgggtacctttacgttaacccacccgtacttaccccgtaccgaaaccgtaaacggaacccaaacggtaaaccaaacgtaaacttaacctaagttttcctttacggaaaccctaaggaaacgtaaccgtttacgtacgtacggtaacgtacggttaccggaaaccggtacggtaccggttaactaggtttacccgttagttaaaccgttcgggtaaacggttacgaaacggtaccgaacgggttacggtaaccggggggtacccgttaaacccgggaccccggtttaccggtcccgtaaccccggtcccgg

SEQ ID NO: 57976 - DNA, 871 bp, Homo sapiens
  misc_feature: GYAE6OF01CBJBK.37.33.C11.1.454.CMB.1.raw
  modified_base (107)..(107): a, c, t, g, unknown or other
  misc_feature (107)..(107): n is a, c, g, or t
  modified_base (171)..(171): a, c, t, g, unknown or other
  misc_feature (171)..(171): n is a, c, g, or t
  modified_base (213)..(213): a, c, t, g, unknown or other
  misc_feature (213)..(213): n is a, c, g, or t
tcagtagtgtagatcacgaccggtgctcgatttagagtgagctcggtttggggtttgggggtcagactcagtcaggacacagcagtggacagtggacgggtcccccntcacgtctccggtgggcctcctgcgtgctcgcggcctcccgagacgacctaagtcggtacaacncgtaccgagtacctaccgaccctacgttccctcccttacccncccttgttcgtcgacttacgtcggtacggtaacggaaccgtaactacggtacgtacccgaaccttcgtaccgttacccgggttcggacccgggtactacgggtaaccgtttaacgttacgttaccgggtccggtcggtttacggtccgttaacggtaaccgtaaccgaaaacgtaaaccggaaacggtaacccgggtaaccgtaccgttaacggttcctaagactttcggtacgtacgtaccgtccccgtaacttacccggtaaaggggttaaccggacccggggttacccggttaacaacgtttacccgggtagttaccgggccgtacggtacggttaacgtcgttacggttaccggaagtaccggtaacttacgtcccgtctaaccgccaaacgttcggtaacacgtacgtacgtccgacgttacgcgttaacggtcgttacttacgtaccgttaattaccgtttacttaacgtcgtaaccgtacgttaacgtagttaaggtcggtaacggtaccggtacgggtcggtaaccgggtaggttaccggtacggtacgttaacgaaccggtacgttaaaggtcggtacgtaggtaaccttcgtaaccgtaccgtttacaccgtttacgttacccgttaccgttcccgttaccgtacccg

SEQ ID NO: 57977 - DNA, 803 bp, Homo sapiens
  misc_feature: GYAE6OF01C0RUJ.37.33.C11.1.454.CMB.1.raw
  modified_base (103)..(103): a, c, t, g, unknown or other
  misc_feature (103)..(103): n is a, c, g, or t
  modified_base (608)..(608): a, c, t, g, unknown or other
  misc_feature (608)..(608): n is a, c, g, or t
  modified_base (792)..(792): a, c, t, g, unknown or other
  misc_feature (792)..(792): n is a, c, g, or t
tcagtagtgtagatcacgaccggtgctcgatttagagtgagctcggttggggtttggggggtcagactcagtcaggacacagcatggacatgacgggtccccnctcagctccgtgggctcctgctgctctggcctcccgaggacacctaaatggtagaactactaccgagtacgtcgaaccctagttccctcccttacccaccccgttgttcctacgtacctacgttacgtagggtaacgggacgaacgtaacgacgtaccaaccgtacttaccgtacgttccgggccgggaccgtacggtacggtacttacgttcggtaccgttggttcgtccgtaggtaactacgaaacgaaacggaaaaccggtaacgggaaaccgtaccccggttaaaaggtcctacgtaacttaccgtagtcggtaacgttccgacccttaccggtttacggttaaggggaaccggtccgggttaacccaagttaccggtaaggggtaccacgggtacggacgttacgggttacgtacgttagggtaaccggtaactaaacgtaacgtttcccaaccgttccctaacaccctaacgtacgtacgtaacgtctacgcgaccgtntagtgttacgttacgttactacctttaacttacgtacgtactacgtaaccgtacttaacgtaggtacgtaaggtaccggttacgtccggggaacggaccggttaaggtggtaacgacgtaaccgaacgtaacggacgtcgacggtcgactaccgtacgtacttcggttacttactcgtttcccnccgtttacccg

SEQ ID NO: 57978 - DNA, 912 bp, Homo sapiens
  misc_feature: GYAE6OF01C1IRW.37.33.C11.1.454.CMB.1.raw
  modified_base (102)..(102): a, c, t, g, unknown or other
  misc_feature (102)..(102): n is a, c, g, or t
  modified_base (196)..(196): a, c, t, g, unknown or other
  misc_feature (196)..(196): n is a, c, g, or t
tcagtagtgtagatcacgaccggtgctcgatttagagtgagctcggttgggtttgggggtcagactcagtcaggacacagcatggacatgacgggtccccgntcagctcctggggctcctgctgctctggctcccgaggacgacctaaatgcgacactccaagactacgaccagtcctccttccacccgtgtcctncattcgtaggtaggacgacctaagactcaacctattaccaacgttcgggacccgggactacggtacggaacttaacgttaacgttaccggttggttcggtccgtaaggtaactaaccgaaacgaaacgaaaaccgaaacgggtaaccgtaccccgtaagttaccgacgtaacttacctagacgtaacgtccgtaccctaacgtttacggttaaggggaaaccggtaccccggggttaaccaacgttaacgggtaaacgggttaccgacgggtaacggtacttaaacgggttacggtaacgtaaccggttaggggtaaacctaaaacgggtacctttaacccggaaccctttaacccgtaacctaaaaccggttaacctaaccgttaaacgggtacgttaacccggtacgaacgttaccggtaaccttggtaaacgttaacgggttaactttaacgtaacgtttaaaccgttaacttaacgtaacgttaccgaacttaaccggtaacttaaacggttaaaggtacgggtaacggtaaccgggttacccgggaaacgggttaacgggtaaccgggttaagggttaacccggtaaaacgtaaacccgtaaaccggttaaaaccggtacggtaaccgggtagggtaaccctaacggtaaccctaacgtaaccgtttacctaacggttcccttaaaccgtacccgttcccgtttaaacccc

SEQ ID NO: 57979 - DNA, 835 bp, Homo sapiens
  misc_feature: GYAE6OF01DGDRX.37.33.C11.1.454.CMB.1.raw
  modified_base (101)..(101): a, c, t, g, unknown or other
  misc_feature (101)..(101): n is a, c, g, or t
  modified_base (528)..(528): a, c, t, g, unknown or other
  misc_feature (528)..(528): n is a, c, g, or t
tcagtagtgtagatcacgaccggtgctcgatttagagtgagctcgttgggtttgggggtcagactcagtcaggacacagcatggacatgacgggtccccgntcagctccgtgggctcctgctgctctgcctacccgaggacgaccaaatgtagacataccagactcgaccctagtccctcccttccacccttgtctcgaccattcgtaggtacggagacgaaggtactaccctacccgattacccgtacgttccgggacccgggtactacggttcgtaacttaagttaccgttaccgttggttcggccttaggtaactacaaacgaaacggaaaccgaacggggaaaccgaccccgttaaaggtcctagacttacgtagtacgactcgtcccttacgtacgtttacgggaaccggtccggtacctaagtacgaacggttcgaggtccgtacgtaggttacgtaacgtcggtaggaactaacgtaaccttaccgtaccgttacctcaccgtactacgacgtccgtaccnggaccgttacgcgtagttagttaacgtttagttaccttaacgtttaacttttaccgtaacttcggtaaccttaacggttaacccttaaagtttaacgggtaacggtacggggttaaccgttaaccggggtccggggtaaacccggggtaacgggttaaccggggttaggggttaacgaaacggttaaaaccgtaacccgggtaaacggttacggtaacgggttccgtacccggttagtaaccccttaccttagggttaccccgttttacgttccccgttaacctaccggttttccccccttaaccgg

SEQ ID NO: 57980 - DNA, 753 bp, Homo sapiens
  misc_feature: GYAE6OF01B1XK4.37.33.C11.1.454.CMB.1.raw
  modified_base (102)..(102): a, c, t, g, unknown or other
  misc_feature (102)..(102): n is a, c, g, or t
  modified_base (192)..(192): a, c, t, g, unknown or other
  misc_feature (192)..(192): n is a, c, g, or t
tcagtagtgtagatcacgaccggtgctcgatttagagtgagctcggttgggtttgggggtcagactcagtcaggacacagcatggacatgagggtcccccgntcagctccgtggggcctcctgctgctctggacctccaggagaccaaagtgtgacatccagagtcgacccagtcctccttcccacctgtcngctatcgtaggtagacgacgagactccacatcctacgtcggacccggtccgacggtcggattacgttacgttaccggttgggttcggccgttaggtaacctaccaacgaaaccggaaaaccgaacggggaaaccctaccccggttaaacggttccgtaggtaacttccgtaagagttaacctccgtacccttaccgttaggttaccgggaacgggtccggttacccagttacgtacggttcgacgggccgtagtgtacgtagtcggagaactagtacttacacttccgacctacgactaccgagtaccgtccgtcgacgtaccgtcttacggtagttactttaagtttacctaacttaaccttttagtacctgtaaccgtaagttaccttaaccgtaacggttggtaacggggtaaccggttccgggtaaccgggaccgggttaacgggacccggttagggactaacggtaagttaacccgaaacgggttgaccggggtctacgtccaaccgttacctgtttaacccggttcttacgtttaacctcccgttacccgtcccg

SEQ ID NO: 57981 - DNA, 852 bp, Homo sapiens
  misc_feature: GYAE6OF01BJ5RJ.37.33.C11.1.454.CMB.1.raw
  modified_base (101)..(101): a, c, t, g, unknown or other
  misc_feature (101)..(101): n is a, c, g, or t
  modified_base (141)..(141): a, c, t, g, unknown or other
  misc_feature (141)..(141): n is a, c, g, or t
tcagtagtgtagatcacgaccggtgctcgatttagagtgagctcgttgggtttgggggtcagactcagtcaggacacagcatggacatgacgggtccccgntcagctccgtgggctcctgctgctctggcctcccgagganccaaatgtgacatccagactcgacccagtcctccttccacctgtctgactatctggtagacgactagacgtaccacctatccgtaacgttcggacccggtacctaggtaccggtacttaagttacgttaccgtggttacggccgtaggtaactacaaacgaacgtaaaaccgaacgggtaaaccgtaccccgttaaggtccctagtaacttacgtaacgtacgtaacgtccgtacccgttaaccgttaaggtttaaccgggaaaacggtcccggggttaacctacgttaaccggtaaggttaccgaacgggtacggtaaccttaaggttacgttaacgtaccggttaagggaaacctaacggttaaacttccctaaccgttacctaaccgtaaacctattaccggtaaacgtaccgtacccgtacggtaccgtaccggtaacgttagtaaacgtttacgtttaacgttttaacgtaaccctttaacgtttaactttaaccgttacgtaccgtaacgtaacttaaaccgttaagttaaaggtaccgggtaacggttaccgggtaaccgggtacgggaacgggttaacccggtaagggttaacgaacggttaaacgtaaaccgtaaaacggtcggtacggttaggtaccgtaccgaacccgtaaccgttacttaccggttacttacccttacgttaccgtcccgttaaccccg

SEQ ID NO: 57982 - DNA, 678 bp, Homo sapiens
  misc_feature: GYAE6OF01A6I3H.37.33.C11.1.454.CMB.1.raw
  modified_base (299)..(299): a, c, t, g, unknown or other
  misc_feature (299)..(299): n is a, c, g, or t
  modified_base (438)..(438): a, c, t, g, unknown or other
  misc_feature (438)..(438): n is a, c, g, or t
  modified_base (658)..(658): a, c, t, g, unknown or other
  misc_feature (658)..(658): n is a, c, g, or t
  modified_base (661)..(661): a, c, t, g, unknown or other
  misc_feature (661)..(661): n is a, c, g, or t
  modified_base (666)..(666): a, c, t, g, unknown or other
  misc_feature (666)..(666): n is a, c, g, or t
  modified_base (668)..(678): a, c, t, g, unknown or other
  misc_feature (668)..(678): n is a, c, g, or t
tcagtagtgtagatcacgaccggtgctcgatttagagtgagctcgttggggtttgggggggtccctgagactctcctgtgcaacctctggattcagttgtagtgtatttggttggagttgggggtttgggtcccgccgaggcctcccgaagggggaacggggggctggggaggttgggggtcggaccaaacaagtaaaaggcgaagagtgggaagacgaagaaattactatggtaggacttgtggtggacggggcctaattccaccatccaccaaacgaacgaaccgaacaacgaaaanactacttattttactacaaatagaacgatacgtagagacggtacgacggaccgacgacgtactagtattacgtagagaacggaagaacgagtcggtacggggaccggaccggtaccggtcgtaccgtaccgtccgtccncctacgcccgtaccgaaccgaaccggaccgtccgtccggttcccctccccggtccgccgccctcgccgtccgacgaccgccgaccgtaccgagacgccgacgacggtcccggccgtcggcgtaccgtccgtacggtacgaaccgttacctaccttactacccacgtaacctcgtacggtaccggacgggtcgggtacggtacgaccgacggacgtcgagnacngctancnnnnnnnnnnn

SEQ ID NO: 57983 - DNA, 816 bp, Homo sapiens
  misc_feature: GYAE6OF01BM8X4.37.33.C11.1.454.CMB.1.raw
  modified_base (103)..(103): a, c, t, g, unknown or other
  misc_feature (103)..(103): n is a, c, g, or t
tcagtagtgtagatcacgaccggtgctcgatttagagtgagctcgtttggggtttgggggtcagactcagtcaggacacagcatggacatggagggtcccccnctcagcctccgtggggcctcctgctgcttctcggcctcccgagggacgaccaaatgtagaactactccaaggacttacgaccctacgttcccttcccttccctacccctgtcctcgactacttcgtggaaggagaactagtactacaccctactcctacgttcggcccgggaccacggtacgacttattacggtaccgttgggtcgtccgtaggtaactacgaaacgaacggaaaccgacggggaaaccctcccgtaacggtacctagtaacttcctagtcgtacgtacctaccgtttacctaacggttacggggtaaccggtcccggtacctaagtaccgtaaggtaccgacgggcgtacgaggttacgtacgttaccggacgggtaacgaacttacgtttccaacccttacctaacccgtaacccgtaacgtttacggtaaccgtaccggtaccgtaccggtaccgtaccggttacgttacgttaaacgtttcggtttaacgttttaacccgttaactttaaccttttaacgtttacgttacgttacgtacgtaacttaacgtaacgttaagggtaacggttacggtacgggttaccgggacgggtaacgggtaccggtagggttacgtacggtaactaccgtaaacgtcgtaacggtcgtacgtctaccgtacctacgttctcttaccgttcttcccgttcccgttaccc

SEQ ID NO: 57984 - DNA, 464 bp, Homo sapiens
  misc_feature: GYAE6OF02F8Q2A.37.33.C11.1.454.CMB.1.raw
  modified_base (459)..(464): a, c, t, g, unknown or other
  misc_feature (459)..(464): n is a, c, g, or t
tcagtagtgtagatcacgaccggtgctcgatttagagtgagctcgttgggtccgccaggctccagggaaggggctggagtgggtggccaacataaagcaagatggaagtgagaaatactatgtggactctgtgaagggccgattcatcatctccagagacaacgcccagaactcattgtatctgcaaatgaacagactgagagccgaggacacggctgtgtattactgtgcgagagaggaggcgattagtgtaaatggctgggccttctactactactactacatggacgtctggggcaaagggaccacggtcaccgtctcctcagcctccaccaagggcccatcggtcttccccctggcaccctcctccaagagcacctctgggggcacagcggcctgggctgcctggtcaaggctacttccatctacactactgagcgggctggcaaggcgcatagnnnnnn

SEQ ID NO: 57985 - DNA, 439 bp, Homo sapiens
  misc_feature: GYAE6OF02G4GXP.37.33.C11.1.454.CMB.1.raw
  modified_base (435)..(439): a, c, t, g, unknown or other
  misc_feature (435)..(439): n is a, c, g, or t
tcagtagtgtagatcacgaccggtgctcgatttagagtgagctcgttgggtttggggaagaggaagactgacggtccgccaggctccagggaagggctggagtgggtggccaacataaagcgagatggaagcgagaaatactatgtggactctgtgaggggccgattcaccatctccacagacaacgccaagaaatcaatcttttgcaaatgaacagtctgagagtcgaggacacggccatgtattactgtacgagagaacagacttggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnn

SEQ ID NO: 57986 - DNA, 490 bp, Homo sapiens
  misc_feature: GYAE6OF02GA1VO.37.33.C11.1.454.CMB.1.raw
  modified_base (309)..(309): a, c, t, g, unknown or other
  misc_feature (309)..(309): n is a, c, g, or t
  modified_base (409)..(409): a, c, t, g, unknown or other
  misc_feature (409)..(409): n is a, c, g, or t
tcagtagtgtagatcacgaccggtgctcgatttagagtgagctcgttgggtttggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctgttgcctggtatcaacagaaaccagggaaagcccctaaaggtcctgatctatgatgcctcactttggaaancgggtccatcaaggttcagcggcagtgtatctgggacagaaattcactctcaccatcagtagcctgcagcctgatgattttgcaacttattactgtcagnactataataggagatgtcgaggacgaggtgagatacaaacgaaactagtagcgtgcaccaactactgtcttctatattccc

SEQ ID NO: 57987 - DNA, 429 bp, Homo sapiens
  misc_feature: GYAE6OF02IC8NI.37.33.C11.1.454.CMB.1.raw
  modified_base (422)..(429): a, c, t, g, unknown or other
  misc_feature (422)..(429): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcactgtctcctcagcctccaccaagggcccatcggtcttcccccctggcgcccctgctccaggagcacctccgagagcacacgcggccctgggctgcctggtcaaggactacttccatctacactactgagcgggctggcaaaggcgcatagnnnnnnnn

SEQ ID NO: 57988 - DNA, 523 bp, Homo sapiens
  misc_feature: GYAE6OF02G1G29.37.33.C11.1.454.CMB.1.raw
  modified_base (401)..(401): a, c, t, g, unknown or other
  misc_feature (401)..(401): n is a, c, g, or t
tcagtagtgtagatcacgaccggtgctcgatttagagtgagctcgttgggtttgggggttcgaggactcagtcaggacacagcatggacatgagggtccccgctcagctcctgggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtccatcaaggttcagcggcagtgtatctgggacagaattcactctcaccatcagtagcctgcagcctgatgatttgcaattntacttgtcagctactattaaagtgggatatttcgggaccgtaggggaccctaagggttgagattacaaacggtaactggtggactggaccaccattcctaggttccttcgtatccttccccg

SEQ ID NO: 57989 - DNA, 508 bp, Homo sapiens
  misc_feature: GYAE6OF02GVPOE.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccaggatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcggggtcccatcaaggttcagcggcagtgtatctgggacagaattcactctcaccatcagtagcctgcagcctgatgattttgctaacttattactgtcagcaactataatgggagattcggccgagggaccgagggttgagatacgaaacgaacgtggtaggctgccactatctgtcttcacttcttcccg

SEQ ID NO: 57990 - DNA, 516 bp, Homo sapiens
  misc_feature: GYAE6OF02JC28I.37.33.C11.1.454.CMB.1.raw
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtctccttccaccctgtctgcatctgtaggagacagagtcaccatcacttgccgggccagtcggactattagtacctggttggcctggtatcaacagaaaacagggaaagcccctaaggtcctgatctatgatcgcctcacttggaagcgggtccatcaaggttcagcgcagtgtanctgggacagaattcactcncaccatcagtancctgcagcctgatgtatttgactaacttattactgtcagcacttataagtgggagtagttcggaccggagggtacctagggttgagatacgaaacgtacgtggtaggctggccacgtattctgttcttctacttccttaccccg

SEQ ID NO: 57991 - DNA, 510 bp, Homo sapiens
  misc_feature: GYAE6OF02HFRJI.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccaggatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctcactttggaagcgggtccatcaaggttcagcggcagtgtatctgggacagaattcactctcaccatcagtagcctgcagcctgatgtattttgctaacttattactgtcagctactataagtgggagattcgggaccgagggaccgagggttgagactacgaaacgacgtggtaggctgacaccgatcgtgtcttctattcctcccg

SEQ ID NO: 57992 - DNA, 577 bp, Homo sapiens
  misc_feature: GYAE6OF02J3KYF.37.33.C11.1.454.CMB.1.raw
  modified_base (195)..(195): a, c, t, g, unknown or other
  misc_feature (195)..(195): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccacctgtctgcatctgtagganacagacgtcaccatcacttgccggcagtcgactatagtacctggttgcctggtatcaacagaaaccgagggaaacgccctaaggtcctgactctatgatgcctacactttaggaacgcgggtacccagtcgaaggttcagtcggactagtacgtacgtcgtagggaacagtaacttcactctacacatcaagtcgctgcacgtcctagacgttagttactttacgaacttaactttacttacgttacgactactactaacgttagtaggtaggtacgtacggttaccgggaccggtacgggtaccggtaggtacgagtaacctacgaaacgtcgtcggtcgactacgacctatacgttcacgttctacctcttacccgtacc

SEQ ID NO: 57993 - DNA, 494 bp, Homo sapiens
  misc_feature: GYAE6OF02GOAAG.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtccatcaaggttcagcggcagtgtatctgggacagaattcaactctcaccatcagtagcctgcagcctgatgattttgcaactttatactgtcagcaactataatgggagattcggccgagggaccagggttgagatacaaacgaactgtaggctgcaccatctgtctcatctcccg

SEQ ID NO: 57994 - DNA, 509 bp, Homo sapiens
  misc_feature: GYAE6OF02F7W0O.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacagtccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcggcagtgtatctgggacagaattcactctcaccatcagtagcctgcagcctgatgtattttgactaacttattactgtcagctactataagtgggatacgttcggaccgtagggaccagggttgagatacgaaagtacgtggtggctgcctacatctgtcttcacttcctcccg

SEQ ID NO: 57995 - DNA, 496 bp, Homo sapiens
  misc_feature: GYAE6OF02JCZ4G.37.33.C11.1.454.CMB.1.raw
  modified_base (470)..(470): a, c, t, g, unknown or other
  misc_feature (470)..(470): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcggggtcccatcaaggttcagcggcagtgtatctgggacagaattcactctcacatcagtagcctgcagcctgatgattttgctaacttattactgtcagcacttataagtgggagtattcggccgagggaccagggttgagatcaaacgactgngctgcaccatctgtcttcatctcccg

SEQ ID NO: 57996 - DNA, 420 bp, Homo sapiens
  misc_feature: GYAE6OF02HRWX4.37.33.C11.1.454.CMB.1.raw
  modified_base (418)..(420): a, c, t, g, unknown or other
  misc_feature (418)..(420): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnn

SEQ ID NO: 57997 - DNA, 496 bp, Homo sapiens
  misc_feature: GYAE6OF02GHR47.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtccatcaaggttcagcggcagtgtatctgggacagaattcactctcaccatcagtagcctgcagcctgatgtattttgctaactttattactgtcagcactataatgggagtagttcggacgagggaccagggttgagatacaaagtactgtgctgacacatctgtcttcactctcccg

SEQ ID NO: 57998 - DNA, 530 bp, Homo sapiens
  misc_feature: GYAE6OF02H6XG3.37.33.C11.1.454.CMB.1.raw
  modified_base (311)..(311): a, c, t, g, unknown or other
  misc_feature (311)..(311): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctcactttggaancgggtccatcaaggttcagcggcagtgtatctgggacagaattcactctcacatcagtagcctgcagcctgatgattttgctaacttattactgtcagcaactataactgggatagttcgggaccgtaaggggacctagggttagaagatacgaaacggtaacgtggtacggtctcgtaccaccgtatccgtgttaccttactacttcctttacccccg

SEQ ID NO: 57999 - DNA, 524 bp, Homo sapiens
  misc_feature: GYAE6OF02GEN9B.37.33.C11.1.454.CMB.1.raw
tcagtagtgtagatcacgaccggtgctcgatttagagtgagctcgttgggtttggggtcagactcagtcaggacacagcatggacatgagggtccccgctcagctcctggggctcctgctgctctggctcccaggagccaaatgtggacagtccaaggatgaccctagtctccttccaccctgtctgcatctgtaggagacagagtcaccatcacttgccgggccagtcggactattagtacctggttggcctggtatcaaacagaaaccagggaaagcccctaaggtcctgatctatgatgcctcactttggaagcgggtccatcaaggttcagcggcagtgtatcgtgggacagaattcactctcaccatcagtagcctgcagcctgattgtattttgactaacttattactgtcagtctactataagtgggagtagttcggccgagggtaccagggttagagatacgaaacgtacgtggtagcgtagaccacgtatcttgtccttctacttccgttccccg

SEQ ID NO: 58000 - DNA, 499 bp, Homo sapiens
  misc_feature: GYAE6OF02GH83V.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggccagtcggactattagtacctggttggcctggtatcaacagaaaccagggaaagcccctaaggtcctgatctatgatgcctccactttggaaagcggggtcccatcaaggttcagcggcagtgtatctgggacagaattcactctcaccatcagtagcctgcagcctgatgattttgctaacttattactgtcagctactataatgggagagttcggcgagggaccagggttgagatacgaaacgaactggaggctgcaccatctgtcttcatccttcccg

SEQ ID NO: 58001 - DNA, 550 bp, Homo sapiens
  misc_feature: GYAE6OF02HIY6W.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacatccagatgacccagtctccttccaccctgtctgcatctgtaggagacagagtcaccatcacttgccgggccagtcggactattagtacctggttggcctggtatcaacagaaaccagggaaagcccctaaggcctgatctatgatgcctccactttggaaagcggggtcccatcaaggttcagcggcagtgtatctgggacagaattcactctcaccatcagtagcctgcagctgatgatttgctaattattactgtcagtcacttataagtgggagtagttcggaccggtaggggacccgagggttgaagtatacgaaacggtacgttggtacggacgttacggacctaacccgtaacttccgttacggttcctttacgtactttcccgttaccccgg

SEQ ID NO: 58002 - DNA, 541 bp, Homo sapiens
  misc_feature: GYAE6OF02JRGSJ.37.33.C11.1.454.CMB.1.raw
  modified_base (384)..(384): a, c, t, g, unknown or other
  misc_feature (384)..(384): n is a, c, g, or t
  modified_base (424)..(424): a, c, t, g, unknown or other
  misc_feature (424)..(424): n is a, c, g, or t
  modified_base (485)..(485): a, c, t, g, unknown or other
  misc_feature (485)..(485): n is a, c, g, or t
  modified_base (506)..(506): a, c, t, g, unknown or other
  misc_feature (506)..(506): n is a, c, g, or t
  modified_base (529)..(529): a, c, t, g, unknown or other
  misc_feature (529)..(529): n is a, c, g, or t
tcagtagtgtagatcacgaccggtgctcgatttagagtgagctcgttgggtttgggggttcgtagactcagtcaggacacagcatggacatgagggtcccgctcagctcctgggctcctgctgctctggctcccaggagccaaatgtgacatccaggatgacccagtctcttccacctgtctgcatctgtagagacagagtcaccatcacgttgccgggccagtcggactattagtacctggttgcctggtactcgaacagaaaccaggaaacgcccctaaggtcctagatccgtaatcgatcgcctccactttggaaacgcgggtcagtcaaggttcagtcgactgtgtatccgtagggactagaattcgaactcgtcacctntacagttagccctagcagcctgatcgtatttgctaacttntacctgttacagtactactataagtcgggagtacttccgggcgtaacggacgtagggttanacgtatcgaaaaccgtgtggngcgtcacgtacatctgtaccttnacgtccttaccg

SEQ ID NO: 58003 - DNA, 551 bp, Homo sapiens
  misc_feature: GYAE6OF02H6A7W.37.33.C11.1.454.CMB.1.raw
  modified_base (347)..(347): a, c, t, g, unknown or other
  misc_feature (347)..(347): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccaaggatgacccagtctccttccaccctgtctgcatctgtaggagacagagtcaccatcacttgccgggccagtcggactattacgtacctggttggcctggtatcaacagaaaccagggaaagcccctaaggtcctagatctatgatgcctcactttggaaagcgggtccatcaaggttcagcgcagtgtanctgggacagaacttcaactctcaccatacagtacgcctgcagcctagatcgtatttgactaactttattactgtctaagctaacttataagtgggatacgttcgggaccgtagggaccgtagggttcgaagtactacgaaacggtaacgtggtacggacgtcgtaccacgtatcgttcgttaccttctaccgttccttaccccg

SEQ ID NO: 58004 - DNA, 494 bp, Homo sapiens
  misc_feature: GYAE6OF02G8BVS.37.33.C11.1.454.CMB.1.raw
  modified_base (313)..(313): a, c, t, g, unknown or other
  misc_feature (313)..(313): n is a, c, g, or t
  modified_base (478)..(494): a, c, t, g, unknown or other
  misc_feature (478)..(494): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcctcccctggccnccctgcctccgaggacgccacctccgagacgccaacgacggccggtccccgtggggcctcggcccgttgggtaccgaaaacgggtaccttaccgtttctaacttcctaaccacctttaactggaacggccggggtctcgggaccgaaagggccgacaagtacggnnnnnnnnnnnnnnnnn

SEQ ID NO: 58005 - DNA, 613 bp, Homo sapiens
  misc_feature: GYAE6OF02J1OP2.37.33.C11.1.454.CMB.1.raw
tcagtagtgtagatcacgaccggtgctcgatttagagtgagctcgttgggtttgggggttcgtaggactcagtcaggacacagcatggacatgagggtcccgctcagctcctgggctcctgctgctctggctcccaggagccaaatgtgacatccagatgacccagtctccttccacctgtctgcatctgtaggagaccagacgtcaccatccacttcggcccggggccaggtccggacttattacgtaccttggttggcctggtactacaacaacgaaaccgaacgggaaacgtttttacccgaacggtacctagactactatagtactgcctcctactttacggaaacggtccggggtacccagtaccgtaacggttcgaacggtcggcgtagtcgtagtacgtggacagacttcgactctacactatacagtacgctacgcacgctgtactcgtatttagacttaacttattacgttactcctaagctaactataagtaggtacgtacgttacggacggtacgggtaccgtagggttagacgtaactacgaacgtacgtggtacgcgtacgtacacgtacttcgtacgttacgtactacgtccttacccg

SEQ ID NO: 58006 - DNA, 607 bp, Homo sapiens
  misc_feature: GYAE6OF02G94VQ.37.33.C11.1.454.CMB.1.raw
tcagtagtgtagatcacgaccggtgctcgatttagagtgagctcgttggggtttggggggtcagactcagtcaggacacagcatggacatgacgggtccccgctcagctcctggggctcctgctgctctgggcctcccaggagccaaagtgtggacagtccagatgacccagtctccttccaccctgtctgcatctgtaggagacagacgtcaaccagtccacgttcgaccgggccaggtcggacttagttagtaccgtaggttcgtccttggtatcaacaagaaaccgagggaaacgccccgtaaggtcctagactctatagactcgacctcctacgtttaggaacggtccgggtacccagtcgaacggttcagcggactagtgtatcgtagggacagtaacgttcactctacaccatcagtacgctgacaggtctagtatgtatttcgacttaattatttactgtacagtactagttataagtagggactacgttaccgggaccggtacgggaccgtagggttagacgtacgtacgaaacggtacgtggtacggtactacgaaccgtacgtagttccgtgttccttactaccttccgttaccccg

SEQ ID NO: 58007 - DNA, 513 bp, Homo sapiens
  misc_feature: GYAE6OF02ISNPQ.37.33.C11.1.454.CMB.1.raw
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctccccaggagccaaatgtgacatccagatgacccagtctccttccaccctgtctgcatctgtaggagacagagtcaccatcacttgccgggccagtcggactatagtacctggttggcctggtatcaacagaaaccagggaaagcccctaaggtcctgatctatgatgcctccactttggaaagcggggtcccatcaaggttcagcggcagtgtatctgggacagaattcactctcaccatcagtagcctgcagcctgatgtattttgactaacttattactgtcacgcactataatgggatagttcggcgagggacctagggttagagatacgaaacgtaacgngtacggntacgcacctatctgtcttctactcgttacccg

SEQ ID NO: 58008 - DNA, 616 bp, Homo sapiens
  misc_feature: GYAE6OF02H2JAQ.37.33.C11.1.454.CMB.1.raw
  modified_base (398)..(398): a, c, t, g, unknown or other
  misc_feature (398)..(398): n is a, c, g, or t
tcagtagtgtagatcacgaccggtgctcgatttagagtgagctcgttggggtttagggggtcgagacgtcgagtcaaggacacgagcatcggacagtcgaggggtccccgcctccagtcctccctgggctcctgctgctctggctcccaggagccaaatgtgacatccagatgacccagtctccttccacctgtcctgcatctgtaggagacagagtcaccatcacttgccgggccagtcggaactattagtactggttgcctggtatcaacagaaaccgagggaaacgccccctaaggtcctagatctaatagaatcgacctccacgtttggaaacgtccgggtaccagtcaacggttcagcggactagtgtatcgtgggacagtaacttcgactcncacatcagtacgctgactagcctgagtgtagtttgactaacgttattactgttactagtactaacttaagtaaggtagggaagtaggttaccgggaccggtaacgggtaccggtagggttcggaaggtacgtacggtaaaaccggtacgtagggtacggtcgtacggtacctacgtacgtacgtccgttaccgttacgtacccgttcccgttaccccg

SEQ ID NO: 58009 - DNA, 525 bp, Homo sapiens
  misc_feature: GYAE6OF02FUNDD.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccaggatgacccagtctccttccaccctgtctgcatctgtaggagacagagtcaccatcacttgccgggccagtcggactattagtacctggttggcctggtatcaacagaaaccagggaaacgcccctaaggtcctgatctatgatgcctccactttggaagcgggtccatcaaggttcagcgcagtgtatctgggacagaattcactctcacatcagtagctgcagcctgatgtatttgactaattattactgtcagctactataagtgggatagttcggccgagggactagggttgagtatacaaacgacgtggtggctcggacctaaccgtattcgttacgttcctttactacgttcccgttaccccg

SEQ ID NO: 58010 - DNA, 432 bp, Homo sapiens
  misc_feature: GYAE6OF02IZMC2.37.33.C11.1.454.CMB.1.raw
  modified_base (335)..(335): a, c, t, g, unknown or other
  misc_feature (335)..(335): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (425)..(432): a, c, t, g, unknown or other
  misc_feature (425)..(432): n is a, c, g, or t
tcagtagtgtagatcacgaccggtgctcgatttagagtgagctcgttgggtccgccaggctccagggaggggcgtgggagtgggtggccgaacataaagcgagatggaagcgagaaatactatgtggactctgtggagggccgattcaccatctccacagacaacgccaagaaatcaatcttttgctaaatgaacagtctgagagtcgaggacacggccatgtattactgtacgagagaacagacttggggccagggaaccctggtcaccgtctctcagcctccacaacggcccagtccggtcctccccctgggccacccctgcctaccgaggcnccacctccgagacgcacagccgtccctgggcctcgccttaggcaaggcctacttcgatcactctactgagcggctggcaaggcncnacgnnnnnnnn

SEQ ID NO: 58011 - DNA, 557 bp, Homo sapiens
  misc_feature: GYAE6OF02J1AE0.37.33.C11.1.454.CMB.1.raw
tcagtagtgtagatcacgaccggtgctcgatttagagtgagctcgttgggtttggggtcagactcagtcaggacacagcatggacatgagggtccccgctcagctcctggggctcctgctgctctggctcccaggagccaatgtggacagtccaggatgacccagtctccttcaccctgtctgcatctgtaggagacagagtcaccatcacttgccgggcagtcggactattagtacctggttggcctggtatcaacagaaaccagggaaacgcccctaaggtcctgactctatgatgcctcactttggaaacgcgggtccatcaaggttcagcggcagtgtatcgtgggacagaattcactctcacatcagtagcctgctagccttgatcgtattttcgactaactttattaccttgtactagtactacttaataacgttgggagtaagtttccggaccgtaagggtaccctagggttagagtactacgaacgtaacgtcggtacggctacgaccgtaccgagttccgtcgttactttcgacttcccgttaccccg

SEQ ID NO: 58012 - DNA, 513 bp, Homo sapiens
  misc_feature: GYAE6OF02FRRGP.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccagggaaagcccctaaggtcctgatctatgatgcctccactttggaaagcgggtccatcaaggttcagcggcagtgtatctgggacagaatcactctcaccatcagtagcctgcagcctgatgtattttgactaactttatactgtcagcactataagtgggagtagttcggaccgagggacctagggttgagactacgaaacgaacgtggtaggctgacaccgtatcttgtcttctactccgttccccg

SEQ ID NO: 58013 - DNA, 569 bp, Homo sapiens
  misc_feature: GYAE6OF02IVLN6.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcggcagtgtatctgggacagaattcactctcaccatcagtagcctgcagcctgatgtattttgactaacttattactgtcagcaacttataagtgggagtagttccgggaccgtaagggacccgtaggggttagaagtagtaccgaaaacggtaacgttggtacggtacgtaggtacccgaacccgttacttccgttaggtttaccctttacctacgtttcccctttaccccccgg

SEQ ID NO: 58014 - DNA, 494 bp, Homo sapiens
  misc_feature: GYAE6OF02GBRNR.37.33.C11.1.454.CMB.1.raw
  modified_base (370)..(370): a, c, t, g, unknown or other
  misc_feature (370)..(370): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctcactttggaaagcgggtccatcaaggttcagcgcagtgtatcgtggacagaatcactctcacatcagtanctgcagcctgatgtatttgactaacttattactgtcagctactataatgggatagttcggacgtagggacgagggttgagatacgaaacgacgtggtagctgcacatctgtctcactcttcccg

SEQ ID NO: 58015 - DNA, 496 bp, Homo sapiens
  misc_feature: GYAE6OF02IHWW3.37.33.C11.1.454.CMB.1.raw
  modified_base (465)..(465): a, c, t, g, unknown or other
  misc_feature (465)..(465): n is a, c, g, or t
  modified_base (485)..(485): a, c, t, g, unknown or other
  misc_feature (485)..(485): n is a, c, g, or t
  modified_base (491)..(496): a, c, t, g, unknown or other
  misc_feature (491)..(496): n is a, c, g, or t
tcagtagtgtagatcacgaccggtgctcgatttagagtgagctcgttgggtttgggggtccctgagactctcctgtgcaacctctggattcagttgtagtgattgttggatgggttgggtccgccaggctccagggaaggggctggagtgggtggccaacataaaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaacccctggtcaccgtctcctcagcctccaccaagggcccatccggtcttcccctggccgccctgcctcccaaggcgccaccctccgagagcacagccggccctgggctgcctggtcaaggctactccatctacactacngacgcgggctgggcaaggcncatagnnnnnn

SEQ ID NO: 58016 - DNA, 511 bp, Homo sapiens
  misc_feature: GYAE6OF02HXSPP.37.33.C11.1.454.CMB.1.raw
  modified_base (273)..(273): a, c, t, g, unknown or other
  misc_feature (273)..(273): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaancccctaaggtcctgatctatgatgcctcactttggaaagcgggtccatcaaggttcagcggcagtgtatctgggacagaattcactctcaccatcagtagcctgcagcctgatgtattttgactaacttatttactgtcagtcacttaataagtgggtagattccgggcgtaagggccagggttgagatacgaaagacgtggtcgcgtgacactatcgtgttcttctacttcctcccg

SEQ ID NO: 58017 - DNA, 522 bp, Homo sapiens
  misc_feature: GYAE6OF02FJO0K.37.33.C11.1.454.CMB.1.raw
  modified_base (373)..(373): a, c, t, g, unknown or other
  misc_feature (373)..(373): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatcgcctcactttggaaagcgggtccatcaaggttcagcgcagtgtatcgtggacagaatcactctacacatcagtacnctgcagtctgatgtatttgacttaattatatgtcatactactaatagtggtagacgttcggacgtagggacgtaggtcgaagactacgaacgtacgtggaggtctacgaccactacgttcgttcgttctacctaccttcccgttacccg

SEQ ID NO: 58018 - DNA, 495 bp, Homo sapiens
  misc_feature: GYAE6OF02F2895.37.33.C11.1.454.CMB.1.raw
  modified_base (472)..(473): a, c, t, g, unknown or other
  misc_feature (472)..(473): n is a, c, g, or t
  modified_base (475)..(479): a, c, t, g, unknown or other
  misc_feature (475)..(479): n is a, c, g, or t
  modified_base (481)..(495): a, c, t, g, unknown or other
  misc_feature (481)..(495): n is a, c, g, or t
tcagtagtgtagatcacgaccggtgctcgatttagagtgagctcgttggggttggggtccgccaggctccagggaaggggctggagtgggtggccaacataaagcgacgatggaagcgagaaagtactatgtggactctgtgaggggcccgattcaccatctccacagacaacgccaagaaatcaatctttttgcaaatgaacagtctgagagtcgaggacacggccaatgtattactgtacgagagaggaggcgattagtgtaaatggctgggccttctactactactactacatcggacgtctgggcaaagggaccacggtcaccggtctcctcagcctccaccaagggcccatcggtctcccctggcaccctcctccaagagcacctctcggggcacagcgccctgggctgcctggtcaaggctacgttccatctacactactgagcgggctggcaagggcgacatagnncnnnnngnnnnnnnnnnnnnnn

SEQ ID NO: 58019 - DNA, 511 bp, Homo sapiens
  misc_feature: GYAE6OF02GELSD.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcggcagtgtatctgggacagaattcactctcaccatcagtagcctgcagcctgatgtattttgctaatttattactgtcagtcactataatgggatattcggccgtagggaccagggttagagatacgaaacgtacgtggtaggctgaccaccattctcgtcttctactcttaccccg

SEQ ID NO: 58020 - DNA, 415 bp, Homo sapiens
  misc_feature: GYAE6OF02GFOP9.37.33.C11.1.454.CMB.1.raw
  modified_base (412)..(415): a, c, t, g, unknown or other
  misc_feature (412)..(415): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggcgccctgctccaggagcacctcgagagcacagcggccctgggctgcctggtcaaggactactccatctacactactgagcgggctgggcaaggcgcatagnnnn

SEQ ID NO: 58021 - DNA, 506 bp, Homo sapiens
  misc_feature: GYAE6OF02GP58L.37.33.C11.1.454.CMB.1.raw
  modified_base (415)..(415): a, c, t, g, unknown or other
  misc_feature (415)..(415): n is a, c, g, or t
  modified_base (459)..(459): a, c, t, g, unknown or other
  misc_feature (459)..(459): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagccccctaaaggtcctaggatctaatgatgcctccactttggaaagcgggtcccatcaaggttcagcggcagtgtatctgggacagaattcactctacaccatcagtagcctgcagcctgatgtatttgctaacttattactntcagcactataatgggatattcggccgaaggaccagggtgaganacaaagactggtaggctgacaccgtatcgttgtacttcatcctcccg

SEQ ID NO: 58022 - DNA, 519 bp, Homo sapiens
  misc_feature: GYAE6OF02FZAEL.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaaacagaaaccagggaaagcccctaaggtcctgatctatgatgcctccatttggaaagcgggtccatcaaggttcagcgcagtgtatctgggacagaattcactctacacatcatagcctgcagcctgatgtatttgctaatttattactgtcagtctaactataagtgggatacgttcgggaccgagggaccgtagggttgaagtactacgaaacgtacgtgtacggctgacaccgtatcttacgtcttacactccttccccg

SEQ ID NO: 58023 - DNA, 445 bp, Homo sapiens
  misc_feature: GYAE6OF02FRKAR.37.33.C11.1.454.CMB.1.raw
  modified_base (439)..(445): a, c, t, g, unknown or other
  misc_feature (439)..(445): n is a, c, g, or t
tcagtagtgtagatcacgaccggtgctcgatttagagtgagctcgttgggtttggggggaagaggaagactgacggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnn

SEQ ID NO: 58024 - DNA, 533 bp, Homo sapiens
  misc_feature: GYAE6OF02GSLBJ.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcggggtcccatcaaggttcagcggcagtgtatctgggacagaattcactctcacatcagtagcctgcagcctgatagtattttgctaacttatttactgtacagcaactataatgggatacgttcggaccgaagggaccgtagggttcgaagtatacgaaacgaacgtggtacggactcgaccaccgtatctcggttcctttactacttccttacccccg

SEQ ID NO: 58025 - DNA, 739 bp, Homo sapiens
  misc_feature: GYAE6OF02JDH92.37.33.C11.1.454.CMB.1.raw
tcagtagtgtagatcacgaccggtgctcgatttagagtgagctcgttgggtttggggtcagactcagtcaggacacagcatggacatgaggtcccgactcagctcctgggctcctgctgctctggctccaggagccaaatcgtggacatccagatgaccagtctccttcacctgtctgctatctgtacgagaccagagtcaccatcgacttgccgggcagtcgactatagtacctggttggccttggtactcgaaacgtaggaaaaccagggaaacgccccctaaaggtccctaggaactcctaagtgaagtcgtcccgtacctaacgttttaggaaaacggtccggggtaccctagttaccgtaaaacggtttcaacggccgggtacctaaggttacgttaacgttccgttacggggaaacctaaggtaaacttttcccgaaacgtttccgttaccaaccgtaacgttacgtaaacgtttacggtcccttacggacgaacgtcccgtaggtaacttcggttactttttggaccttaaacttttcgtttaacctcggtaacctacggtaccttaacgtttaattaaacggttgggtaacgtacgtttaccgggacccgggtaacgggttaacccgtaaggggtttacgaacggtaacgttaccgtaaaacggtacgttaggtacgtcgttacgtactaaccgtagtttcgttcggtaccttacgtacttcccgttcccg

SEQ ID NO: 58026 - DNA, 547 bp, Homo sapiens
  misc_feature: GYAE6OF02H3V90.37.33.C11.1.454.CMB.1.raw
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
  modified_base (544)..(546): a, c, t, g, unknown or other
  misc_feature (544)..(546): n is a, c, g, or t
tcagtagtgtagatcacgaccggtgctcgatttagagtgagctcgttggggtttgggggtccctcgagacttctcctgtgcaacctctggattcagttgtagtgattgttggatgggttgggtccgccgaggctccagggaaggggcttggtagtgggtggtaccgaacataaaagcgagaatggaagcgagaaagtactatgtgggactctggtgaggggccgagttcaccgactctccacagaccaacgccaagaaatccaatctttttagcaaatgaacagtctgagagtcgaggacacggccagtcgtattactgtaccgagaggaacgagacgttgggggccagggaaccctgggtacaccggttcacctcaggcctccgaccgaagggcccagtccggtcttccccctggcgacccgtcgcctccgaggacgcacctccgagagcacagcgccctggcctgcctggtacaaggctactcatcacnctacgngacgcgggctggactaaggcgacatagntgangnagngnacgcancnnng

SEQ ID NO: 58027 - DNA, 515 bp, Homo sapiens
  misc_feature: GYAE6OF02GKC7E.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctggatctatgatgcctccactttggaaagcggggtcccatcaaggttcagcggcagtgtatctgggacagaattcactctcaccatcagtagcctgcagcctgatgattttgctaacttattactgtcagtctaactataatgggagtagttcggacggagggacctagggttgaagagtacgaaacgtaacgtggtaggctgacaccatctgtcttcactcttaccccg

SEQ ID NO: 58028 - DNA, 430 bp, Homo sapiens
  misc_feature: GYAE6OF02H8AQB.37.33.C11.1.454.CMB.1.raw
  modified_base (413)..(413): a, c, t, g, unknown or other
  misc_feature (413)..(413): n is a, c, g, or t
  modified_base (419)..(430): a, c, t, g, unknown or other
  misc_feature (419)..(430): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggccgcccctgctccaggacgcacctccgagagcacagcggccctgggctgcctggtcaaggctactccatctacactactgagcgggctggcaaggcncatagnnnnnnnnnnnn

SEQ ID NO: 58029 - DNA, 667 bp, Homo sapiens
  misc_feature: GYAE6OF02I9V86.37.33.C11.1.454.CMB.1.raw
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (611)..(611): a, c, t, g, unknown or other
  misc_feature (611)..(611): n is a, c, g, or t
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtggacagtccaggatgacccagtctcctccacctgtctgcatcgtgtaggagacaggatcaaccagtctacgttcggccgggccagtccgatagttacgtccgttggtcgcgtagtanacaacgaagaacgagggaacncccgttaaggcctagactctatgatcgcccttacgtacgttagggaacggccgggtacccagtccgtaaaggttcgagccggagtaggttagtaactcgtaacgggaacaagttaacttccaacttctaacccgaactcgtacgtacgttacgccgttgaccgtacgtacgtaggttatacggtttattaccggaacttaaaccgtttattaaccgtcggttacaacggtacctaagttaagtacgggtaggtactacggttaccggacgggtaacggtaccgttagggtagtaacgcgtttaacgaaggttaccggtggtaccggtntaaccggacttacccgtaagttcttaccggttacctacttccgttcccccgtaacg

SEQ ID NO: 58030 - DNA, 580 bp, Homo sapiens
  misc_feature: GYAE6OF02IUEMZ.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccagggaaacgccctaaggtcctgatctatggatgcctcactttaggaaagcgggtacccatcaaggttcagcggcagtgtatcgtggacagtattcactctcaccatcagtacgcctgcagcctgatgtatttgactaatttattactgtcacgtactacttaataaggtgggtagtacgttccgggacggtaacggggtaccgtaggggttacgagtaacgtaccgaaaacggtacgtgggttacggacgttacggtaccgtaacccgtaacttccgttaggttacccttacgttaacctcccgtttaacccccgg

SEQ ID NO: 58031 - DNA, 424 bp, Homo sapiens
  misc_feature: GYAE6OF02G3IPP.37.33.C11.1.454.CMB.1.raw
  modified_base (418)..(424): a, c, t, g, unknown or other
  misc_feature (418)..(424): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtccttccccctggccgccctgcctccgaggacgccacctccgagacgcacagcggccctgggctgcctggtcaaggactactccatctacactactgagcggctggcaaggcgcatagnnnnnnn

SEQ ID NO: 58032 - DNA, 579 bp, Homo sapiens
  misc_feature: GYAE6OF02JFB5K.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcgactattagtacctggttggcctggtatcaacagaaaccgagggaaacgcccctaaaggtcctaggatcgtatgatgcctccactttggaaacgtcgggtccatcaaggttcagcggacagtgtatcgtaggacagtaattcactctcacctatcagtagcctgcagtcctagatgtatttagactaacttacttaactcgtactagtactaacgttaataacgtagggtaactagttaccgggtaccggaacggggtaaccgtagggtttacgaaggaactacgaaacgtaacgtggtacggctacggacctacgtacttcgttacgttaccttacgtacttcccgttacccg

SEQ ID NO: 58033 - DNA, 500 bp, Homo sapiens
  misc_feature: GYAE6OF02G6MZ0.37.33.C11.1.454.CMB.1.raw
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
  modified_base (461)..(461): a, c, t, g, unknown or other
  misc_feature (461)..(461): n is a, c, g, or t
  modified_base (482)..(482): a, c, t, g, unknown or other
  misc_feature (482)..(482): n is a, c, g, or t
  modified_base (490)..(500): a, c, t, g, unknown or other
  misc_feature (490)..(500): n is a, c, g, or t
tcagtagtgtagatcacgaccggtgctcgatttagagtgagctcgttgggtttggggggtccctgagactctcctgtgcaacctctggattcagttgtagtgattgttggatgggttggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtatactgtacgagagaacagacttggggccagggaaccctggtccaccgtctctcagccctcaccagggcccatccggtctcccctggccnccctgctccaggcgccacctccganacgcacacgcggccctgggcctgcctggcaaggcctacttccatcctacactacgngacgcgggctgggacaaggcncgatacgnnnnnnnnnnn

SEQ ID NO: 58034 - DNA, 422 bp, Homo sapiens
  misc_feature: GYAE6OF02F1JN4.37.33.C11.1.454.CMB.1.raw
  modified_base (271)..(271): a, c, t, g, unknown or other
  misc_feature (271)..(271): n is a, c, g, or t
  modified_base (418)..(422): a, c, t, g, unknown or other
  misc_feature (418)..(422): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtntcctcacgcctccaccaaggcccactcgtcttcccctcggcgccctcgctccaggagcacctccgagagcacagcggccctcgggcgtcgcctcggtcaaggactacttccatctacactactgagcgggctggcaaggcgcatagnnnnn

SEQ ID NO: 58035 - DNA, 573 bp, Homo sapiens
  misc_feature: GYAE6OF02HKM7C.37.33.C11.1.454.CMB.1.raw
  modified_base (388)..(388): a, c, t, g, unknown or other
  misc_feature (388)..(388): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggcagtcggactattagtacctggttggcctggtatcaacagaaaccagggaaacgcccctaaggtcctgatctatgatcgcctcctacgtttggaaacggtcgggtcccagtcgaaggttcaggcggacagtgtatcgtagggacagtaacttcactctcactatcagtcncctgcagtcctgtatgttactttgaccttaatttactttacgcgttacagtactactaagtaagtagggagtacgttccgggacgtaacggggtaccgtagggttagaacgtactacgtaacgtacgtggtacggactacgacctaccgtattccgtagttcctttactacttcccgttaccccg

SEQ ID NO: 58036 - DNA, 510 bp, Homo sapiens
  misc_feature: GYAE6OF02GNT5K.37.33.C11.1.454.CMB.1.raw
  modified_base (339)..(339): a, c, t, g, unknown or other
  misc_feature (339)..(339): n is a, c, g, or t
tcagtagtgtagatcacgaccggtgctcgatttagagtgagctcgttgggtttgggggtcagactcagtcaggacacatcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaacgcccctaaggtcctgatctatgatgcctcactttggaagcgggtccatcaaggttcagcggcagtntatcgtgggacagtaattcactctcaccatcagtacgcctgcagcctgatgtattttcgactaacttattactgtacagctactaataagtgggagtattcgggacgagggacctagggttgagatacgaaacgagtggtggctagcacctatctgtctctatcctacccg

SEQ ID NO: 58037 - DNA, 417 bp, Homo sapiens
  misc_feature: GYAE6OF02IQUX7.37.33.C11.1.454.CMB.1.raw
  modified_base (326)..(326): a, c, t, g, unknown or other
  misc_feature (326)..(326): n is a, c, g, or t
  modified_base (411)..(417): a, c, t, g, unknown or other
  misc_feature (411)..(417): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttcccctggccgccctgctccaggngcacctccgagagcacagcggccctgggctgcctggtcaaggctactccatctacactactgagcgggctggcaaggcgcatagnnnnnnn

SEQ ID NO: 58038 - DNA, 541 bp, Homo sapiens
  misc_feature: GYAE6OF02GFHI8.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagctgggttttccttgttgctattttagaaggtgtccagtgtgaagtgcagctggtggactctgggggaggcctggtccagcctggggggtccctgagactctcctgtgcaacctctggattcagttgtagtgattgttggattggggttgggtccgcgaggctccgaggggaaggggctgggagtgggtggccaacgataaagcgagatggaagcgagaaatactatgtgactctgtggagggcgatcacatctcacagacaacgaccaaagaaatacaattcttttagactaaatagaacagtactagagagtacgaggaacacggaccatagtattactagtaacgagagaacgagacgttcgggaccgagggacccgtggtccacgtcc

SEQ ID NO: 58039 - DNA, 600 bp, Homo sapiens
  misc_feature: GYAE6OF02F2F6A.37.33.C11.1.454.CMB.1.raw
  modified_base (271)..(271): a, c, t, g, unknown or other
  misc_feature (271)..(271): n is a, c, g, or t
  modified_base (407)..(407): a, c, t, g, unknown or other
  misc_feature (407)..(407): n is a, c, g, or t
  modified_base (454)..(454): a, c, t, g, unknown or other
  misc_feature (454)..(454): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggcagtcgactattagtacctggttgctggtatcaacaagaaaccgagggaaacnccccgtaaggtcctagatactatgatcgccctaccgtacgtttaggaaacggtccggggtaccagttacgtaaggttcaggcggacaggttgtagtcgtagggaacaagtaacttcactctacactatacagtacncctgcagcctagatgtatttcgacttaactttatacgttgtaaaacncgtactaacgttaataacggtaggagtacgttccgggaccggaacgggtaccgtagggttacgaagtacgtacgaaacgtaacggttggtacggtacgtacgacctacgtattccgttacgttactttactacttcccgttacccg

SEQ ID NO: 58040 - DNA, 564 bp, Homo sapiens
  misc_feature: GYAE6OF02IQX5U.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttgcctggtatcaacagaaaccagggaaagcccctaaggtcctgatctatgatcgcctcctacgtttggaaaacgccggggtacccagtcgaaggttcaaggcggcagtgtatcgtgggaacagaattcactctacaccatcagtacgcctgcagcctgatgtattttgacttaacttattactagtcacgcaacttagtaagtgggaagtagttccgggaccggaagggtaccgtaagggtgaacgtactacgaaacgtacgtggtcggtactacgaccgacctacttaccgttcgttccttacgtacttcccgttaccccg

SEQ ID NO: 58041 - DNA, 492 bp, Homo sapiens
  misc_feature: GYAE6OF02IQSNM.37.33.C11.1.454.CMB.1.raw
  modified_base (460)..(492): a, c, t, g, unknown or other
  misc_feature (460)..(492): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccactagacaacgccaagaaatcaatctttttgcaaatgaacagtctgagagtcgaggacacggccatgtattactgtacgagagaacagacttggggccaggggaacccctggtcaccgtctcctcagcctccaccaagggcccatcggtcttccccctggccgccctgctccagggacgcaccgtcccggagacgccacgacggccggccgtgggctcggccgtcggtaacgaggtaccttactccatcctaacctactacgtgacgggtcggtcgtacgggacgaacgggccacgtaacgtacgnnnnnnnnnnnnnnnnnnnnnnnnnnnnnnnnn

SEQ ID NO: 58042 - DNA, 519 bp, Homo sapiens
  misc_feature: GYAE6OF02GGBF8.37.33.C11.1.454.CMB.1.raw
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (457)..(457): a, c, t, g, unknown or other
  misc_feature (457)..(457): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaaacagaaaccgagggaaagccccgtaaaggtcctgatctatgatgcctccactttggaaagcgggtccatcaaggttcagcgcagtgtatcgtggacagaattcactcacacatcagtagctgcagcctgatgtatttgactaacttatactgcagctaactataagngggtanagttcggaccgtagggacctagggttnaagactacgaaacgtacgtggtggctcggacctacgattcgtgttcctctacgtccttcccg

SEQ ID NO: 58043 - DNA, 508 bp, Homo sapiens
  misc_feature: GYAE6OF02FVD8E.37.33.C11.1.454.CMB.1.raw
  modified_base (430)..(430): a, c, t, g, unknown or other
  misc_feature (430)..(430): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcggggtcccatcaaggttcagcggcagtgtatctgggacagaattcactctcaccatcagtagcctgcagcctgatgtattttgactaacttattactgtcagcactataatggganattcgggacgagggaccagggttgagatacgaaacgacgtggtggctgactacgatcgtagtcttacacttctacccg

SEQ ID NO: 58044 - DNA, 560 bp, Homo sapiens
  misc_feature: GYAE6OF02F2OUB.37.33.C11.1.454.CMB.1.raw
  modified_base (340)..(340): a, c, t, g, unknown or other
  misc_feature (340)..(340): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttgcctggtatcaacagaaaaccagggaaacgccccctaaaggtcctgatctatgatgcctccactttggaaagcgggtcccatcaaggttcagcggnagtgtatcgtgggacagtattcactctacaccatcagtacgcctgcagcctgattgattttgactaattattactgtcagtcacttaataagtgggagtagttcgggacgtaaggggaacctaggggttagaagtaactaccgaaaccgtaacgttggtacggacctcgtaccaaccgtacttccggttcgttaccctttactacgttcccttacccccg

SEQ ID NO: 58045 - DNA, 554 bp, Homo sapiens
  misc_feature: GYAE6OF02H8G7R.37.33.C11.1.454.CMB.1.raw
tcagtagtgtagatcacgaccggtgctcgatttagagtgagctcgttggggtttgggggtcagactcagtcaggacacagcatggacatgagggtccctgctcagctcctgggactcctgctgctctggctcccaggtagcgggtgtgacattctgatgacccagtctccatcctcctgtctgcatctattagagacagagtccaccgatcgcttgccgggcagtcaggacatccgctaatttgtagcctggtatcagcagagaccagggcaagttcctcaactcttgatctatgatgcatctctattggagtccgtaggggtctctagtcgttacggttcgagttggacaggcgtagtcgtcggggtacccgtccttttacgactccttccacctactccaacccacgccctaccacgtcccttaggaagtataggttacgactaacttaacttacgtagtactaacagttatcgaagtcttacgtccggtaggtacgttccggacccgtagggaaccgtaaggtaacgaagtacgagaacgacttggagtcg

SEQ ID NO: 58046 - DNA, 589 bp, Homo sapiens
  misc_feature: GYAE6OF02I7CIG.37.33.C11.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
  modified_base (379)..(379): a, c, t, g, unknown or other
  misc_feature (379)..(379): n is a, c, g, or t
  modified_base (452)..(452): a, c, t, g, unknown or other
  misc_feature (452)..(452): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacatccagatcgacccagtctccttccacctgtctgcatctgtagagacngagtcaccatcacttgccgggcagtcggactatacgtcctggttgccttggtatacgaacaagaaaccgagggaaacgccccctaaagggtccnggtactctatgatcgcctcacttggaaacgcgggtcccatcaaggttcagcggcagtgtatcgtgggacagaattcactctctaccntcagtacgccctagcacgccttagagttgtacttttgactaactttattactgctagctaacgttattaacgngggaactaagttccgggaccgtaaggggccttaagggtgaagtaacccgttagaaacggaccggtttaggtacgggaccttaacgggaccctaacgtagttccgtaacggttcccttactaccggttcctttccccg

SEQ ID NO: 58047 - DNA, 412 bp, Homo sapiens
  misc_feature: GYAE6OF02H1BSU.37.33.C11.1.454.CMB.1.raw
  modified_base (322)..(322): a, c, t, g, unknown or other
  misc_feature (322)..(322): n is a, c, g, or t
  modified_base (406)..(412): a, c, t, g, unknown or other
  misc_feature (406)..(412): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtctcccctggcgcctgctccagngcacctcgagagcacagcggccctgggctgcctggtcaaggctacttcatctacactactgagcgggctggcaaggcgcatagnnnnnnn

SEQ ID NO: 58048 - DNA, 569 bp, Homo sapiens
  misc_feature: GYAE6OF02H8CRR.37.33.C11.1.454.CMB.1.raw
  modified_base (419)..(419): a, c, t, g, unknown or other
  misc_feature (419)..(419): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacaagaaccagggaaacgcccctaaggtcctagatctatgatgcctcactttggaacgcgggtacccatcgaaggttcagcggcagtgtagtcgtagggacagtaattccaactctacaccatcgagtgcctgcacgcctgattgtattttgacttaaacttntttactgtactagactaacttaagtaagtggggtaatacgttccgggaccgtaaggggtaccgtagggttacgaagtaataccgaaacgtacgtggtagtcgtacgtcaccgttattacttcgttaccctttagtaccttccgttacccg

SEQ ID NO: 58049 - DNA, 556 bp, Homo sapiens
  misc_feature: GYAE6OF02GJJWR.37.33.C11.1.454.CMB.1.raw
  modified_base (298)..(298): a, c, t, g, unknown or other
  misc_feature (298)..(298): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagacagaaaccagggaagacccctaagctcctcatctatggtncatcctaagtttacaaacgtcgggtaccatcaaggttcaggcggcagtgtatcgtagggacagtaacttcactcctacaccatcagtacgccgtgccagccctgagtgtattttcgactaactttatttactttcagtcctaacgttaataagtagggaactcggttaccggaccgtaggggaccgtaggggttacgaaggtaactaacgaaacggtaacgtaggttacggacgtaggacctacctagttccttacgg

SEQ ID NO: 58050 - DNA, 517 bp, Homo sapiens
  misc_feature: GYAE6OF02HP215.37.33.C11.1.454.CMB.1.raw
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaaggtcctgatctatgatgcctccacttttggaaagcggggtcccagtcaaggttcagcggcagtgtatcgtgggacagaattcactctcaccatcagtacgcctgcagcctgattgattttgctaacttattactagtcagctactataagtggagtagttcggcgagggaccgaggttcgagntacgaagaacgtgtggctcgacaccngttctcgtctttacattccctaccccg

SEQ ID NO: 58051 - DNA, 562 bp, Homo sapiens
  misc_feature: GYAE6OF02ICMYO.37.33.C11.1.454.CMB.1.raw
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccacctgtctgcatctgtaggagacagagtcaccatcacttgccggccagtcgactattagtacctggttggcctggtatcaacagaaaccagggaaagcccctaaggtcctgatctatgatgctccactttggaaagcggggtccatcaaggttcagcggcagtntanctggacagaattcactctcaccatcagtagctgcagcctgatgattttgactaacttattactgtacagcaacttaataacgtggggtaagtacgttcggaccggtaacggggacccgtaaggggttgaacggtaataccgaaaaccggtaacgtggttacgggtcgttcggaccacccgtagttcgttacgttcctttaccttacgtccctttacccccgg

SEQ ID NO: 58052 - DNA, 586 bp, Homo sapiens
  misc_feature: GYAE6OF02HSVRY.37.33.C11.1.454.CMB.1.raw
  modified_base (194)..(194): a, c, t, g, unknown or other
  misc_feature (194)..(194): n is a, c, g, or t
  modified_base (273)..(273): a, c, t, g, unknown or other
  misc_feature (273)..(273): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggngacagagtcaccatcacttgccggaccagtcggactattagtacctggttggcctggtatcaacagaaaccagggaaancccctaaggtcctgatctatgatgctcacttggaaagcgggtccatcaagttcagcgcagtgtatcgtgggacagaattcactctacaccatacagtacgcctgtcagcctagatgtattttgactaaacttatttactgtacaagctaattataacgtagggactagttccggaccgtaggggaacccgtagggttagaacgaagttaccgaaaacggtaaccgttaggtacgggtaccttacggaaccctaacccgtagtttacccgtaggttttacccgtttaccgtaacgtttccccgttaacccccgg

SEQ ID NO: 58053 - DNA, 560 bp, Homo sapiens
  misc_feature: GYAE6OF02H8Z2I.37.33.C11.1.454.CMB.1.raw
tcagtagtgtagatcacgaccggtgctcgatttagagtgagctcgttgggtttgggggtcagactcagtcaggacacacgcatggacatgagggtccccgctcagctcctggggctcctgctgctctggctcccaggagccaaatgtggacatccagatgacccagtctccttccaccctgtctgcatctgtaggagacagagtcaccatcacttgccgggcagtcgactatgtaccgtggttgcctggtatacaacagaaaccagggaaacgcccctaaggtcctgatctatgatgcctctacgttggaacgtccgggtacccatacaaggttcacgcggctacgtgtatcgtgggacagaacttcacttctccaacctatacgagtacgcctgccaggtcctgatgtattttgacctaatttacttactgtcagctattataagtagggagtacgttcgggaccggacgggtaacgtgggttaagagtactacgaaacgtacgtgtaggtcctagacctaacgcgttactcggttacctttcgtaccttccctacccg

SEQ ID NO: 58054 - DNA, 495 bp, Homo sapiens
  misc_feature: GYAE6OF02FP7OC.37.33.C11.1.454.CMB.1.raw
  modified_base (485)..(495): a, c, t, g, unknown or other
  misc_feature (485)..(495): n is a, c, g, or t
tcagtagtgtagatcacgaccggtgctcgatttagagtgagctcgttgggtttgggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttcccctggccgccctgctcccaggacgccacctccgagagcacagcggccctgggctgcctggtcaaggactacttccatctacactactgagcgggctggcaaggcgcatagnnnnnnnnnnn

SEQ ID NO: 58055 - DNA, 567 bp, Homo sapiens
  misc_feature: GYAE6OF02GMEZE.37.33.C11.1.454.CMB.1.raw
  modified_base (259)..(259): a, c, t, g, unknown or other
  misc_feature (259)..(259): n is a, c, g, or t
  modified_base (547)..(547): a, c, t, g, unknown or other
  misc_feature (547)..(547): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatcgtgtaggagacagagtcaccatcacttggccggcagtcggactattagtaccgtggttgcctggtatcaanacgaaaccgagggaaacgcccctaaggtcctgatctatgatcgcctcctactttggaacgccgggtaccatcgtaaggttcagcggacagtgtagtcgtgggacagaacttcactctacaccatcagtacgaccgtgacacgcctgatgtatttcgactaactttattactgtcacgtctaactataagtgggtagtagttccgggcggtaagggccgtagggttagagtactacgaacggtacgtgggtacggcttacgacctaccgtacgtcgttagttccctttntacccgttccgttacccccg

SEQ ID NO: 58056 - DNA, 542 bp, Homo sapiens
  misc_feature: GYAE6OF02IO66C.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagtccgggtcccatcaaggttcagcggcagtgtatcgtgggacagtaatcaactctacaccatcagtagcctgcagcctgattgtattttgacttaacttatttactgtcagtcacttataatgggatagttcgggaccgacgggaccgtagggttgaagacgtacaaacggtacgtggtcggctagacctaaccagttccgttgtcctttacctacttcccgttaccccg

SEQ ID NO: 58057 - DNA, 514 bp, Homo sapiens
  misc_feature: GYAE6OF02F9KHT.37.33.C11.1.454.CMB.1.raw
  modified_base (386)..(386): a, c, t, g, unknown or other
  misc_feature (386)..(386): n is a, c, g, or t
  modified_base (506)..(514): a, c, t, g, unknown or other
  misc_feature (506)..(514): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatccggtccttccccctggccnccctgcctccacggacgccacctccgagacgcacgagccggcccgtgggcctcgccgttggtaccaacggacctacttccattcctacactactgacgcgggctggcaaggcgcatagcnnnnnnnnn

SEQ ID NO: 58058 - DNA, 605 bp, Homo sapiens
  misc_feature: GYAE6OF02GPDXK.37.33.C11.1.454.CMB.1.raw
  modified_base (362)..(362): a, c, t, g, unknown or other
  misc_feature (362)..(362): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccaccacttgccgggccagtcggactatagtacctggttggcctggtatcaacagaaaccagggaaacgcccctaaggtcctgatctatgatgcctcactttggaaacgcgggtcccatcaaggttcagcggcagtgtatcgtggacagtatcactcncaccatcagtagcctgcagcctgatgtatttgactaacttattactcgtcagctactaagtaagtgggtaagtacgttacgggaccgggtaacggggtaccgtaaggggttacgaaggtaacgtaaccgtaaacggaaccgtttagggtacggggtacctttacgggaccccgttaaccgttacgtttacccgttcggtttaccctttaccgtaaccttttccccggtttacccccgtacccg

SEQ ID NO: 58059 - DNA, 550 bp, Homo sapiens
  misc_feature: GYAE6OF02HVIO6.37.33.C11.1.454.CMB.1.raw
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccagggaaacgccctaaggtcctgatctatgatgcctccactttggaaagtccggggtaccagtcaaggttcagcggcagtgtatcgtagggacagtaattcactcncaccatcgagtacncctgcagcctgatgtattttgactaacgtttattactgtaccagtactaacttaataagtgggtatacgttccgggaccgtaagggaccgtagggtcgaagagtacaaacgtacgtgtaggctacgaccaccgtattccgtagttccttactacctccttaccccgg

SEQ ID NO: 58060 - DNA, 449 bp, Homo sapiens
  misc_feature: GYAE6OF02I2524.37.33.C11.1.454.CMB.1.raw
  modified_base (433)..(449): a, c, t, g, unknown or other
  misc_feature (433)..(449): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatccggtccttccccctggccgcccctgcctccgagggacgccaccctccgagacgccacgacgccggccctggggcctggccgtggtacaacggactacttccatctacactactgagcgggctggcaggcgcatagnnnnnnnnnnnnnnnnn

SEQ ID NO: 58061 - DNA, 640 bp, Homo sapiens
  misc_feature: GYAE6OF02JB5GF.37.33.C11.1.454.CMB.1.raw
  modified_base (274)..(274): a, c, t, g, unknown or other
  misc_feature (274)..(274): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcattctgtaggagacagagtcaccatcacttgccgggccagtcggactattagtacctggttggcctggtatcaacagaaaccagggaacncccctaaggtcctgatctagtcgatcgcctccactttagggaaaacgccgggggttaccctagttaccgaacgggttccaggtccgggacacggttgtaagtcttaggggacaaggtaattccaactctaccgacctatacagtacgccctaggccagcccttggacttcgttatttagacctaaacgtttattacgttgtacagtactaacttaagtaagtgggtaagtacggtttaccgggaccgggtaacgggtacccgtaaggggtttagaacggtaacgtacggaaaccgtaacgttggtacgggtcttagaccgtaaccttacgttacttaccgtccgtttactacgttccctttccccg

SEQ ID NO: 58062 - DNA, 438 bp, Homo sapiens
  misc_feature: GYAE6OF02GY79I.37.33.C11.1.454.CMB.1.raw
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
  modified_base (429)..(438): a, c, t, g, unknown or other
  misc_feature (429)..(438): n is a, c, g, or t
tcagtagtgtagatcacgaccggtgctcgatttagagtgagctcgttgggtttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggccccatccggtccttccccctggccgcccctgcctccaggagccaccctccgagagcacagccggccctggggctgcctggtacaaggactactccatctacactacngagcgggctggcaaggcncatagnnnnnnnnnn

SEQ ID NO: 58063 - DNA, 530 bp, Homo sapiens
  misc_feature: GYAE6OF02GJLO1.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacagtccaaggatgacccagtctccttccaccctgtctgcatctgtaggagacagagtcaccatcacttgccgggccagtcggactattagtacctggttggcctggtatcaaacagaaaaccagggaaacgcccctaaaggtcctgatctatgatgcctccactttggaaagcggggtcccatcaaggttcagcggcagtgtatcgtgggacagaattcactctcaccatcagtagcctgcagcctgatgtattttgactaacttattacttgtcagcaacttataagtagggtagtagttcggacggagggactacccgggttagacgagtacaaacgaacgtggtggctgacaccatctcgtcttctactccttacccg

SEQ ID NO: 58064 - DNA, 435 bp, Homo sapiens
  misc_feature: GYAE6OF02JICV6.37.33.C11.1.454.CMB.1.raw
  modified_base (423)..(435): a, c, t, g, unknown or other
  misc_feature (423)..(435): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggcgcccctgcctccaggagcacctcccgagagcacagcggccctggggctgcctggtcaaggactacttccatctacactactgagcgggctgggcaaggcgcatagnnnnnnnnnnnnn

SEQ ID NO: 58065 - DNA, 556 bp, Homo sapiens
  misc_feature: GYAE6OF02I6R99.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactatagtacctggttggcctggtatcaacagaaaccagggaaacgcccctaaggtcctgatctatgatcgcctcctacgtttagggaacggccggggtacccagtcaaggttccaggcggcagtgtatcgtgggacaagattcactctccacatcagtacgctgcacgctgtatgtatttgactaactttacttactgtacacgtacattataagtggagtagttcgggacggagggtaaccgtagggttagagtaactacgaaacgacgttggtacggtctacgacctaccgtacttcgttacgttccttactacttcccgtaccccg

SEQ ID NO: 58066 - DNA, 611 bp, Homo sapiens
  misc_feature: GYAE6OF02GJXVY.37.33.C11.1.454.CMB.1.raw
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctgtagganacagagtcaccatcactgccggcagtcgactattagtacctggttcgctggtatacaacagaaaccgaagggaacncccgtaaggtcctgatctatgatcgcctccacgtttaggaacgcgggtacccagtcgtaaggttcaggccgacgagtgtactcgtaggaacagtaacttcactcctcaactactacgaagtacgcctgccgaagtcctagtattagttacttttgaccttaaatttacttactcgtacaagtacctaacttagtaaggttagggtacttacgggttccgggaaccggtagggtaaccgtagggttagaagtaacgtacgaaacgtacggtcggtagtaccgtaccgtactaccgttacgttacgttaccgttctttacctacctttccccgttaccccg

SEQ ID NO: 58067 - DNA, 514 bp, Homo sapiens
  misc_feature: GYAE6OF02FSGRA.37.33.C11.1.454.CMB.1.raw
  modified_base (503)..(503): a, c, t, g, unknown or other
  misc_feature (503)..(503): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtggacatccagatgacccagtctccttccaccctgtctgcatctgtaggagacagagtcaccatcacttgccgggccagtcggactattagtacctggttggcctggtatcaacagaaaccagggaaagcccctaaaggtcctgatctatgatgcctccactttggaaagcggggtcccatcaaggttcagcggcagtgtatctgggacagaattcactctcaccatcagtagcctgcagcctgatgtattttgactaatttattacttgtcctagctactaataatggggaatagttcggccgagggaccgagggttgagatacgaaacgacgtaggtggctgcacatctgttcctntacttctcccg

SEQ ID NO: 58068 - DNA, 518 bp, Homo sapiens
  misc_feature: GYAE6OF02IWEEW.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctccaaggagccaaatgtgacatccagatgacccagtctccttccaccctgtctgcatctgtaggagacagagtcaccatcacttgccgggccagtcggactattagtacctggttgcctggtatcaacagaaaccagggaaagcccctaaggtcctgatctatgatgcctccactttggaaagcggggtcccatcaaggttcagcggcagtgtatcgtgggacagaattcactctcaccatcagtagcctgcagcctgatgtattttgactaacttattactgtcagcactataagtgggatagttcggaccggagggaccgtagggttgagatacgaaacgtacgtggtcggactgaccgacctatctgtcttactacttccttcccg

SEQ ID NO: 58069 - DNA, 735 bp, Homo sapiens
  misc_feature: GYAE6OF02J0PEU.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggcagtcgactattagtacctggttcgcctggtatcaacagaaaccagggaacgcccctaaggtcctagatctatgatacgcctcctacgtttcggaaacggtccggggtacccagtaccgtaaggttccaaggtcggacgtaggttgttaactcgtaggggaacctaaggtaaacttccgtaacctccgttaccaacccgtagtacctaacggttaacgcccgttaggaccgtaacgtcccgttaggtaacttacggttaactttttacggaaaccttaaacttttacgtttaccgttacgttaccgaacgttacctaaaccgttaattaaacggttcggggtaaacggttacgtttacccgggaaccgggtaacggggtaacccggttagggttaacgggtaaggtaacgtacccgtaaaacggttaaccggtaggttaccggtaccgtacgtaaccgtacccgttacgttaccgttaccgtttacccgtacgttacccgttacccgtttaccccgg

SEQ ID NO: 58070 - DNA, 558 bp, Homo sapiens
  misc_feature: GYAE6OF02H4XGP.37.33.C11.1.454.CMB.1.raw
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaaatgtgacatccagatgacccagtctccttccaccctgtctgcatctgtaggagacagagtcaccatcacttgccgggccagtcgactatacgtacctggttgcctggtatcaacagaaaccagggaaagcccctaaggtcctagatctatgatgcctccactttggaaagcgggtccatcaaggttcagcgnagtgtatcgnggtacagtaatcaactctcacatacgtagtacgactgcagtcctagactgtatttgactaagttattactagtacagacaacttaagtaagtgggtatacgttcggaccgtaaggggtaccagggttacgaagtacttacgaaaaccgtagtaggtacggtctacgacctaccgtagttccgttagttaccttacgtaccttccttaccccgg

SEQ ID NO: 58071 - DNA, 553 bp, Homo sapiens
  misc_feature: GYAE6OF02FTZP1.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggccagtcgactattagtacctggttgcctggtatcaacagaaaccagggaaacgcccctaaggtcctgatctatgatgcctcactttggaaacgcggggtcccatcaaggttcagcggcagtgtatcgtagggacagtaattcaactctcacatcagtacgcctgcagcctgattcgtattttcgactaactttattacttgtcagtcaacttataagtgggtatagttcgggaccgtagggaccgtagggttgaacgtatacgaaacgtaacgttggtacggcttacgaccgtaacctacttcgttacgttcctttactacgttcccttaccccg

SEQ ID NO: 58072 - DNA, 591 bp, Homo sapiens
  misc_feature: GYAE6OF02HVVU6.37.33.C11.1.454.CMB.1.raw
tcagtagtgtagatcacgaccggtgctcgatttagagtgagctcgttggggtttgggggtcagactcagtcaggacacagcatggacatgagggtccccgctcagctcctggggctcctgctgctctggctcccagggagccaaatgtgacatccagatgacccagtctccttccaccctgtctgcatctgtaggagacagagtcaccatcacttgccgggccagtcggactattagtacctggttggcctggtatcaacagaaaaccagggaaacgcccctaaaggtcctagatctatgatcgcctctacgttaggaacgcgggtcccatcgtaaggtcagcgcagtgtatcgtagggacaagtaacttcactctaccactatcagtacgcctgcagtcctgatgtattttgacttaactttatttactgtcaagactaacttaagtaagtagggtagtacgttccgggaccggtaagggtaccgtagggttacgagtaacgttaacgaaaacggtaacgttcgggtaggtacctacggacctaacccgtagttccgtacggtttcctttacgtacttcccgttaccccg

SEQ ID NO: 58073 - DNA, 561 bp, Homo sapiens
  misc_feature: GYAE6OF02IO6R9.37.33.C11.1.454.CMB.1.raw
  modified_base (271)..(271): a, c, t, g, unknown or other
  misc_feature (271)..(271): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(552): a, c, t, g, unknown or other
  misc_feature (551)..(552): n is a, c, g, or t
  modified_base (555)..(557): a, c, t, g, unknown or other
  misc_feature (555)..(557): n is a, c, g, or t
  modified_base (559)..(561): a, c, t, g, unknown or other
  misc_feature (559)..(561): n is a, c, g, or t
tcagtagtgtagatcacgaccggtgctcgatttagagtgagctcgttgggtttggggggtccctgagactctccttgtgcaaccgtctggattcagttgtagtgattgttggaatgggttgggtccgccagggctccagggaaggggctggagtgggtggccaacataaagcgagatggaagcgagaaatactatgtggactctgtgagggccgattcgaccatctccacagacaacgccaagaatcaatcttttgacaatgaacagtctnagagtcgaggacacggccatgtattactgtacgagagaacgagacgttggggccgagggaacccgtggtacaccgtctccctcacgcctaccaccgaacgggcccagtccggtcttcccccgtggaccgccctgcctccgagngcacctcgagacgcaacngccggcctgggctcgccgttcgggtacaacgggaccttacgtcccaatcctactacctacgtgacggaccgggtcgtcggaccgtaaagggccgaccgtaagttaacggcngcgnancnngcnnncnnn

SEQ ID NO: 58074 - DNA, 423 bp, Homo sapiens
  misc_feature: GYAE6OF02GM6IQ.37.33.C11.1.454.CMB.1.raw
  modified_base (333)..(333): a, c, t, g, unknown or other
  misc_feature (333)..(333): n is a, c, g, or t
  modified_base (411)..(411): a, c, t, g, unknown or other
  misc_feature (411)..(411): n is a, c, g, or t
  modified_base (417)..(423): a, c, t, g, unknown or other
  misc_feature (417)..(423): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggcgccctgcctccaggancacctccgagacgcacagcggccctgggcctgcctggcaaggctactccatctacactactgagcggctggcaaggcncatagnnnnnnn

SEQ ID NO: 58075 - DNA, 549 bp, Homo sapiens
  misc_feature: GYAE6OF02HDGQS.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaacgcccctaaggtcctgatctatgatgcctccactttggaaagcgggtcccatcaaggttcagcggcagtgtatctgggacagaattcactctcacatcagtagcctgcagcctgatgtattttgactaacttattactgtcagtcaacttataagtgggagtacgttcggaccgtagggaccgtagggttacgagtataccgaaaacggtacgtggtacggactcggacctaaccgtacgttccgttacgttcctttacctacttcccgttaccccg

SEQ ID NO: 58076 - DNA, 643 bp, Homo sapiens
  misc_feature: GYAE6OF02JJZFA.37.33.C11.1.454.CMB.1.raw
  modified_base (602)..(602): a, c, t, g, unknown or other
  misc_feature (602)..(602): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacagtccagatgacccagtctcctccacctgtctgcatctgtaggagacagagtcaaccatcacgttgccggccagtcgactattacgtacctggttgcctggtatcaacaacgaaaccgagggtaaacgcccctaaggtcctgatctatcgtatcgtcctacgtacgttaggaaacgtccgggtaccagtacgtaaggttcacgcggacgtagtacgtatcgtagggactagtaacttcgaactcgtacacctagtacacgtacgctagctacgcctgtagtgttacttcgtacttaacttactttacgtagttacacgtacttaacgtagttaaacgggtcggtaacgttagttacccgggacccgggtaaggttaaaccggtagggttaacggagtaacgtaccgtaaacggtaaccgtttgggaacggttacgtacggtacctaaccgttnttcggtacctttacgttacctaccggttccccttaacccgg

SEQ ID NO: 58077 - DNA, 760 bp, Homo sapiens
  misc_feature: GYAE6OF02J3A0R.37.33.C11.1.454.CMB.1.raw
  modified_base (98)..(98): a, c, t, g, unknown or other
  misc_feature (98)..(98): n is a, c, g, or t
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
tcagtagtgtagatcacgaccggtgctcgatttagagtgagctcgttgggtttgggggtcagactcagtcaggacacagcatggacatgaggtcccgntcagctcctgggctcctgctgctctggctcccaggagccaaatgtgacatccagatcgacccagtcctccttccacctgtctgacatctgagganacagacgtcaaccntctacgttcggccggctaggtcggactagttacgtaccgtgggttcgcctggtactacgaacgacgaaaccgaggtaacgtaccccgtaaggtcctagtactacgtagtgtaactccgtccgttaccgtaacgtttacgggaaaccggtccgggtaccctacggtaccgttaaacgggttccgaacgggtccggtacgtacgttacggttaccgtacgggtaaccgggtaactaacggttaaccttccggtaaaccgttccgtaccctaaccgtaacgttacgtacggtaacctccggtacggtacgtaacggtacccgtttaaggacgttttaacgttacgtttaacgtaccgtttaaacgttttacgttacgttaacggtcctaacgtaccgttaaccgttaaggttacgtaaccgggggtactttaaccgggtacccgggtacggtaaccggggtacgtacgggttagaacgtacgtaacgacgtaggtacggcgtactaccggactaccgtacttccgtacgttacctccgttaccctccgttaacccg

SEQ ID NO: 58078 - DNA, 459 bp, Homo sapiens
  misc_feature: GYAE6OF02HHZSS.37.33.C11.1.454.CMB.1.raw
  modified_base (360)..(360): a, c, t, g, unknown or other
  misc_feature (360)..(360): n is a, c, g, or t
  modified_base (448)..(459): a, c, t, g, unknown or other
  misc_feature (448)..(459): n is a, c, g, or t
tcagtagtgtagatcacgaccggtgctcgatttagagtgagctcgttgggtttggggggaagaggaagactgacggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaacggcccatccggtccttcccccgtggccgccctgcctccgaggacnccacctccgagacgcacaggccggccctgggctgcctggtcaaggactactccatcacactactgagcgggctggcaaggcgcatagnnnnnnnnnnnn

SEQ ID NO: 58079 - DNA, 418 bp, Homo sapiens
  misc_feature: GYAE6OF02GR192.37.33.C11.1.454.CMB.1.raw
  modified_base (413)..(418): a, c, t, g, unknown or other
  misc_feature (413)..(418): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactttacgagagaacagacttggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnn

SEQ ID NO: 58080 - DNA, 492 bp, Homo sapiens
  misc_feature: GYAE6OF02FV4O4.37.33.C11.1.454.CMB.1.raw
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (480)..(482): a, c, t, g, unknown or other
  misc_feature (480)..(482): n is a, c, g, or t
  modified_base (484)..(492): a, c, t, g, unknown or other
  misc_feature (484)..(492): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgagggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtctcccctggccnccctgctccaggancacctcgagngcacngcgccctgggctgcctggtcaaggctactccatcctacactactgacgcgggctggcaagggcgcatagnnnannnnnnnnn

SEQ ID NO: 58081 - DNA, 502 bp, Homo sapiens
  misc_feature: GYAE6OF02GFOYL.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggtgccagatgtgccatccaaatgacccagtctccttccaccctgtctgcatctgtaggagacagagtcaccatcacttgccgggccagtcggactattagtacctggttggcctggtatcaacagaaaccagggaaagccccctaaggtcctgatctatgatgcctccatttggaaagcgggtccatcaaggttcagcggcagtgtatctgggacagaattcactctcacatcagtagcctgcagcctgatgtattttgactaattatactgtcagcaacttataagtgggagtattcgggccgagggaccgtagggttagagatacaaacgactggtgctgcaccattctgttctcactcctcccg

SEQ ID NO: 58082 - DNA, 555 bp, Homo sapiens
  misc_feature: GYAE6OF02FYCFF.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggatccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcggggtcccatcaaggttcagcggcagtgtatctgggacagaattcactctcacatcagtagcctgcagcctgatgtattttgctaacttattactgtcagtcacttataagtgggagtagttcgggaccgaaggggacctaaggggttgaacggtattacgaaacggtaacgttggtacggtctaggacctaacccgtattccgttacggttacctttaccgtacttcccgtttacccccg

SEQ ID NO: 58083 - DNA, 874 bp, Homo sapiens
  misc_feature: GYAE6OF02JBEC3.37.33.C11.1.454.CMB.1.raw
tcagtagtgtagatcacgaccggtgctcgatttagagtgagctcgttggggtttgggggtcagactcagtcaggacacagcatggacatggacgggtccccgctcagctccgtggggctcctgctgctctggctcccgaggacgaccaaatgtgacatccagatcgacccagtcctccttccaccctgtctgcatctgtaggagacagagtcaaccatcacgttcggccgggccaggtccggtactattacgtacctggttcggcctggtatacaaacaagtaaaccgagggaaacacccccgtaaaggtccgtgtaactcgtaacgtgaagttccggacccttaccgtaaccgttttaggggaaaacggtcccggggggtacccctaagtaccgtaacgggtttcaacggtcggtaccgtaggttagttaacgtcggttacggggtaacaaggtaactttaccgtaaccttccttaccgaaaccctaacgttaccgtaaggttacccggaccctttacgggacccgtaacggtccttaacggactttaacgggttactttttacggaacccgtttaaaaccttttaaacgttttaccggttacgtaaccgtaacggtaccttaaaaccgtttaaagttaaaccgggtttaaggggtaaacggtttaccggtttacccgggggacccggggttaaacgggtaaaccccgggttaaagggggtttaacgtaaagggtaacccgtttaaccgggaaaaaccgtttaacgggtacgggttaaccggggttacctaccgggttaacccgtaaccggtaactttcccgtttaacggtttcccgtttaacccgttacggttaccccccgtttaccccggg

SEQ ID NO: 58084 - DNA, 550 bp, Homo sapiens
  misc_feature: GYAE6OF02JOQI8.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggccagtcggactattagtacctggttggcctggtatcaacagaaaccagggaaacgcccctaaggtcctgatctaatgatgcctcactttggaaagcgggtccagtcaaggttcagcggctagtgtatcgtggacagaatcactctacacatcgagtacgctgcagctgatgtatttcactaattatactgtacagtcacttaagtaagtgggagtacgttcggaccggtagggtacccgtaggggttagacgtaagtaccgaaaaggtaccgtggtacggtctacggtaccactacgttcctagttaccttactacgttcccgttaaccccg

SEQ ID NO: 58085 - DNA, 433 bp, Homo sapiens
  misc_feature: GYAE6OF02FTXL7.37.33.C11.1.454.CMB.1.raw
  modified_base (425)..(433): a, c, t, g, unknown or other
  misc_feature (425)..(433): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtggaggggccgattcaccatctccacagacaacgccaaagaaatcaattctttttgcaaatgaaacagtctgagagtcgaggacacggccatgtattactgtacgagagaacagacttggggccagggaaccctggtcaccgtctcctcagcctccaccaagggcccatcggtcttccccctggccgcccctgcctccgaggacgccacctccggagagcaacagccggccctgggctgcctggcaaggctactcatctacactactgacggcgggctggcaaggccgcatagnnnnnnnnn

SEQ ID NO: 58086 - DNA, 538 bp, Homo sapiens
  misc_feature: GYAE6OF02GOV0Y.37.33.C11.1.454.CMB.1.raw
  modified_base (195)..(195): a, c, t, g, unknown or other
  misc_feature (195)..(195): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtagganacagagtcaccatcacttgccgggcagtcggactatagtacctggttggcctggtatcaacagaaaccagggaaacgcccctaaggtcctgatctatgatgcctccactttggaaacgcgggtacccatcgaaggttcagcggcagtgtatcgtgggacagaattcactctcacatcagtacgcctgcagcctgatgtatttgactaacttattactgtacagactactataagtggagtagtcgggacggacgggaccgtagggttagagtactacgaacgtacgtggtcggctcgacctaccgtacttcgttacgttccttacgtaccttcccgtaccccg

SEQ ID NO: 58087 - DNA, 672 bp, Homo sapiens
  misc_feature: GYAE6OF02JEYCN.37.33.C11.1.454.CMB.1.raw
tcagtagtgtagatcacgaccggtgctcgatttagagtgagctcgttggggtttggggggtcagactccagtcaggacacagcatggacatgagggtccccgctcagctcctggggctcctgctgctctggctcccaggagccaaatgtgacatccacgatgacccacgtctccttccacctcgttcctgcatctgtacggagacgagacgtcacctatccacttcgccggggtccacgggtccggacttacttaggtacctggttggcctaggttattcgaactacggaaaacctaggggaaacgtaccccgtaagggtccctcgtaatctactggatccgtcccttccgacgtttcgggaaagttccggggtaccctaggtccaacggttacaacggtccggacgtaggttcgttagtcgtaggggacgaagtaacttactacctactccaccatactaggtaacgcctaggccgacggtccctaggacttcggttactttcggaccttaactttattacctgtacaagtcctaacttagtacgtccggatcgtaccggacggacggacctagggttgaagtactaccgaacggtacgttgggtacgtccgtacgaccctaaccgtcgttccgtttaccgttaccgttacctaccgttccccgtaccccg

SEQ ID NO: 58088 - DNA, 698 bp, Homo sapiens
  misc_feature: GYAE6OF02JI0Y8.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagctgggttttccttgttgctattttagaaggtgtccagtgtgaagtgcagctggtggactcgtgggggaggcctggtccaggccgtggggggtccctggacgactctccgtgtcgcctaacctctggattcagttgtagtgattgtggagtgggttcggtccgccgaggcctccgaggggaaggggctgggaggtgggtggaccaagagtaaaggcgagagtaggaagcgaagaaatactagtgtaggtactcgtggtaggacgggggtcccgtagttccgaaaccgtagttccgtacccgaacgtaacgaacccgtaaacggacccaaaaggtaaacttaccgtaaactttaccgtttttacgaactaaaagtacggaaactacgttactggtaaagtaggtaaccgaacgggaaccacgggacccagttacggttaactttaccgtaggttaaccggaaagtaacggtaaaccgaacggtaaccggttacgggggtacccgaaccggggtaaccccggttcgggtaaccccgtacccgggttacccc

SEQ ID NO: 58089 - DNA, 539 bp, Homo sapiens
  misc_feature: GYAE6OF02GSGG5.37.33.C11.1.454.CMB.1.raw
  modified_base (236)..(236): a, c, t, g, unknown or other
  misc_feature (236)..(236): n is a, c, g, or t
  modified_base (407)..(407): a, c, t, g, unknown or other
  misc_feature (407)..(407): n is a, c, g, or t
  modified_base (424)..(424): a, c, t, g, unknown or other
  misc_feature (424)..(424): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttcctccctgtctgcatctgttagagacagagtcaccatcgcttggccgggcagtcaggacatccgnaattttgtagcctggtatcagcagagaccagggcaagttcctcaactcttgatcatgatgcatctcatttggacgccaggggtctcagttctcggttcaggtggcagcggatcgtgggacctcgtttcactctccaccatccacacgcccctcacgcctagaagtactgtntactaacgttattactntactaacgtatactacgaggtactcggtacccgtggtaccgttccgggcccgtaacggggaaccgtaagggtaacgtaacgtacgaacggtaccgtaacgttggtcgtacgtacg

SEQ ID NO: 58090 - DNA, 524 bp, Homo sapiens
  misc_feature: GYAE6OF02GXM7X.37.33.C11.1.454.CMB.1.raw
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (513)..(513): a, c, t, g, unknown or other
  misc_feature (513)..(513): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaacgcccctaaaggtcctgatctatgatgcctccactttggaaagcggggtcccagtcaaggttcagcggcagtgtatcgtgggacagaattcactctcacatcagtncctgcagcctnattgattttgactaacttattactgtcagtcacttaatagtaggagtacgttcggaccgagggaccgtagggttagagatacaaacggtacgtggtaggctgaccacgtatcctgttccttacncttccttcccg

SEQ ID NO: 58091 - DNA, 416 bp, Homo sapiens
  misc_feature: GYAE6OF02G2IHN.37.33.C11.1.454.CMB.1.raw
  modified_base (413)..(416): a, c, t, g, unknown or other
  misc_feature (413)..(416): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggccgccctgctccaggagcacctccgagagcacagcggccctgggctgcctggtcaaggactactccatctacactactgagcgggctggcaaggcgcatagnnnn

SEQ ID NO: 58092 - DNA, 593 bp, Homo sapiens
  misc_feature: GYAE6OF02GIC1V.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccagggagccaaagtggtggacagtccaaggactcgaccctaggtcctccttccaccctgtctgcatctgtaggagacagagtcaccatcacgttcgccgggcagtccggactattacgtacctggttggcctaggtactacaacagaaaccagggaacacccgtaaggtcctgatctatagatgcctcactttggaaacgtcgggtaccatcgaagttcagcggcagtgtatcgtgggacagtaatcactactcaccatcagtacgcgtggcacgtcctagtattgtacttttacgtacctaaactttacttacgttgtacctagtacctaacttaagttaacggtgggtaacgtacgttcgggaccgtaacggggtaccgtaggttaggaacgtagtacgaaacgtacgtaggtacgtcacggcctacgacttctacgttcctactacgtcccttacccg

SEQ ID NO: 58093 - DNA, 674 bp, Homo sapiens
  misc_feature: GYAE6OF02JDP55.37.33.C11.1.454.CMB.1.raw
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcgagtcaggacatccgactaattttgtacgcctggtatcagcagagacngggacagttccacaactnttagatctatgatgctatctctagtttgggacgtccggtaggggtctcgtacgttccgtttcggttacgaggtacggcgtacggcggtaacgttccgggtacgggtacccgttccttttacccgacttcccgtaccctaaccgtacttcccgaacccgtacgtccccctacccgtaaccgtaccctagggtaaacgtagttacggttacgtaccttaaacgtttacgttaaccgttcgtaacctaaaccgtacgttaattaccgaaggttacgttaccggttacccggttaggtacccggttccgggaccccggtaacgggtaacccgtaaagggttacggtaaacgtccgaacggtaaccgtacggtaggttacggccgttaaccgg

SEQ ID NO: 58094 - DNA, 430 bp, Homo sapiens
  misc_feature: GYAE6OF02HV21P.37.33.C11.1.454.CMB.1.raw
  modified_base (311)..(311): a, c, t, g, unknown or other
  misc_feature (311)..(311): n is a, c, g, or t
  modified_base (417)..(417): a, c, t, g, unknown or other
  misc_feature (417)..(417): n is a, c, g, or t
  modified_base (422)..(430): a, c, t, g, unknown or other
  misc_feature (422)..(430): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatccggtccttcccccnggccgccctgcctccaggcgcacctccgagacgcacacgccggccctggggctgcctggtacaaggctacttccatctacactactgacgcgggctggcaaggcgnatagnnnnnnnnn

SEQ ID NO: 58095 - DNA, 569 bp, Homo sapiens
  misc_feature: GYAE6OF02II5EC.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagcgtgggttttccttgttgctattttagaaggtgtccagtgtgaagtgcagctggtggactctgggggaggcctggtccagcctggggggtcccctgagactctcctgtgcaacctctggattcagttgtagtgattggttggagtgggttgggtccgccgaggctccgaggggaaggggcgtgggaggtggggtggaccgaacagtaaagcgagagtggaagcgaagaaatactaagtgtgactctgtgaggggccgattcacatctccacagacaacgaccaagaaatactaattctttttagactaaatagaactagtactgagagtacggaggaacgacggcctatgtattacgtagtaacgaaggagaacgagaccggttgggaccgaacgggaacccgtcggtccgaccgtccg

SEQ ID NO: 58096 - DNA, 801 bp, Homo sapiens
  misc_feature: GYAE6OF02HYA17.37.33.C11.1.454.CMB.1.raw
tcagtagtgtagatcacgaccggtgctcgatttagagtgagctcgttgggtttggggtcgagactcagtcaggacacagcatggacatgagggtccccgctcagctccgtggggcctccgtgctgctcgtggcctcccaggacgccaaaatcgtagacactccagatcgacccagtcctccttcccacctgtctgcactctgtagagacagacgtcacatcacttcggccgggcaggtccggacttagttacgtaccgttggttcggtcctggtaacgtacaaacgtagaaaaccgaagggaaacgtaccccgtaaaggtccctaggactcgtaagtcgtaacgtcgacccttcctaacgtttacgggaaacggtccggggtccccaaagtaccgtaagggtttccgacggtaccggactacggttacgtacgttccgtacggggaacaacggttaaactttccgtaaccgttaccgtacctaacccgtaattacccgtaagtaccgacccgtttacgacctaacggtacccgttaggtacgtttaacgtaacgttttacgaaccttaaaccttacgtttaacttcgtaaccgtagtacctaaacttagttaaaccggtaggggtaactacgggttaccggtaacccggaacggggttcccgtaaaggggtttacgaacgaacgttaaccggtaaacgttaaaccggtcggttaacgggtacgtaaccggtaaccgtaacccgtaagttacccggttacggtttaaccgttttacctaccgtttacccccgtttaccccgg

SEQ ID NO: 58097 - DNA, 550 bp, Homo sapiens
  misc_feature: GYAE6OF02HNJLW.37.33.C11.1.454.CMB.1.raw
  modified_base (195)..(195): a, c, t, g, unknown or other
  misc_feature (195)..(195): n is a, c, g, or t
  modified_base (397)..(397): a, c, t, g, unknown or other
  misc_feature (397)..(397): n is a, c, g, or t
  modified_base (427)..(427): a, c, t, g, unknown or other
  misc_feature (427)..(427): n is a, c, g, or t
  modified_base (489)..(489): a, c, t, g, unknown or other
  misc_feature (489)..(489): n is a, c, g, or t
tcagtagtgtagatcacgaccggtgctcgatttagagtgagctcgttggggtttgggggtcagactcagtcaggacacagcatggacatgagggtccccgctcagctcctggggctcctgctgctctggctcccaggagccaaatgtgacatccagatgacccagtctcctccaccctgtctgcatctgtagganacagagtcacatcacttgccggccagtcgatattagtacctggttggcctggtatcaacaacgaaaccgaagggaaacgcccccgtaaggtccctagactactatgatcgcctccacgtttaggaaaggtccggggtccctatcgaaggttcagcggcagtgtatcgtaggacagattcactctacacatcagtacgctgcngcctgatgtactttgactaacttatttacngttacagtctaactaataagtgggagtacgttcggaccggtaggtaccggtagggtagaagntaacgaacgtagtcggtagcgtacgactacgtatcgttgttaccgtctacttcccgtcccg

SEQ ID NO: 58098 - DNA, 568 bp, Homo sapiens
  misc_feature: GYAE6OF02IUE1X.37.33.C11.1.454.CMB.1.raw
  modified_base (281)..(281): a, c, t, g, unknown or other
  misc_feature (281)..(281): n is a, c, g, or t
  modified_base (427)..(427): a, c, t, g, unknown or other
  misc_feature (427)..(427): n is a, c, g, or t
  modified_base (492)..(492): a, c, t, g, unknown or other
  misc_feature (492)..(492): n is a, c, g, or t
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
  modified_base (548)..(548): a, c, t, g, unknown or other
  misc_feature (548)..(548): n is a, c, g, or t
  modified_base (555)..(568): a, c, t, g, unknown or other
  misc_feature (555)..(568): n is a, c, g, or t
tcagtagtgtagatcacgaccggtgctcgatttagagtgagctcgttgggggtttgggggtccctgagactctcctgtgcgaacctctggattcagttgtaggtgattgttggatgggttgggtccgccaggctccagggaaggggcctgggaggtgggtggccgaacataaagcgagatggaagcgagaaatactatgtggactcgtgtgaggggccgattcaccatctcacagacaacgccaaagaaatcaattcttttagcaaatgaacatactgagngtcgaggacaacggccatagtattactgtaacgagagaacaggtacgttggggaccaaggggaacccttgggtccaacccggttctcccgtcgaaggccctaccaccgaaacgggtccctagtccgggtcttacccccgtggcccnccctggcctaccgacgggacgaccacccgtccgtaagacgcgaacgacggccggccctggggacncgccgtggtacaaacggcttacgttccatctanacctacngagcggctggcaagcncatacgnnnnnnnnnnnnnn

SEQ ID NO: 58099 - DNA, 829 bp, Homo sapiens
  misc_feature: GYAE6OF02HXSZQ.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctgggggccctcgtcgtcgtcgtctcggtcgtcccaccggagggaccaacgtaagttggtacgactacctacgaagtacgtacccgtaaccgtacgttcccctttcccttacccctaccgttcgttacgtcgtactacgttcggttaggggtaacggacgaacggtaaggtaccgtacccaacttactaacctaccggttccggggaccccggaaccgttacggggtaccttaacgtttaacgttaaccggttacgggtttggggtccgtcggttaagttaaccaacgaacgaaaaccgaacgggtaaacggaccccgtaaccggtacgtcagtactactaggactcgtccgtaccctacgtttaggtaacgggaccggggtcccggaacttacgtacggttagtacggacggtcgagttaggttacttcgacgggtacggtaataacgttacctcctaccgttcaacctactatacggaacggtcctccggacgtaccgtacgtacgtacgttagttacgtttaactttaccgtaaacctttaactttaacgttacgtcgtaacgtaactaaccgttaagttaaacgtagggtacggtagtaccgggtaccggacgggtacgggtacgggtaggtagtaacgtaacgtaacggtaacgtggtcggaccgtacgtacacgtaactcgttcgttaccttctaaccttcccgttccctaacccg

SEQ ID NO: 58100 - DNA, 551 bp, Homo sapiens
  misc_feature: GYAE6OF02GIM1W.37.33.C11.1.454.CMB.1.raw
  modified_base (536)..(536): a, c, t, g, unknown or other
  misc_feature (536)..(536): n is a, c, g, or t
  modified_base (538)..(551): a, c, t, g, unknown or other
  misc_feature (538)..(551): n is a, c, g, or t
tcagtagtgtagatcacgaccggtgctcgatttagagtgagctcgttgggtttgggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccaagggaccctggtcaccgtctcctcacgcctccaccaacgggcccagtccggtccttccccctggccgcccctcgcctcccacgggacgccaccctccggagacgcacgacggccggcccgtgggcctcggtcctgggtaccgaaggtaccttaccttccaacttcctaaccactacgtacgacggcggtcgtggacgaaggccgactagtagngnnnnnnnnnnnnnn

SEQ ID NO: 58101 - DNA, 1091 bp, Homo sapiens
  misc_feature: GYAE6OF02F1KYG.37.33.C11.1.454.CMB.1.raw
tcagtagtgtagatcacgaccggtgctcgatttagagtgagctcgttggggtttggggtcgagacgtcacgtcaggacacgaagcgagtggtacattggagggtccccgcgtcagctacctggggctccgtgctcgctcgtggtcgtcccgaggagccaagtgttcgacgtagtcctagtagtgacctagtcgtccttccacccgtgtctcgtcgtagtcgtggtagggagacgtaggacgtcgacccgagtccgtaccgttggacccgggacctacggttcccggtaacttaagtttaacggtaccccgttgggtttcgggtaccctttacggttaacttaccgaaaacgaaccgtaaaaacccgtaaggggtaaaacccgtacccccgttaaaaggttcccgtacggaaccgtttacggttaccgtcggaacgttccgtccccgttaccggtaaccggtttaacggggaacggtaccgggggttacccgtaaggttaccgttaacggttacgtaacggtaccgggtacgtaaggttacggttaacgttacggtaacggggtaaacgttaacggttaaacgttaccgtaaaccgtttccgttaaccgaacccgttaacgtttaccgtaacggtttaaccggtaacccggttaccgggtaacctaacccggtacccgttaacgttaaacggtttacggtttaaaccgtttttaccggaaacccttttaaaacccgtttttaaacgttaaaacccggtttacggttaaaccccgtaaaccgttaaccctttaaaccgtttaaaccggtttaaacgggtaaccggggttaaaacggttttaaccggggtttaaaccccggggtaacccggggtttaaaaccgggggttaaaccccggggtttaaagggggttttaaaaccggggtaaaccgggttaaaaaccggtttaccccggaaaaaacgggtttaacccggtttaggggttaaccggttaaccgggttaaccgtaaccccggttaacgttacccgggtttacgtttaaacccgggtttaccggttttaaccggttacccgttaccccgtttacccccggg

SEQ ID NO: 58102 - DNA, 580 bp, Homo sapiens
  misc_feature: GYAE6OF02G3CIE.37.33.C11.1.454.CMB.1.raw
  modified_base (377)..(377): a, c, t, g, unknown or other
  misc_feature (377)..(377): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagccccctaaggtcctgatctatgatgcctccactttggaaagcgggtcccatcaaggttcagcggcagtgtatcgtgggacagaattcactctcaccatcagtancctgcagcctagatgtatttgactaacttatttactgttcagtaccacttaataagtggggtaagtacgttcgggacccggtaggggaacccgtaggggttacgaaggtaacgttaccgaaaacggtaaacgttgggtacgggaccgttacgaccgaacctacttccgttacggttcctttaccgtacttccctttacccccg

SEQ ID NO: 58103 - DNA, 629 bp, Homo sapiens
  misc_feature: GYAE6OF02JGNAG.37.33.C11.1.454.CMB.1.raw
  modified_base (290)..(290): a, c, t, g, unknown or other
  misc_feature (290)..(290): n is a, c, g, or t
  modified_base (569)..(570): a, c, t, g, unknown or other
  misc_feature (569)..(570): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(599): a, c, t, g, unknown or other
  misc_feature (598)..(599): n is a, c, g, or t
  modified_base (601)..(602): a, c, t, g, unknown or other
  misc_feature (601)..(602): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(611): a, c, t, g, unknown or other
  misc_feature (608)..(611): n is a, c, g, or t
  modified_base (613)..(613): a, c, t, g, unknown or other
  misc_feature (613)..(613): n is a, c, g, or t
  modified_base (615)..(616): a, c, t, g, unknown or other
  misc_feature (615)..(616): n is a, c, g, or t
  modified_base (618)..(618): a, c, t, g, unknown or other
  misc_feature (618)..(618): n is a, c, g, or t
  modified_base (620)..(622): a, c, t, g, unknown or other
  misc_feature (620)..(622): n is a, c, g, or t
  modified_base (624)..(627): a, c, t, g, unknown or other
  misc_feature (624)..(627): n is a, c, g, or t
  modified_base (629)..(629): a, c, t, g, unknown or other
  misc_feature (629)..(629): n is a, c, g, or t
tcagtagtgtagatcacgaccggtgctcgatttagagtgagctcggttggggttgggtccgccaggctccagggaaggggctggagtgggtggccaacataaagcgagatggaagcgagaaatactatgtggactctgtgaggggccgattcaccatctccacagacaacgccaagaaatcaatcttttgcaaatgaacagtctgagagtcgaggacacggcatgtatactgtacgagagaacagacttggggaccaagggaacccgtggtacaccgtactcctacgacnggaccctacggacccctaaagggggccccctaattccccgggtagttccccccccttaggggtccggacccccttacggaccgttaccccaacggggtaaccgtcccgaaccccgttcccggaacgaacggaccgaacccgtaaacggtccgggggaccccctttaggggggaccccttaggggaccccttaagggggtcccaaaggggtaccctaacgtttcccaagtcctaacgactaacgtcggaagtcggggactagggacaaggcgtacatagnnganagancganannananananananannannananannnnanannanannnannnnan

SEQ ID NO: 58104 - DNA, 498 bp, Homo sapiens
  misc_feature: GYAE6OF02FG41C.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggcagtcggactattagtacctggttggcctggtatcaacagaaaccagggaaagccccctaaggtcctgatctatgatgcctccactttggaaagcggggtcccatcaaggttcagcggcagtgtatctgggacagaattcactctcaccatcagtagcctgcagcctgatgtattttgctaacttattactgtcagcactataatgggagtattccgggcgacgggacagggttgagatacaacgatgtggctgcacactctagtctcatcgttaccccg

SEQ ID NO: 58105 - DNA, 567 bp, Homo sapiens
  misc_feature: GYAE6OF02IWMHR.37.33.C11.1.454.CMB.1.raw
  modified_base (100)..(100): a, c, t, g, unknown or other
  misc_feature (100)..(100): n is a, c, g, or t
  modified_base (168)..(168): a, c, t, g, unknown or other
  misc_feature (168)..(168): n is a, c, g, or t
  modified_base (190)..(190): a, c, t, g, unknown or other
  misc_feature (190)..(190): n is a, c, g, or t
  modified_base (316)..(316): a, c, t, g, unknown or other
  misc_feature (316)..(316): n is a, c, g, or t
  modified_base (388)..(388): a, c, t, g, unknown or other
  misc_feature (388)..(388): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggagccaaatgtgaccatccagatgacccagtcnccttcaccctgtcctgccatcngtaggagacagagtcaccattcaacgttgccggggtccaagttccggactattgtacctggtggcctggtatcaacagaaaccaggaagccctaaggcctgatcatgactgctcactttggaacgngggtaccagtcgaagttcagcggctagtcgtatctgggactaggaacttcaactcacgacctagtcacgtancctagcagcctagattcgtaatttcgactaacttatacttgtacagtacaacgtagtaagtgggtacgtaagttcgggaaccgtagggtaaccgagggttagaacgtagtaccaaacggtacgttaggtacgtctacggcctaccgtagttcctagttcctacgtacttcccgtacccg

SEQ ID NO: 58106 - DNA, 552 bp, Homo sapiens
  misc_feature: GYAE6OF02FJO65.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccagggaaacgcccctaaggtccctgatctatgatgcctccactttggaaagcgggtccatcaaggttcagcggcagtgtatcgtgggacagaattcactctcaccatcagtacgcctgcagcctgatgtatttgctaacttattactgtacagctactaataagtgggtagtacgttcgggaccggaagggaccgtaggggttgaagtactacgaaacggtaacgtggtacggactacggaccaaccgtacttccgttagttacctttcctacgttcccgttacccccg

SEQ ID NO: 58107 - DNA, 609 bp, Homo sapiens
  misc_feature: GYAE6OF02H3LU5.37.33.C11.1.454.CMB.1.raw
  modified_base (478)..(478): a, c, t, g, unknown or other
  misc_feature (478)..(478): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgagagacagagtcaccatcacttgccgggcagtcggactattacgtacctggttgcctggtatacaacaagaaaccagggaaacgcccctaaaggtcctagatactatgatgcctcacttggaaagcgggtcccagtacaagtcgagcggcagtgtaatctgggaactaagaatttcactacttacaaccattaccaaggttacgaccttgaccaaggtcctgaattagtactttagtactaaatttactttaacgttcgtactaagactaactaattaaagtgggtaanacgttcgggaccgtaacggggccgtaaagggtttagaacgtatacgaaaacgtacgtaggtacggtacgttacggaacctaaccgtacgttacgttaccgttcgtaaccgttaccttaccgttacccccgg

SEQ ID NO: 58108 - DNA, 775 bp, Homo sapiens
  misc_feature: GYAE6OF02HPP2X.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactatacgtacctggttggcctggtatcaaacgaacgaaaccgaagggaaacgtacccccgtaaggtccctagattaccttatgtaatcggaccttcctacgtttagggaaacggtcccggggtacctaacgttaccgtaacgggtttcgaacggtacgggtacgtaaggttacggtagttaccggtagggggtaacctaaaggtaaaccttttaccaaccttacctacctaaccctaataccggtaaggttaccggtacccgtaggaccgtaacggtccccttaggtaaacgtttacgttaaggttttttaccggaaacctttaaaccgtttaacgtttttaacccgtagggtttaccaaacggttaacctaacgtttaaagttaaacggtaagggggtacgtacggtttacccggggacccgggtaacgggggtaaccgtagggttacgaagtaacgtaaccgtaaacggtaacgttcgggtacggtacgtacgaccctaacgtacgtttacgtaccgttaccgtttactaccttcccgtaacccg

SEQ ID NO: 58109 - DNA, 550 bp, Homo sapiens
  misc_feature: GYAE6OF02H4NZ8.37.33.C11.1.454.CMB.1.raw
  modified_base (151)..(151): a, c, t, g, unknown or other
  misc_feature (151)..(151): n is a, c, g, or t
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (338)..(338): a, c, t, g, unknown or other
  misc_feature (338)..(338): n is a, c, g, or t
  modified_base (527)..(527): a, c, t, g, unknown or other
  misc_feature (527)..(527): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagcctaaatgtgacntccaggatgacccagtctccttccaccctgtctgcatctgtagganacagagtcacatcacttgccgggcagtcgactatagtacctggtgctggtatcaacaagaaaccgaggaacgccctaaggtcctagatctagngatgcctcagttggaacgcgggtaccatcgaagttcagcgcagtgtangtggacagtatcactccacaacctagtactagtagcctgacacgtctgactgtactttgacttaacgtttattactagcgtacgtacaacgttagaagttcggaagttcggttacgggaccggtaagggcggtaaggtacgaagtagtaacgaaacgtgtcggtcggtactagacctaccgtattccgntttacgtactccgttctaccccg

SEQ ID NO: 58110 - DNA, 571 bp, Homo sapiens
  misc_feature: GYAE6OF02GYS7S.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggtggcctggtatcaacagaaaccagggaaacgcccctaaggtcctgatctatgatcgcctcctacgtttgggaaacgcggggtcccagtacgaaaggttcaggcggacagtgtatcgtgggacagaattcactctcacctatctagtagcctgacagcctgatgtattttcgacttaactttattactgtacagtctaacttataagtgggtacgtagttccgggacggtaagggaccgtagggttagaagtacgtacgaaacgtaacgttggacggtactacgacctacctagttccgttagttaccttacgtaccttccgttaccccg

SEQ ID NO: 58111 - DNA, 709 bp, Homo sapiens
  misc_feature: GYAE6OF02HHEF0.37.33.C11.1.454.CMB.1.raw
  modified_base (666)..(666): a, c, t, g, unknown or other
  misc_feature (666)..(666): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgaccagtctcctccaccctgtctgcatcgtgtaggagacagacgtcaccatcacgttcgccggctagtcgtactagttacgtacgtggtcgcctaggtatacgaaacgaacgaaaccgaacggtaaacgtcccccgttaaggtcctaggtaacttccgtagtcgtactcggacccttaccgtaacggtttacgggaacggtccgggtacctaagttaccgtaaggttccgacggccggtacgtaggttacgtacgtacggtacgggtaactacgtaacttaccgtaactcgtaaccgacctagtacgtaacgtccgtccgttagaaccgtcgtaccttaggtaacttacggttaacgtttacgaactttaaaccgttttaagtccgttacgtaacgaactaacgtaagttaagtaacgggtaggtacggttacggtaccgggacgggtaaggtaacggtaggaacgtaagtacgaacgttaacggtcgtacggacctacgtacgtaccnccgttacgttcctaccgtttcctacgttaccgtcccgtaaccc

SEQ ID NO: 58112 - DNA, 603 bp, Homo sapiens
  misc_feature: GYAE6OF02GCJR8.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcgactattagtacctggttgctggtatcaacagaaacagggaaacgcccctaaggtcctgatctatgatgcctcctacgtttaggaaacgtccgggggtacccagtacgtaaggttcaggtcggcagtgtagtcgtggacagtaattcactctaccacctactacgagtacgcctgcacgccttgatgtatttgacttaacttattactcgtacagtactaactaacgtaagtggggtatacggtttccggaccgggtaagggaaccgtaggggttacgaagtaacgttaccgaaacggtaacgttagggtacggtacgttacggaaccgtacccgtacgttaccgttacgttcctttacctacgtttcccttaccccg

SEQ ID NO: 58113 - DNA, 469 bp, Homo sapiens
  misc_feature: GYAE6OF02GM45J.37.33.C11.1.454.CMB.1.raw
  modified_base (316)..(316): a, c, t, g, unknown or other
  misc_feature (316)..(316): n is a, c, g, or t
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (437)..(469): a, c, t, g, unknown or other
  misc_feature (437)..(469): n is a, c, g, or t
tcagtagtgtagatcacgaccggtgctcgatttagagtgagctcgttgggttgggtccgccaggctccagggaaggggctgggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcacgtctcctcagcctccaccaagggccccatccggtcttcccccnggccgccctgcctccaggagccaccctccgagagccacagccggccctggggctcgccgtggtcaaggctacttccatccacactacngagcgggctggcgaaggcgacatagcngnangnnnnnnnnnnnnnnnnnnnnnnnnnnnnnnnnn

SEQ ID NO: 58114 - DNA, 670 bp, Homo sapiens
  misc_feature: GYAE6OF02G56AS.37.33.C11.1.454.CMB.1.raw
tcagtagtgtagatcacgaccggtgctcgatttagagtgagctcgttggggtttgggggtcagactcagtcaggacacagcatggacatgagggtccccgctcagctcctgggctcctgctgctctggctcccaggagccaaagtgtggacatccagatgacccagtctccttccaccctgtctgcatctgtaggagacagagtccaccatcacttgccgggcagtcggactatagtacctggtggcctggtatcaacgagaaaaccgagggaaacgccccttaaaggtcctagattcgtagtgtaatcgcccttcctaacgtttaggaaacggtccggggttaccccaagtaccgtaaaggggttccaacggtcggactaggtagtaacgttcgtacggggtaacaaggtaaactttcgaactttcctacaacccgtaataccgtagtacgtccctgccagccctagattagttattttcgaccttaagtttactttactaggttacacgtactaattacgtaaggttagggtagtacggttaccgggaccggttaaggggaccggtaacggtaggtacgtaagttaccggaaccgttaacggttcggtagggtacctacgaccgtaacctacggttccttgtttaccttacacgttccccttaacccg

SEQ ID NO: 58115 - DNA, 494 bp, Homo sapiens
  misc_feature: GYAE6OF02HCECE.37.33.C11.1.454.CMB.1.raw
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
  modified_base (451)..(452): a, c, t, g, unknown or other
  misc_feature (451)..(452): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (475)..(479): a, c, t, g, unknown or other
  misc_feature (475)..(479): n is a, c, g, or t
  modified_base (481)..(482): a, c, t, g, unknown or other
  misc_feature (481)..(482): n is a, c, g, or t
  modified_base (484)..(486): a, c, t, g, unknown or other
  misc_feature (484)..(486): n is a, c, g, or t
  modified_base (488)..(494): a, c, t, g, unknown or other
  misc_feature (488)..(494): n is a, c, g, or t
tcagtagtgtagatcacgaccggtgctcgatttagagtgagctcgttgggtttgggggaagaggaagactgacggtccgccaggctccagggaagggggctggagtgggtggccaacgactaaagcgagatggaagcgagaaatactatgtggactctgtgaggggccgattcaccatctccacagacaacgccaagaaatcaagtctttttgcaaatgaacagtctgagagtcgaggacacggccatgtattactgtacgagagaacagacttgggccagggaaccctggcaaccgtcacctcagcctccaccaaggcccatcggtcttaccccctggccnccctgctccgaggacgcaccctccgagancaacagcgccctaggctgctcccggtanaaggacctactccatctaacnctacngagcgggcnggccaaggccnactagnngntcnactcangctacngcacgnnnnncnngnnncnnnnnnn

SEQ ID NO: 58116 - DNA, 545 bp, Homo sapiens
  misc_feature: GYAE6OF02GSBIK.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagctgggttttccttgttgctattttagaaggtgtccagtgtgaagtgcagctggtggactcgtgggggaggcctggtccagccgtggggggtccctgagactctcctgtgcaacctctggattcagttgtagtgattgttggatgggttgggtccgcaggctcgagggagggctggagtgggtgccaacataaagcgagatgggaagcgagaaatactaatgtaggactgtgtggagggcgatcaccatctaccagagacaaccgaccaaaactcaactgtactctagactaaagtcggaaccggcctaggacgacgtaccgaaggaccgacggctgtagttagttattggtgcgaggtagtatttagacttaacgtaagtttcggattggatagg

SEQ ID NO: 58117 - DNA, 423 bp, Homo sapiens
  misc_feature: GYAE6OF02IO1M2.37.33.C11.1.454.CMB.1.raw
  modified_base (329)..(329): a, c, t, g, unknown or other
  misc_feature (329)..(329): n is a, c, g, or t
  modified_base (408)..(408): a, c, t, g, unknown or other
  misc_feature (408)..(408): n is a, c, g, or t
  modified_base (413)..(423): a, c, t, g, unknown or other
  misc_feature (413)..(423): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttcccccgtggccgccctgctccaggancacctccgagagcacagcggccctgggctgcctggtcaaggctacttcatctacactactgagcgggctggcaaggcgnatagnnnnnnnnnnn

SEQ ID NO: 58118 - DNA, 567 bp, Homo sapiens
  misc_feature: GYAE6OF02IXH12.37.33.C11.1.454.CMB.1.raw
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccgaggagccaaatgtgacatccagatgacccagtctccttccaccctgtctgcatctgtaggagacagatcaccatcacttgccgggcaggtcgactattagtacctggttcggctggtancaacagaaaccagggaaacnccccgtaaggtcctgatctatgatgcctctatttggaaacggtcgggtcccagtcaaggttcagcggcagtntatcgtagggacagaattcgactctacactatcaggtacnctgcacgcctagatgtattttcactaacttacttacgtgtaacacgtcaacttagtaagtggggtaactacggttccggacggtaacgggtaccggtagggtttacgacgtacgttacgaaaccgtagttcggtacgcgtcgacctacgtacttcgttcttacctattaccgtccttccccg

SEQ ID NO: 58119 - DNA, 703 bp, Homo sapiens
  misc_feature: GYAE6OF02I0RGO.37.33.C11.1.454.CMB.1.raw
  modified_base (135)..(135): a, c, t, g, unknown or other
  misc_feature (135)..(135): n is a, c, g, or t
tcagtagtgtagatcacgaccggtgctcgatttagagtgagctcgttgggtttgggggtcagactcagtcaggacacagcatggacatgagggtcccgctcagctcctgggctcctgctgctctggctccagganccaaatgtgacatccagatgacccagtctccttccacctgtctgcatctgtaggagacaggactcaccacctacttcggccgggcctaggtcggacttagttacgtacctggttacggcctggtaactcaacaacgaaaccgaaggggtaaactccccgtaaaggtccgtagtaacttactaatggactcggacctcgtacgtttacggaacggtccggggtcccatacgtaacggttcagtcggatagtcgtatcgtaggactagacttacacgtctaccactactcgtagtacgaccttgacgtacgtacctgtacgttagtacgtttacgaccgttaaacttttacttacgttacgttacggtactaccgttaaacgtaattaaacgggttacggaacggtttaccgtaccgggtaccggtaacgggttaccgtaaggggttacggaaacgtacgtaacccgtaaacggtaccggttacggtaacgggaccgttacgtaccgtaacccgttacgttaaccgtttcgttaccgttaaccgttaccgtttacccgtacccgttaacc

SEQ ID NO: 58120 - DNA, 651 bp, Homo sapiens
  misc_feature: GYAE6OF02HQJ35.37.33.C11.1.454.CMB.1.raw
  modified_base (290)..(290): a, c, t, g, unknown or other
  misc_feature (290)..(290): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagcctaaagtgtggactagtccaaggactcgaaccctagtctccttccacctgtctgcatctgtaggagacagacgtcaccatcacttcggccgggccagtcggactattacgtacctggttggcctggtatcaacgagaaaccgagggaaacnccccgtaaggtcctagatctatagactcgccttacctacgtttagggaaacgtccgggtacccagtaccgtaaacggttcaaggcggtactagtgttaactcggtgggaaactagtaaacttcaacttctccaaccatcgagtacgcctcgacacgcctgtacttaggttacttttacgaccttaaacgtttatttaacgtcgttacaacgtacctaacgttaagtaagtcgggtaagtcgttaccgggacgtacggggaaccgttagggtagtaagtaacgtacgtaaaccgtacggtcggtacgtcgtacgtacccacgttacgttacgttcgttaacttcctacgttacccttacccg

SEQ ID NO: 58121 - DNA, 441 bp, Homo sapiens
  misc_feature: GYAE6OF02HM6B8.37.33.C11.1.454.CMB.1.raw
  modified_base (409)..(409): a, c, t, g, unknown or other
  misc_feature (409)..(409): n is a, c, g, or t
  modified_base (435)..(441): a, c, t, g, unknown or other
  misc_feature (435)..(441): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaaatctttttgcaaatgaacagtctgagagtcgaggacacggcatgtattactgtacgagagaacagacttggggccagggaaccctggtcaccgtctcctcacgcctccaccaacgggccccagtccggtccttccccctggccgcccctgcctccgaggacgcacccgtcgagacgcacagccgcccgtgggctcgcctggtacaaggctacttccatctacactacngacgcgggctggcgaaggcgcatagnnnnnnn

SEQ ID NO: 58122 - DNA, 909 bp, Homo sapiens
  misc_feature: GYAE6OF02HA79F.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatcgtgtaggagacagagtcacatcactgccggcagtcgactattacgtaccgtggttcggcctggtactacaaacgaacggaaaccgaagggaaacgacccccgttaagggtccctaggacttcgtagttgactcgtcccttaccgtaacgtttacgggaaaacggtccggggtacccaagttaccggtaaaggtttccgaacggtccgggtacgtagggttacggtttaacgttaccggtaacggggtaaactaacgggttaaaactttcccgtaacctttacccgttaaccctaaaccccgtaagttacccggtaaacgttaacccggtccccgttacgggaacccgtaacggtacccggttaaggttaacgtttacggtttaacgttttttaaccggaacccttttaaaaccgtttttaaccgttttaaccgtttacggttaacccgttaacggttaacccttaaacgtttaaaacggtttaaacgggttaacgggggttaaacggtaccgggttttaacccgggggaacccgggttaacgggggtaaacccgggttaacgggggtttaacggaacgttaaaccggttaaaccggtaaaaccgggttaaccgggttacgggttaccgggtacgttacccgggtaacccgtacccgttaacgtttacccggtttacggtttaacccttttcccgttaccgtttcccccggtttaaccccgg

SEQ ID NO: 58123 - DNA, 580 bp, Homo sapiens
  misc_feature: GYAE6OF02I9HJ3.37.33.C11.1.454.CMB.1.raw
  modified_base (565)..(565): a, c, t, g, unknown or other
  misc_feature (565)..(565): n is a, c, g, or t
  modified_base (569)..(580): a, c, t, g, unknown or other
  misc_feature (569)..(580): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggaggtgggtggccaacataaagcgagatggaagcgagaaatactatgtggactctgtgagggccgattcaccatctccacagacaacgaccaaagaaatcaattctttttgacaaatgaacagtctgagagtcgaggacacggccatgtattactgtacgagaagaacagacgttggggccagggaaccctggtcaccgtctcctcacgcctccacgaacggcccactccggtccttcccctcggccgtccctcgcctccaggacgccaccctccggaacgacgcaccgacggccggcccggtgggcctcggtccctgggtaccaaacggaccttaccgttcccagtttacctaaccaaccttacgtcggacggtccggggaccgttacgggaccgaaacgggccgaccagttaacgtnacgnnnnnnnnnnnn

SEQ ID NO: 58124 - DNA, 580 bp, Homo sapiens
  misc_feature: GYAE6OF02HBNQ5.37.33.C11.1.454.CMB.1.raw
  modified_base (269)..(269): a, c, t, g, unknown or other
  misc_feature (269)..(269): n is a, c, g, or t
  modified_base (552)..(552): a, c, t, g, unknown or other
  misc_feature (552)..(552): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccacctgtctgcatctgtaggagacagagtcaccatcacttgccgggcagtcgactattagacctggtgcctggtatcaacagaaaccgagggaaacnccccgtaaggtcctagatctatgatcgcctacacgtttaggaaacgtcgggtccagtcgaaggttcaggcggcagtgtatcgtgggacagaattcactctcacatcagtacgctgcagcctagacttgtacttttcgacttaaacgtttatttacgtgtacacgtactaacgttaagtaaggtagggtaacgtacgtttacgggacccgtaagggtaaccgtagggtacgaagtactaacgtaaacgtacgtggtcggacttcggaccctacgtacttacgtnttaccgttactaccgttcccgttacccg

SEQ ID NO: 58125 - DNA, 597 bp, Homo sapiens
  misc_feature: GYAE6OF02FWD6G.37.33.C11.1.454.CMB.1.raw
  modified_base (348)..(348): a, c, t, g, unknown or other
  misc_feature (348)..(348): n is a, c, g, or t
  modified_base (376)..(376): a, c, t, g, unknown or other
  misc_feature (376)..(376): n is a, c, g, or t
  modified_base (419)..(419): a, c, t, g, unknown or other
  misc_feature (419)..(419): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggcagtcgactatagtacctggttggcctggtatcaacacgaaaccagggaaacgcccctaaggtcctagatctatgatcgccctctacgtttggaaacgtccgggtaccatcgaaggttcaggcgctagtntatcgaggacagtaatcactctacacanacagtacgctgcgtacgtctgatcgttatttcgacttaacttntttacgtgtacctagccttaattaagtaacgtagggtacgtacggttcgggtacccggaaggggtaacctagggtttacgaaggtaacgttaaccggaaacgtaacgttcggtacggtacctacgtacctaaccgtacgttcctacgttactttaccctacgtttcccgttacccccg

SEQ ID NO: 58126 - DNA, 707 bp, Homo sapiens
  misc_feature: GYAE6OF02IRCN9.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacatccagatgacccagtctccttccaccctgtctgcatctgtaggagacaggagtcaccatcacgttgccgggccagtcgactatagtacctggtgccttggtatacaacgaacgtaaaccagggaaacgacccctaaggtcctagatacgtatgtatcgcctacctacgttttaggaaacggtccggggttaccctagtacgtaaaggtttccgaagtccgggtacgtaacggttagtaacgttcggtacgggaactaacggtaaacttacccgtaacttacctacctaacccgtaagttaccgtaacgtaaccgtacccgtacggtaaccgaccggtccgttacggtaacgttcgttaacgtttttaccggtaaccttaaaccgttttaacttacttcggttaccgtaacgtaccctaacttaacttaaaggtacgggtaagtaccggttacgggacccggtaaggggtaccgtagggttaggacgtacgtaccgaaaggtaccgtaggtcggactcgacctaaccgtctcgttgttacctacctacgtccttacccg

SEQ ID NO: 58127 - DNA, 548 bp, Homo sapiens
  misc_feature: GYAE6OF02G6RJW.37.33.C11.1.454.CMB.1.raw
  modified_base (344)..(344): a, c, t, g, unknown or other
  misc_feature (344)..(344): n is a, c, g, or t
  modified_base (393)..(393): a, c, t, g, unknown or other
  misc_feature (393)..(393): n is a, c, g, or t
  modified_base (532)..(533): a, c, t, g, unknown or other
  misc_feature (532)..(533): n is a, c, g, or t
  modified_base (535)..(537): a, c, t, g, unknown or other
  misc_feature (535)..(537): n is a, c, g, or t
  modified_base (539)..(548): a, c, t, g, unknown or other
  misc_feature (539)..(548): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgagggccgattcaccatctccacagacaacgccaagaaatcaatctttttgcaaatgaacagtctgagagtcgaggacacggccatgtattactgtacgagaagaacagacgttgggccagggaccctggtcaccgtctccncacgcctacccaccgaacgggcccagtccggtccttcccccgtgggccnccctcgcctccgaggacgccacccgtccgagacgcacgacggccggcccgtgggctcggccttgggtcaaacggtaccttaccttccaattctaaccgtactacgtgacggcgggtcgtgggacaagggcgactatagnngnnngnnnnnnnnnn

SEQ ID NO: 58128 - DNA, 722 bp, Homo sapiens
  misc_feature: GYAE6OF02G2D8B.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacatccagatcgacccagtcctccttccaccctgtctgcatctgtaggagacagagtcaccatcacttgccggcagtcggatagttagtacctggttgcctggtatcaacgagaaaccgagggaaacgaccctaaggtcctagactcgtatgatcgtcctccgacgttttagggaaacggtcggggtaccccaagttacgaagggttcaaggccgcgtaggttagtattcgtagggaactaacggtaacttacgaaccgttcctacccgtaaccctacgttaccgtacggtaacgcccgttacggaccgacgtccctagtaacgtgtttacgttttacgaacgtttaactttacgttacgttacgttacagttaacccgtaattaaaggttagtacggggtaagtaccggtttaccgggaccggttaacggggaacccggttaggggttaacgtaacggtaacggttaaccgtaaaaccggtacggtttcgggtacggtaccgttacggacccgtaaaccgtacgtttccggttaaccgtttcctttaaccgttaccgttccccgttaacccccgg

SEQ ID NO: 58129 - DNA, 589 bp, Homo sapiens
  misc_feature: GYAE6OF02IJAWK.37.33.C11.1.454.CMB.1.raw
  modified_base (403)..(403): a, c, t, g, unknown or other
  misc_feature (403)..(403): n is a, c, g, or t
  modified_base (554)..(554): a, c, t, g, unknown or other
  misc_feature (554)..(554): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttcgccgggccaggtcggactattagtacctggttggcctggtactacaacacgaaaccgagggaaacgcccctaaggtcctgatctatgatcgcctcctacgtttaggaaacggccgggtaccaagtacgtaaggttcaggcggacagtgtactcgtgggacagtaatcactctcacatcgagtacgtccngcagcctgtatgtatttcacttaactttactttacgtgttactagctaacttaagttaacgagggtacgtacgttccgggaaccggtacgggaccggttaagggtgaacgtaacgtacgaaacgtagtcggtacggctacgaccaaccgtnttacgttcgttacctttctaccttcccgttacccg

SEQ ID NO: 58130 - DNA, 705 bp, Homo sapiens
  misc_feature: GYAE6OF02FWA67.37.33.C11.1.454.CMB.1.raw
  modified_base (279)..(279): a, c, t, g, unknown or other
  misc_feature (279)..(279): n is a, c, g, or t
tcagtagtgtagatcacgaccggtgctcgatttagagtgagctcgttgggtttgggggtcgagactcagtcgaggacacagcatggacatgagggtccccgctcagcctcctgggctcctgctgctctggctcccaggagccaaatgtgacatccagatgacccagtctccttccaccctgtctgcatctgtaggagacagagtccaccatcacttcggccgggccaggtcggactatagtacctggttcgcctggtatcaacagaaaccagggaaacncccgtaaggtcctaggatacgtatggactcgcctacgtaacgtttaggaaacggtcggggtaccctagtacgtaaggttccaaggtaccggtacgaggttcgtaacgttcggtaggggtacaaggtaacttaccacttccgtacacctacgtacgtaacgtacgtcccgtcgacctacggccttaggtagttacgttacttttcggaaccttaattaacggtttactcgttaccgacgtactaacgttaagttaagtaggggtaactacggttccggggaacgttacgggggtaccttaaggggttagaacggttaacgtaccgaaaacgggtacggttacgggtacgggtacgtacggtaaccgtaaccgtacgtttacggttaccggttacctttacccggttacgttaccccgttacccccgg

SEQ ID NO: 58131 - DNA, 549 bp, Homo sapiens
  misc_feature: GYAE6OF02G9UZ9.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccgagggaaacgcccctaagctacctcatctatggtgcatccatttacaaacgtcggggtaccattaagattcagcggcaggtggatctggcacagatttcactctacacatcagcagcctgcagacctgaagtatttagactaactttattactgtcagtcctataagttaacgtaggggactagttccgggaccggtagggaccgtagggttagagtagtaaccgtaaacggtacgttggtacggtccgttaggaccactagtaccgttcgttcttccttaccg

SEQ ID NO: 58132 - DNA, 856 bp, Homo sapiens
  misc_feature: GYAE6OF02JKVBD.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtcctccttccacctgtctgcatctgtaggagacagacgtccaaccatccacgttggcccgggccacgtcggaacttagttacgtaccgtggttcgtctggtactacaaactaacgaaaccgaagggaaacgaccccgtaaggtacctagtactcgtagtgactcgtccttaccgtaacgtttacgggaaacggtccggggtaccctaagttacggtaacggttcgacgggtacggtacgtaggttacgttacgtcggtaacggggtaactaaggttaacttaccgtaaccgttacctacctaaccgtacgtaccgtaacggttaccgtacccgttaggaccttaacggtccgttaacgggttacgttttaacggtttacgttttaaccgaaacccgtttttaaaaccggtttacgttttaacccgttaacgggttaaccctaacggtaaacctttaacggttaaaacgttaacggggttacggggtaaacgtttaccgggtttaacccgggggaaaccgggttaccggggggtaaaccgtttaagggggttaaaccggaacggttaaaccggtaaccgtaaaaccgggtttacgggtaacgggttccgggtaactaaccggtaacctaaccgttaccgtttaaccgttcgttttaaaccccgtaccgtttacccgttccccggttaacccg

SEQ ID NO: 58133 - DNA, 562 bp, Homo sapiens
  misc_feature: GYAE6OF02HH31P.37.33.C11.1.454.CMB.1.raw
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccacctgtctgcatctgtaggagacagatcaccatcacttgccggcagtcgactatagtacctggtgcctggtatcaacagaaccagggaacgccctaaggtcctgatctatgatcgcctccagtttggaaaggcgggtcccagtcgaaggttcaggcggactagtgtatcgtagggacagtattcactctcgacatcagtacnctgcacgcgtnattgtattttgaccttaactttattactcgtacacgtactaagttagtaagttagggagtacgttcgggacggagggtaccgtagggttacgaagttacgtacgaaacggttagtcggacgggtactacgacctacgtactccgttagttccttacttaccgttcccgttaccccg

SEQ ID NO: 58134 - DNA, 781 bp, Homo sapiens
  misc_feature: GYAE6OF02II36A.37.33.C11.1.454.CMB.1.raw
  modified_base (590)..(590): a, c, t, g, unknown or other
  misc_feature (590)..(590): n is a, c, g, or t
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacatccagatgacccagtctcctccaccctgtctgcatctgtaggagacagacgtcacctatctacgttggccgggcaagtcggacttagttacgtaccgtggttggccttggtactacgaacgacggaaaaccagggtaaacgaccccgtaaagggttcctggtaacttactaagtacggtaacgtacgtcccttacgttaacgtttacggggaaaccgtaccgggggtaccctaacgttacgaaacggggtttacgacggtacggaccttacgggttacgttacgttacggttaacggggaactaaggtaaactttacctaacgttccttaaccgaacccttataccgtaagtaacccgtccgttaaggcctacggacccgtaggtaacgttagttaaaccggttttggaaacctttaaaccggttattttaaccgggttcnccgttaaacgtctaaaccgtttaagtaacgggttacgggtaacgttaaggtttcccggggaaccggtaaagggggtacccttaaaggggttcgaacggtaaccgttaaccgaaaacgggtcgtaggtacggtaccctacggtaccaccgttacgtacgttaccggttacctaacgtccgtttccgtacccg

SEQ ID NO: 58135 - DNA, 479 bp, Homo sapiens
  misc_feature: GYAE6OF02HFTKQ.37.33.C11.1.454.CMB.1.raw
  modified_base (397)..(397): a, c, t, g, unknown or other
  misc_feature (397)..(397): n is a, c, g, or t
  modified_base (428)..(428): a, c, t, g, unknown or other
  misc_feature (428)..(428): n is a, c, g, or t
  modified_base (457)..(479): a, c, t, g, unknown or other
  misc_feature (457)..(479): n is a, c, g, or t
tcagtagtgtagatcacgaccggtgctcgatttagagtgagctcgttgggttgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagtacggagtatagcagcagctctgactactggggccacggaaccctggtcaccgtctcctcagcctccaccaacgggcccatcggtccttccccctcggccaccctccctccaagacgcacccgtcgtcggggcacgacgcggccctgggcngcctggtcaggactactccatctacactacngacggcggctacggcaaggccgcgatagnnnnnnnnnnnnnnnnnnnnnnn

SEQ ID NO: 58136 - DNA, 484 bp, Homo sapiens
  misc_feature: GYAE6OF02GDITG.37.33.C11.1.454.CMB.1.raw
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (470)..(473): a, c, t, g, unknown or other
  misc_feature (470)..(473): n is a, c, g, or t
  modified_base (475)..(484): a, c, t, g, unknown or other
  misc_feature (475)..(484): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgaggggccgattcaccatctccacagacaacgccaagaaatcaattctttttgcaaatgaacagtctgagagtcgagacacggccagtgtattactgtacgagagaacagacttggggccagggaccctggtcaccgtctcctcagcctcacaggccatcgtctccctgcncctgctcagcncacctcgagagcacagcgccgtggcctgcctggacacggactactccatctacactactgacggcggctgcgaaggcgacgagagnnnntnnnnnnnnnn

SEQ ID NO: 58137 - DNA, 586 bp, Homo sapiens
  misc_feature: GYAE6OF02J1HX5.37.33.C11.1.454.CMB.1.raw
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
  modified_base (557)..(586): a, c, t, g, unknown or other
  misc_feature (557)..(586): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaagggccgtttcaccatctccagagacaacgccaagaactccgtgcatctgcaaaatgaacagtctgagagcccgaggacacggctaatttattactgcgcgagagaacggacgtggggtcgttttcgactagtgggggccaggggaaccctgggtccaccggttctcctcgacgccctacccaacccgaagggccccagttccggtcctttcccccgngggccnccccgtgcctcccgaggacgccaccgtccgaagcgaccacgacgcccgggtccctagggggccttcggacccgtttggggacctaaacggggaccctttaaccgttccaaacgtttccaacccgtacctaaccgtgggtaccggccggggtacttccggggacaaacgggcccggacaagggttacncgacngnnnnnnnnnnnnnnnnnnnnnnnnnnnnnn

SEQ ID NO: 58138 - DNA, 678 bp, Homo sapiens
  misc_feature: GYAE6OF02HIL7Q.37.33.C11.1.454.CMB.1.raw
  modified_base (138)..(138): a, c, t, g, unknown or other
  misc_feature (138)..(138): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccagganccaaatgtgacatccagatcgacccagtctccttccacctgtctgcatcgtgtaggagacagacgtcaccatcactgccggcagtcgactatagtacctggtgcctgtatcaacaagaacgaggaacgccctaaggtcctagatctatgatcgcctacctacgtttagggaaacgcgggtccatacgtaagttcaggcgacgagtgtactcgtagggacgaagtaacgttcaaccgttcctacaaccctatcaacgtacgtaccgtgtaccgagccgtagtcttaagttatttttacggtacttaaaacttttacgtttaccgttacgtaacgtaacgtactaaccgttaaagttaaggttaacggggtattaacgggttaccgggtaaccgggtaaccgggtaaccgggttaaaggttcgggaacgtaacgaaccgttaaaacggtaaccggttcgggtacggttaccggtacgtaccgtaaccgttaccgttccgttaccgttaccgtttaccgtttaacctccccgtttaacccccg

SEQ ID NO: 58139 - DNA, 538 bp, Homo sapiens
  misc_feature: GYAE6OF02G3CNV.37.33.C11.1.454.CMB.1.raw
  modified_base (523)..(525): a, c, t, g, unknown or other
  misc_feature (523)..(525): n is a, c, g, or t
  modified_base (528)..(538): a, c, t, g, unknown or other
  misc_feature (528)..(538): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgagggccgattcaccatctccacagacaacgccaaagaaatcaaattctttttgacaaatgaacagtctgagagtcgagacacggccatgtattactgtacgagagaacagacgttggggccaacgggaaccctggtcaccgtctcctcacgccctccaccgaacgggcccacgtccggtccttccccgtggccgtccctcgcctccgacggacgccacctccgagacgccacgacgccggcccgtgggcctcgccgtcggtacaaggtacctacctccatcctacactctgacgtcggctggacaaggcgacgtactagnnnacnnnnnnnnnnn

SEQ ID NO: 58140 - DNA, 711 bp, Homo sapiens
  misc_feature: GYAE6OF02HPK5E.37.33.C11.1.454.CMB.1.raw
  modified_base (294)..(294): a, c, t, g, unknown or other
  misc_feature (294)..(294): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccacctgtctgcatctgtaggagacagagtcacatcacttggccgggccaggtcgactattacgtaccgtggttggcctggtatcaacgagaaaccggaaggaccaccgtacgtcagtactntagtatcgtcctacctacttaggtaacggaccggtccggtactacgtacggtacgtacgacggcgtacgtagttactacgtcggtaggaactaacgttattaccgtacttacctacctaaccgtactaacggtaacgtccgtaccgtacacgtaccgtcggtattagtttaacgtttacgttaccgttaaacctttaacgttttaacttcgtaccggttacaaaccgttactaaactttaaacgggttaagggggtacggttaacccggttaacggggttacccgggaacggggtaaccgggttacgggttagggaacggtaacgttaacgtaaaccggaacggtttacgggtacgggtcgtaccgtcgtacccgaacttcgtttcgtactttcccgtaattcccggtaccctaccg

SEQ ID NO: 58141 - DNA, 589 bp, Homo sapiens
  misc_feature: GYAE6OF02GVVWN.37.33.C11.1.454.CMB.1.raw
  modified_base (272)..(272): a, c, t, g, unknown or other
  misc_feature (272)..(272): n is a, c, g, or t
tcagtagtgtagatcacgaccggtgctcgatttagagtgagctcgttgggtttggggtcagactcagtcaggacacagcactggacatgagggtccccgctcagctcctggggctcctgctgctctggctcccaggagccaaagtcgtgacatccagatgacccagtctcttcacctgtctgcatctgtaggagacagagtcaccatcacttgccggcagtcggactatagtaccgtggttggcctggtactcaacagaaaccgaggaaacnccctaaaggttcctagatcgtatagatcgcctacactttggaaacgcgggtcccagtctaaggttcaagcgcagtcgtagtcgtgggacagtaattcgactctacacatcagtacgcctgcagcctgacttgattttggactaacttagttacgtacgtcagtacctaacttagtaacgtagggatacgtttaccgggaccgtacgggtaaccgtagggttacgaacgattaccgaaacgtaccgttggttaacggcttacggacctaaccgtacgttcgttacggttacctttacgtacgttcccgttacccccgg

SEQ ID NO: 58142 - DNA, 485 bp, Homo sapiens
  misc_feature: GYAE6OF02HR21W.37.33.C11.1.454.CMB.1.raw
  modified_base (471)..(485): a, c, t, g, unknown or other
  misc_feature (471)..(485): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacgttggggccagggaaccctggtcaccgtctcctcagccctccaccaacgggccccatccggtccttcccccgtggccgccctgcctccgaggacgccaccctccgagacgccacgacgccggcccgtggggcctcggcccttgggtaccaaacgggtaccttaccttccaacttcctaaccaccttacgtggacggccggggctgggacaacgggccgacgtagtagnnnnnnnnnnnnnnn

SEQ ID NO: 58143 - DNA, 665 bp, Homo sapiens
  misc_feature: GYAE6OF02HTWHF.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacagtccagatgacccagtctccttccaccctgtctgcatctgtaggagacagacgtcaccatcacttggccggccagtcgactattagtaccttggttcgcctggtatcaacagaacagggaaacgtcccctaaggtcctgatctagtagatcgcctcctacgtttagggaaacggtccgggtacccatacgtaaggttccaaggcgacgagtgtacgtgtagggaacagtaacgttcacttcctactaaccagtacgtacgtacgtcctgaccgtacgtcctagacgttaggttactttacggtaccttaaagtttactttacgtacgttacctacgtacctaacttaagttaaggtacgggtaaacgttaccgggttaccgggaccgggtaacgggtaacccgggtaagggtttacggacgtaacgtaaccggaaaccggttacgtgggttacgaccgtacgacccgtacgttacaccgtttgttacccctttacgtacgttaccccttaccccgg

SEQ ID NO: 58144 - DNA, 595 bp, Homo sapiens
  misc_feature: GYAE6OF02G17WG.37.33.C11.1.454.CMB.1.raw
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
tcagtagtgtagatcacgaccggtgctcgatttagagtgagctcgttggggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttggccgggcagtcggactattagacctggtggctggtatcaacagaaaccaggaacgccctaaggtcctagatactatgatgcctccacgtttggaaacggcgggtacccatacgaaggttcagcggcagtgtatcgtggganagaattcactcgtaccacatacagtcgcctgacncgtcctgtatgtattttcgacttaacttacttactagtctaactaatattaactaacttacccgttaccggttacgttaccggaccgtaaacgggtaccgtagggttagacgtacgtacgaaacggtacgttacgggtacggtacgttacggccctaacgtacgttaccgttgtttacctttacctaccgtttcccgttaccccg

SEQ ID NO: 58145 - DNA, 730 bp, Homo sapiens
  misc_feature: GYAE6OF02HUAJ6.37.33.C11.1.454.CMB.1.raw
tcagtagtgtagatcacgaccggtgctcgatttagagtgagctcgttgggtttgggggtcagactcagtcaggacacagcatggacatgagggtcccgctcagctcctgggctcctgctgctctggctcccaggagccaaatgtgacatccagatgaccagtctccttccacctgtctgcatctgtaggagacagacgtcaccgatcacttcgccgggtaccagtcggactagttacgtaacctggttcggccgttggtaactacaaacgaagaaaaccgaagggaaacgaccccgttaaaggtcctaggtaactacgttaaacttgaacttcgacccttccgtaacgtttacgggaaaacggtccggggttacccaagttacgtaaacggtttcaacggtacggacgtacggttacgtaacgttccgttaggggtaaactaaacggtaactttaccacttacctaccgaaccgtaatacgaacgttacgccgtacgacgagtcccgtagaacttagtaacttttacgaacttaaacgtttacgttaacgtcggttacaacggtactaacgttaaagtaagtagggtaacgtacgttaccgggacggtaacgggtaaccgagggttacgtaacgaacgttaaccgtaaaacggtacgttaggtacgtacgttaacgaccgtaacgtaccgttacgtacgtttaccgtaccttacggtcccttaaccccgg

SEQ ID NO: 58146 - DNA, 593 bp, Homo sapiens
  misc_feature: GYAE6OF02GJDJP.37.33.C11.1.454.CMB.1.raw
  modified_base (395)..(395): a, c, t, g, unknown or other
  misc_feature (395)..(395): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtctccttccaccctgtctgcatctgtaggagacagagtcaccatcacttgccgggccagtcgatatagtacctggttgcctggtatcaacagaaaccagggaaacgcccctaaggtcctagatctatgatgccctctaacgtttaggaaacggccgggtcccaagtcgtaaaggttcaggtccggacagttagtaatcgtagggaactagtaacttcactctaccactanccgtagtacgcctgaccgagtccctagattgtattttacgacttaacctttattacgtcgtactaagtctaacttaagtaacgtggggaacttaggttccggacggtacgggaccgtaggttagaattacgacgaacgtacgtgtacggctacgaccctaacctgttaccttcgttacttactaccttcccgtacccg

SEQ ID NO: 58147 - DNA, 626 bp, Homo sapiens
  misc_feature: GYAE6OF02GJJAW.37.33.C11.1.454.CMB.1.raw
  modified_base (426)..(426): a, c, t, g, unknown or other
  misc_feature (426)..(426): n is a, c, g, or t
tcagtagtgtagatcacgaccggtgctcgatttagagtgagctcgttggggtttgggggtcagactcagtcaggacacagcatggacatgagggtccccgctcagctcctggggctcctgctgctctggctcccagggagccaaatgtgacatccagatgacccagtctcccttccaccctgtctgcatctgtaggagacagagtcaccatcacttcggccgggcagtcggactattacgtaccgtggttcggcctggtatacaacagaaaccgagggaaacgccccgtaaggtcctgatctatgactcgcctactacgtttagggaaacggtcggggtacccagtcctaaagggttcaacggccggacgtagttcgtatcgtagggactaagtactctactctacacctatcgagtagcctgacngtcctgactgtatttcgacttaactttattacgtgtacgagtactaacttaagtaagtacggggtagtacggttccgggaccggtagggtaaccggtagggttacgaaggtaactacggaaacggtacgttaggtacggtacctcgaacgtacctagtttccggtacgttaccctttacgtaccctttccgttaaccccg

SEQ ID NO: 58148 - DNA, 442 bp, Homo sapiens
  misc_feature: GYAE6OF02G3G7K.37.33.C11.1.454.CMB.1.raw
  modified_base (317)..(317): a, c, t, g, unknown or other
  misc_feature (317)..(317): n is a, c, g, or t
  modified_base (337)..(337): a, c, t, g, unknown or other
  misc_feature (337)..(337): n is a, c, g, or t
  modified_base (431)..(442): a, c, t, g, unknown or other
  misc_feature (431)..(442): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggccccatccggtcttcccccgnggccgccctgcctccagganccacctcgagagcacagcggccctggggctcgcctggtacaaggactacttccatcctacactactgacgcgggctggcaagggcgacagtagnnnnnnnnnnnn

SEQ ID NO: 58149 - DNA, 601 bp, Homo sapiens
  misc_feature: GYAE6OF02F17WB.37.33.C11.1.454.CMB.1.raw
  modified_base (409)..(409): a, c, t, g, unknown or other
  misc_feature (409)..(409): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttggccgggccagtcggactattagtacctggttcggcctggtatcaacagaaaccagggaaacgccctaaggtcctgatctatgatcgcctcctacgttaggaacgccgggtccagtcgaaggttcagcggcaggtgtacgtcgtacgggacaagtacttacgactctacaacctatacctaagtacgtcctggacncggtctgattagtacttttcgacttaaacgtttattacgtgtacgacgtactaacttaagtaagtgggaagttacgttccgggaaccggtaggggtaaccgtagggttgaagtaacgtaccgaaagtacgtggtaggtcgtacgacctaccgtattccgttacgttccttaccgttaccttcccgtaccccg

SEQ ID NO: 58150 - DNA, 619 bp, Homo sapiens
  misc_feature: GYAE6OF02FV589.37.33.C11.1.454.CMB.1.raw
tcagtagtgtagatcacgaccggtgctcgatttagagtgagctcgttgggtttgggggttcgagactctagtcaggacacagcatggacatgagggtccccgactacagctcctggggctcctgctgctctggctcccaggacgccaaatggtgacactccagatgacccagtctccttccaccctgtctgcatctagtaggagacagagtccaccatcacttgccgggccagtcggactattacgtacctggtgcctggtatcaacagtaaaccgagggaacgccccgtaaggtccctgactccgtagtgatgcctccgtacgtttggaaacggtccggggtacccagtacgtaacggttcacggccggtacacgtcgtactcgtagggacagtaacttcactctacacgactacagtacgcctagcacgtctagattgtactttgacttacgttactacgtcgtacacgtctacgttataagtggtagtacgttcgggacggtacggtaccggtagggttgaacgtattacggaaaccgttacggttggtacggtccgttacgacctacgtacgttccggttaggttccttaacggtacctttacccgttaccccgg

SEQ ID NO: 58151 - DNA, 626 bp, Homo sapiens
  misc_feature: GYAE6OF02G26QF.37.33.C11.1.454.CMB.1.raw
  modified_base (396)..(396): a, c, t, g, unknown or other
  misc_feature (396)..(396): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtctccttccaccctgtctgcatctgtaggagacagagtcaccatcactgccgggcagtcgactatagtactggtgcctgtatcaacagaaaccgaggaacgccctaaggtcctagatctatgatcgcctccacgtttgggaaacggtccgggtaccagtcgtaaggttcaggcggctaggtgtagtcgtagggaactagtacgttcacttctaccacctatacctagtacncccgtagacctacggcccttagtacgtttacgttattttcgaacctttaactttaacgtttacgttcggtactaagtacctacttaagtaacggtagggtagtacgttcgggaccggtaacggtacggtaagggtcgaacgtagtaccgaaacggtacggtacggtacggttacgtacgacttaccgacgtttacttccggttacctttacgtaccttcccgttaccccg

SEQ ID NO: 58152 - DNA, 637 bp, Homo sapiens
  misc_feature: GYAE6OF02FN2TN.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttgcctggtatcaacagaaaccagggaacgaccctaaggtcctagatctatgatcgccttcctacgtttaggaacggccgggtaccatcgaaggttcagcgcagtgtactcgtagggacagtaattccgaacttcctaccacctactactacggtacgccctaggacctaacggtccctaggtattacgttattttacgacctttaactttaagttacttcgtacacgtactaacttaagtaacggtagggtaacgtacggtttccgggaccggtacggggtaaccgtaaggggttacgaacgtaacgtaaccgaaacggtaacgttgggtaaccggtaccttcggacctaaccgacgttccgtacgttacctttctaccgttcccgttaccccg

SEQ ID NO: 58153 - DNA, 492 bp, Homo sapiens
  misc_feature: GYAE6OF02GJWMD.37.33.C11.1.454.CMB.1.raw
  modified_base (320)..(320): a, c, t, g, unknown or other
  misc_feature (320)..(320): n is a, c, g, or t
  modified_base (446)..(446): a, c, t, g, unknown or other
  misc_feature (446)..(446): n is a, c, g, or t
  modified_base (448)..(449): a, c, t, g, unknown or other
  misc_feature (448)..(449): n is a, c, g, or t
  modified_base (451)..(452): a, c, t, g, unknown or other
  misc_feature (451)..(452): n is a, c, g, or t
  modified_base (454)..(454): a, c, t, g, unknown or other
  misc_feature (454)..(454): n is a, c, g, or t
  modified_base (457)..(458): a, c, t, g, unknown or other
  misc_feature (457)..(458): n is a, c, g, or t
  modified_base (460)..(462): a, c, t, g, unknown or other
  misc_feature (460)..(462): n is a, c, g, or t
  modified_base (464)..(475): a, c, t, g, unknown or other
  misc_feature (464)..(475): n is a, c, g, or t
  modified_base (477)..(477): a, c, t, g, unknown or other
  misc_feature (477)..(477): n is a, c, g, or t
  modified_base (479)..(488): a, c, t, g, unknown or other
  misc_feature (479)..(488): n is a, c, g, or t
  modified_base (490)..(492): a, c, t, g, unknown or other
  misc_feature (490)..(492): n is a, c, g, or t
tcagtagtgtagatcacgaccggtgctcgatttagagtgagctcgttgggtccgccgaggctccagggaaggggctggagtgggtggccaacagtaaaagcgagatggaagcgagaaatactaatgtggactctgtgagggccgattcacccatctccgacagacaacgccaagaaatcaatctttttgcaaatgaacagtctgagagtcgaggacacgggccaatcgtattactgtaccgagagaacagacttggggccagggaaccctggtcgaccgtctcctcagcctccaccaagggcccagtcggtcttcccccnggccgcctgcctcgacggagccaccgtccgagagcacgacgcggccctggggctgcctggtcaaacggactacgtccaattacaactactacgtgacgcgggtctggacgaagggcgacagtacgnannannangannannncnnnnnnnnnnnngngnnnnnnnnnncnnn

SEQ ID NO: 58154 - DNA, 509 bp, Homo sapiens
  misc_feature: GYAE6OF02GOI43.37.33.C11.1.454.CMB.1.raw
  modified_base (481)..(481): a, c, t, g, unknown or other
  misc_feature (481)..(481): n is a, c, g, or t
  modified_base (491)..(509): a, c, t, g, unknown or other
  misc_feature (491)..(509): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaaagaaatcaaattctttttgcaaatgaacagtctgagagtcgaggacacggccatgtattactgtacgagagaacagacgttggggccagggaaccctggtcaccgtctcctcacgcctccaacccgaacggggccccaagttccggttccctttccccccgtgggcccgccccgtgtcctcccgagggacgcccacccgtccggaagcgccacgacggcccggcccgtggggcctcggcccgttgggtaccgaaaggtaccttaccttccactcctaaccacttacgtgacggccgggacgtggacgagggcncgaagtacgnnnnnnnnnnnnnnnnnnn

SEQ ID NO: 58155 - DNA, 557 bp, Homo sapiens
  misc_feature: GYAE6OF02GE6HW.37.33.C11.1.454.CMB.1.raw
  modified_base (373)..(373): a, c, t, g, unknown or other
  misc_feature (373)..(373): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctgtaggagacagagtcaccatcacttgccggcagtcgactattagacctggttgcctggtatcgaacacgaaaaccgagggaaacgcccctaaggtcctagatctatgatcgcctccacgtttaggaaagtcgggtccatctaaggttcaggcgacagtgtatcgaggacagtatcactctcacntacagtacgcctgcacgtcctagatgttatttcgactacttattacgtgtacacgactattaagtaagtgggtacgtagttccgggaccggagggacctagggttcgaagtacgtacgaaacggtacgtggtcggactcgtaccaacgtacttcgtcggttacttacgtactttacccgtcccg

SEQ ID NO: 58156 - DNA, 658 bp, Homo sapiens
  misc_feature: GYAE6OF02IFFBI.37.33.C11.1.454.CMB.1.raw
  modified_base (145)..(145): a, c, t, g, unknown or other
  misc_feature (145)..(145): n is a, c, g, or t
  modified_base (171)..(171): a, c, t, g, unknown or other
  misc_feature (171)..(171): n is a, c, g, or t
  modified_base (391)..(391): a, c, t, g, unknown or other
  misc_feature (391)..(391): n is a, c, g, or t
  modified_base (424)..(424): a, c, t, g, unknown or other
  misc_feature (424)..(424): n is a, c, g, or t
tcagtagtgtagatcacgaccggtgctcgatttagagtgagctcgttgggtttgggggttctagactcgagtcgaggacacagcatggacatgagggtccccgctcagctccgtggggctcctgctgctcgtggctcccgagganccaaatgtgacatccagatcgacccngtcctccttccaccctgtctgcatcgtagaggagacaggatccaccatcgcttcggccggacctaggtcggacttagttaacgtccgttgggtcgccgtaggtatacaaacgaagaaaaccgacgggtaaacggtacccctaagggtcctagaacttctaagtagactcaccgtcgtacgttaggaacggtccgggccaatccggtaagttcgagcgganagtgtactgaggactagtacttcacttcaaccnctacgtacgtagtaccgtcgtacgtcgacgtacgttagtagttacgtttagttacgtaacttaactttcgttacgtcgttaactagtactaacgttaagttaacgggtaggttaaggtacggttaccgggacggtaacggtacggttagggtagaacgtacgtacgtaacgtacggtcgtacgtacgtacgtactacgtacgttacgtccgttaccttacgtacctaccgttcg

SEQ ID NO: 58157 - DNA, 797 bp, Homo sapiens
  misc_feature: GYAE6OF02J2ZUW.37.33.C11.1.454.CMB.1.raw
  modified_base (211)..(211): a, c, t, g, unknown or other
  misc_feature (211)..(211): n is a, c, g, or t
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagcttgggtttccttgttgcttattttagaggtgtccagtgtgagtgcagctggtgaccgtgngggggagtcctggtccgacggtccggtcgggggtccctgacgtaccgtctccgtgtcgacctaaccgtcgtaggtacttcgagtttgtaggtgtagtttggttgggtgttgggggttccggtccggaccgtacggccgtaccgggaaggggacggggcgtggggtaggttcggggtacgaccgtaaaacgaaggtaaaacggcggaaagaggtaacgggaaacgtacggtaagaaaacgttagttagtaggtacggtccgtcggtagggtgggtacggggtaccgtacgtccgaaaccgttctacccgtacccgaacggtaaaccgaaccgtaaaccggaaccctaaaagtaaccttacttaaaccgtttagtttacgaaactaacgtaacgtaaacgttcgttagtacggtagtaaaccggtacggaaccggtaacgacccgggtaacttacgtaacggttactttaacggtacggtaaacgaaccggaaggtaaacccgtaaggggtaccgggttaaccccggggtaccggtaaaccccgggttaacccggtttaacccgggtacccgtaaccccgttccccgg

SEQ ID NO: 58158 - DNA, 653 bp, Homo sapiens
  misc_feature: GYAE6OF02FWOFE.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccaggatgacccagtctccttccaccctgtctgcatctgtaggagacagagtcaccatcacttgccgggccagtcgactattagtacctggttggcctggtatcaacagaaaccgaggaacgcccctaaggtcctagactactatgatcgccttacctacgtttagggaaacggtccggggtacccctatacgtaaaggtttccacggtccggactagtacggtaatccggtagggacaagtaacttacgaccttctaccgacctactacgtacgtacgcctgcacgtcctagtacttacggttacttttacggaacctttaatttaagttaccgttgtacgtactacgtaacttaacgtaggtaaggtacgtacggttaccgggacggtaacgggtacggtaagggttgaacgtacgttaaccgaacggtaccgttagggtcggtaccgtcgacctaaccgtagttcgtacgtttactacctttaccgtacctttaccccg

SEQ ID NO: 58159 - DNA, 508 bp, Homo sapiens
  misc_feature: GYAE6OF02G82H5.37.33.C11.1.454.CMB.1.raw
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
  modified_base (494)..(508): a, c, t, g, unknown or other
  misc_feature (494)..(508): n is a, c, g, or t
tcagtagtgtagatcacgaccggtgctcgatttagagtgagctcgttgggtttgggggggtccctgagactctcctgtgcaacctctggattcagttgtagtgattgttggatgggttgggtccgccaggctccagggaaggggctggagtgggtggccaacataaaagcgagatggaagcgagaaatactatgtggactctgtgaggggccgattcaccatctccacagacaacgccaagaaatcaatctttttgcaaatgaacagtctgagagtcgaggacacggccatgtatactgtacgagagaacagacttggggccagggaaccctggtcaccgtctcctcagcctccaccaagggcccatcggtcttccccnggccgccctgctccgaggacnccacctccgagagcacagcggcccgtgggctcgccgtggtacaaggaccttacttccattctacactactgacgcggctggcaaggcgcatagnnnnnnnnnnnnnnn

SEQ ID NO: 58160 - DNA, 431 bp, Homo sapiens
  misc_feature: GYAE6OF02FZTFN.37.33.C11.1.454.CMB.1.raw
  modified_base (418)..(431): a, c, t, g, unknown or other
  misc_feature (418)..(431): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctcaccaaggcccatcggtcttccccctggcgccctgctccaggcgcacctccgagacgcacagcggccctggggctgcctggtcaaggctacgttccatctacactactgagcgggctggcaaggcgcatagnnnnnnnnnnnnnn

SEQ ID NO: 58161 - DNA, 581 bp, Homo sapiens
  misc_feature: GYAE6OF02IWBW5.37.33.C11.1.454.CMB.1.raw
  modified_base (356)..(356): a, c, t, g, unknown or other
  misc_feature (356)..(356): n is a, c, g, or t
  modified_base (420)..(420): a, c, t, g, unknown or other
  misc_feature (420)..(420): n is a, c, g, or t
  modified_base (564)..(565): a, c, t, g, unknown or other
  misc_feature (564)..(565): n is a, c, g, or t
  modified_base (568)..(568): a, c, t, g, unknown or other
  misc_feature (568)..(568): n is a, c, g, or t
  modified_base (571)..(581): a, c, t, g, unknown or other
  misc_feature (571)..(581): n is a, c, g, or t
tcagtagtgtagatcacgaccggtgctcgatttagagtgagctcgttgggtttgggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgaggggccgattcaccatctccacagacaacgccaagaaatcaattctttttgacaaatcgaactagtctgagagtcgaaggacacggcatgtattactgtacgagacgaacagacgtggggccagggaaccctggtccaccgtctcctcacncctaccaccgaacgggcccagtccggtccttccccgtggcccgccctcgcctcccgacgggacnctacccgtccgaagacgaccacgacgccgggcccgtgggcctcgcccgttaggtaccgaaggtaccttaccttaccagttacctaaccgacttaaccgtcggtaggccggggtacctgggaccgtaaacgggcgactagtacgnngcngtnnnnnnnnnnn

SEQ ID NO: 58162 - DNA, 779 bp, Homo sapiens
  misc_feature: GYAE6OF02G649A.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccaccacttgccgggccagtcggactattacgtaccgtggttcggccttggtatacaacaacgaaaccagggaaacgccccgtaaggtcctgatctatgatcgcctctacgtttaggaacggcgggtacccagtcgaacggttcgaacggcggctaggttgtacgtcgtagggacaagtaactttacgacttactccaacctacttacgaacggttaccgcccttaggacccgtaagtaccccgtaggtaactttcggtttaactttttacggaacctttaaaaccttttaacgtttaaccgtttacgttaccgtaacggttaacctaaacttaaacggtttaaacgggttacgggggtaaacggttaccggttttacccggggggaaccggggttaacggggggtaaaccccggttaaggggggtttaacgtaaacggggttaaaccgttaaacccgtaaaacccgggttaacggttacggggtttaacgggtacccgttacgggtaccctaacccgttacgtttaccgttccggtttacctttccgtaaccctttccccgttacccgtacccg

SEQ ID NO: 58163 - DNA, 522 bp, Homo sapiens
  misc_feature: GYAE6OF02FWWKR.37.33.C11.1.454.CMB.1.raw
  modified_base (481)..(482): a, c, t, g, unknown or other
  misc_feature (481)..(482): n is a, c, g, or t
  modified_base (484)..(484): a, c, t, g, unknown or other
  misc_feature (484)..(484): n is a, c, g, or t
  modified_base (486)..(507): a, c, t, g, unknown or other
  misc_feature (486)..(507): n is a, c, g, or t
  modified_base (509)..(522): a, c, t, g, unknown or other
  misc_feature (509)..(522): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaattcttttgcaaatgaaacagtctgagagtcgaggacacggccatgtattactgtacgagagaacagacgttgggggccaggggaaccccttggtcacccgtctccctcacgccctcccaccaacgggccccatccgtccttcccccgtggccgccctgctccgagggacgccacccgtccggacgacaccaacacggccggccccgtggggcctcgcccgttaggtaccaaaacggtccttaacttcccattacctaaccaccgttactggacgcgggacgtcggacaacggccgacaagtacgnntncnnnnnnnnnnnnnnnnnnnnnngnnnnnnnnnnnnnn

SEQ ID NO: 58164 - DNA, 603 bp, Homo sapiens
  misc_feature: GYAE6OF02GMR54.37.33.C11.1.454.CMB.1.raw
  modified_base (355)..(355): a, c, t, g, unknown or other
  misc_feature (355)..(355): n is a, c, g, or t
tcagtagtgtagatcacgaccggtgctcgatttagagtgagctcgttgggtttgaggcctcagagaagagccttagccctggactccaaggcctttccacttggtgatcagcactgagcacagaggactcaccatggaattggggctgagctgggttttccttgttgctattttagaaggtgtccagtgtgaagtgcagctggtggactcgtgggggaggcctggtccagccgtggggggtcctgagactctcctgtgcaacctctggattcagttgtagtgatttggttaggattggggttcgggccgccagggcctccgagggggaaggggctgggagtggggtggaccgaanagtaaagcgaagagtagggaagcggaagaaaactacgtatggtggtaactcgtaggtgggaacggggtccgtattccgaccagtcctaccaacaacgacaaaccggaccaaagaaatactaagtttctttttagactaaatggaactagtactagtagagtcgaggtacacggaccagtacgtattacgtgtaacgagagtaacgagtacgttacgggacgaccgggacccgtaggtcctaccgtccc

SEQ ID NO: 58165 - DNA, 943 bp, Homo sapiens
  misc_feature: GYAE6OF02HYA34.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgcctctggcctcccagggacgaccaaagtggtgaccacgtccaaggactcgaacccctaggtcctaccacttccctcccgtgtcctagcctacttctaggttaacgagaaccaggactaccaaccgacttccggtcgttcggggccgggacgtaggtaccgaacggaactcgttaccgtacttaaagttttcggaccgtacgttagggtaactcgaacggcgtaacgggaacggaccgtaaggggtaacctaacggtttacccactaaccgttcttagtactacgtatacggtactcgactcgttactacgtagtttacgggacgacccgggttaggtcctacgtcgtttaccggtaccggtagtacgggttcggaaccgtacgggtaccggttacggtaccgggtccggggtaccctttaccttttaccggaaccctttaccctaacccggtaaaccgtacccgttcgaaaccccgttaaccggtccccgtttaaaccccgacccggttaaccggttaacggtaaacgtttaccgggttaaccgttaaacccggtaaacttttaaaccttttaacggtttaacccgtttaaaccgggtaaacccttaaaggtttaacccgttaacgtaaccggttaaacgggttacccggtacccggggttaccccgggttttacgggtaaccccggggttcccccggggttaaaacccgggacccgggggtttaaaaccgggtaaaaccggggtttaccgggaaaaggtttaaccccggtaaaccgggttaacccgttaaacggggttccgggtaaccgggttaccccgg

SEQ ID NO: 58166 - DNA, 555 bp, Homo sapiens
  misc_feature: GYAE6OF02HT6AS.37.33.C11.1.454.CMB.1.raw
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (514)..(514): a, c, t, g, unknown or other
  misc_feature (514)..(514): n is a, c, g, or t
  modified_base (517)..(518): a, c, t, g, unknown or other
  misc_feature (517)..(518): n is a, c, g, or t
  modified_base (520)..(521): a, c, t, g, unknown or other
  misc_feature (520)..(521): n is a, c, g, or t
  modified_base (523)..(523): a, c, t, g, unknown or other
  misc_feature (523)..(523): n is a, c, g, or t
  modified_base (526)..(555): a, c, t, g, unknown or other
  misc_feature (526)..(555): n is a, c, g, or t
tcagtagtgtagatcacgaccggtgctcgatttagagtgagctcgttgggtccgccaggctccagggaaggggctggagtggggtggccaacataaaagcgagatggaagcgagaaatactatgtggactctgtgaggggccgattcaccatctccacagacaacgccaagaaatcaatctttttgcaaatgaacagtctgagagtcgagacacggccatgtattactgtacgagagaacagacttggggccagggaacctggtcaccgtctcctcagccctccaaccaagggcccagtcggtaccttcccccnggccgcctgcctcccgaggacnccaccgtccgagacgcaacacgggccgacccgtggggtctcggccgttcggtaccggaaaacgggtacccttaccgtttaccccaagttcccctaacgtaacctttaacccgtacgggaacgggtacccggggcgtttacggggaaccgaaacgggtccgacctaaatacgggcacgnacnngnngngannnnnnnnnnnnnnnnnnnnnnnnnnnnnn

SEQ ID NO: 58167 - DNA, 527 bp, Homo sapiens
  misc_feature: GYAE6OF02F593B.37.33.C11.1.454.CMB.1.raw
  modified_base (484)..(485): a, c, t, g, unknown or other
  misc_feature (484)..(485): n is a, c, g, or t
  modified_base (487)..(487): a, c, t, g, unknown or other
  misc_feature (487)..(487): n is a, c, g, or t
  modified_base (492)..(493): a, c, t, g, unknown or other
  misc_feature (492)..(493): n is a, c, g, or t
  modified_base (495)..(527): a, c, t, g, unknown or other
  misc_feature (495)..(527): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagactaacgccaagaaatcaattctttttgccaaatgaacaggtctgagagtcgaggacacggccatgtattacgtggtacgagagaacagacttggggccagggaaccctggtcaccgtctcctcacgcctccacgaacggcccactccggtccttccccccgtggccgccctgcctcgaggtacgcacctacgagacgcacgagccggccctggggctcggccgtaggtaccgaaacgggtacctaaccgtttccaacgttcctaaccgacctttaacgtcggaacggccggggactacgggaaccgtaagggccacgtaatggtnntncgtannannnnnnnnnnnnnnnnnnnnnnnnnnnnnnnnn

SEQ ID NO: 58168 - DNA, 716 bp, Homo sapiens
  misc_feature: GYAE6OF02HUGMN.37.33.C11.1.454.CMB.1.raw
  modified_base (278)..(278): a, c, t, g, unknown or other
  misc_feature (278)..(278): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctgtagagacagagtcacatcacttcggccgggccagtcggactattacgtaccgtggtggcctggtatacaacaagaaaccagggaaacncccctaaggtcctagatctagtgatcgcctcctacgtttagggaacgtccgggtacccagtacgaaacggttcgacggtcggactagtcgtagtcgtagggaactaaggtaaacttcgaacgttctaccgacctacgtactacggtatccctagaccgtacggtccttaggtaacgttcgttaacttttacgaaccttaaacgttttacttaccgttcgttacctaagtacctaaacgtttaagtaaacggttaggggtacgtaaccggttaccgggaccgggttaaacgggaaccgggttaaaggggttaacgaacggtaacgttaacccggtaaaaccggtaacggttcggtacgggtcctaacggacccgtaaacccgttacgtttacccgttccgttaaccttttacctacccgtttaccccgttaacccccgg

SEQ ID NO: 58169 - DNA, 839 bp, Homo sapiens
  misc_feature: GYAE6OF02IAQI7.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccactccccctgtctgcatctagtaggagacagagtcaccatctacttgaccaggcgagtacaggactagttggctaaacttaattttaaattggtatcagacaagaaaccagggaacgaccccaagcctccgtggtactacgctgcacgtacctaagtttacggaaacgacggtacgtacccaatacgtaaacggttcaaggtagggaacggttggtaacgttcggtacgggggaactaacgttaacgtttttttaaccctttaccgtacccttttaaccgaacggttaccgaacgtccccgttaggtaccgtaacggttaccgttacgaaacggttaacctaacggttttacggaaccttaaaccgttaactttaccgtttttaacgttttacggttaaccctaaacccttaaccgtaacgtttaccgggtaaccccgggtacccggttaacggggggtaaaccccgttaaaagggttacgggaaaccgtttaaaacgttaacccgtaaaaacgggttaacccgtttacgggttaaccggggtaccccgttaacgggtaaccctaaacccggttaactttacccggttttaaccggttttacccctttaaacccggtttaaccccgttttaccccgttttacccccccggttaacccgtttaaaccccgg

SEQ ID NO: 58170 - DNA, 923 bp, Homo sapiens
  misc_feature: GYAE6OF02G186X.37.33.C11.1.454.CMB.1.raw
  modified_base (904)..(904): a, c, t, g, unknown or other
  misc_feature (904)..(904): n is a, c, g, or t
  modified_base (908)..(909): a, c, t, g, unknown or other
  misc_feature (908)..(909): n is a, c, g, or t
  modified_base (917)..(918): a, c, t, g, unknown or other
  misc_feature (917)..(918): n is a, c, g, or t
  modified_base (921)..(922): a, c, t, g, unknown or other
  misc_feature (921)..(922): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgaggggccattcaccatctccacagacaacgccaacgaaatactaacttactttttcgttacaaactaacgaacgtaacgtacgtacgaagaaggtacggtacgggaacgaaccgggacccgaacttagttaactttaacgttacggttaacggtaacggaaggtaaaaccgaacggtaaccggtttacgggggtacccgggaaccggggtaaaacccccgggtaccgggttaccggtaccccgttacccgttccccttacccgtaccggacccgttcccccgtaaaccccgaaaccggggaaccccggtacccgttacccggggtttccccggttttacccccccgtttccccggggtcccgggtccccccgttcccggttaccccgttaccccggtaacccggggaacgggtcccctaaaccccggtacccccgggtaacgggaaacggccccgtaaacccggaacgggtccccggggtccccccggggttccgggggtacgttccccggtacccggtttacggggtaacccggttaaaaaccgggggtaacccctttaaaccttttcccccggtaaacttaacctttaaacccgaaccccgtttaacgttaccgggaacggggtcccgggggtaaccccggttcggggtaaacccgggaaaccggggttcggaacccgaaattacgggtgacgcgtaancgannacgcgcgnnacnnc

SEQ ID NO: 58171 - DNA, 443 bp, Homo sapiens
  misc_feature: GYAE6OF02JHXYJ.37.33.C11.1.454.CMB.1.raw
  modified_base (431)..(443): a, c, t, g, unknown or other
  misc_feature (431)..(443): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaaggcccatcggtcttcccctggcaccctcctccaagagccaccctcgtcgggggcacgacgccggcccgtggggctcgccgtggtcgaacgggtactacttccatcctacgtactactgaggcgggactcggcaaggcgcatgnnnnnnnnnnnnn

SEQ ID NO: 58172 - DNA, 496 bp, Homo sapiens
  misc_feature: GYAE6OF02GJJEX.37.33.C11.1.454.CMB.1.raw
  modified_base (422)..(422): a, c, t, g, unknown or other
  misc_feature (422)..(422): n is a, c, g, or t
  modified_base (460)..(460): a, c, t, g, unknown or other
  misc_feature (460)..(460): n is a, c, g, or t
  modified_base (462)..(496): a, c, t, g, unknown or other
  misc_feature (462)..(496): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagccctccaccaagggcccagtccggtccttccccctggccgtccctgcctccgagggagccacctcgagacgcacgcggccggcccgtgggcctcggccctgggtaccaaagggtaccttaccttaccatacctacaaccttacnggaacggcggggctagggcaaagggccgactaagtagngnnnnnnnnnnnnnnnnnnnnnnnnnnnnnnnnnnn

SEQ ID NO: 58173 - DNA, 721 bp, Homo sapiens
  misc_feature: GYAE6OF02IBPRZ.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagactgacccagtcctccttccaccctgtctgcatcttggaggagacagacgtacaccatcctacgttcggccgggaccagtcggacttattacgacgtggttggcctggtactacaactagaaaccgaagggaacgaccctaaggtccctgatctatgtactcgtcctcctagtttcggaaacggtccggggtccctatacgtaacggttcgacggtcggtcgagttgtaactcgtacgggactaggaacttctacttcctacaacctactacgaacgtttcgccgtagaccgacgtcccttaggtaacttggttaaccgtttttacgtacctttaaactttaacgtttaccgttacgttaccgtaaagtcctaacgttaaactttaagggtacgggttaggtaacgtttaccggggaccgggtaacgggtaacccgggtaaggggtttacgaacggggtacttaaccggaaagtaaccgggttggacggttccgtaacggtacccgaactacggtttaccggttaccgttacccgttttacgtaccgtttccccggtttaaccccg

SEQ ID NO: 58174 - DNA, 442 bp, Homo sapiens
  misc_feature: GYAE6OF02I5739.37.33.C11.1.454.CMB.1.raw
  modified_base (396)..(396): a, c, t, g, unknown or other
  misc_feature (396)..(396): n is a, c, g, or t
  modified_base (417)..(417): a, c, t, g, unknown or other
  misc_feature (417)..(417): n is a, c, g, or t
  modified_base (423)..(442): a, c, t, g, unknown or other
  misc_feature (423)..(442): n is a, c, g, or t
tcagtagtgtagatcacgaccggtgctcgatttagagtgagctcgttgggtttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccaggggaaccctggtcaccgtctcctcagcctccaccaagggcccatcggtcttccccctggccgccctgcctccaggacgccacctccgagagccacgagccggccctgggctgcctggtcaggactactccatctacnctactgagcggctggcaggcncatagnnnnnnnnnnnnnnnnnnnn

SEQ ID NO: 58175 - DNA, 577 bp, Homo sapiens
  misc_feature: GYAE6OF02HZCWU.37.33.C11.1.454.CMB.1.raw
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
  modified_base (564)..(577): a, c, t, g, unknown or other
  misc_feature (564)..(577): n is a, c, g, or t
tcagtagtgtagatcacgaccggtgctcgatttagagtgagctcgttgggtttgggggtccctgagactctcctgtgcaacctctggattcagttgtagtgattgttggatgggttgggtccgccgaggctccagggaaggggctgggagtgggtggccaacataaagcgagatggaagcgagaaatactatgtggactctgtgaggggccgattcaccatctccacagacaacgccaagaaatcaatctttttagacaaatagtaacagtactgagagtcgagacaggctatgtatactcgtacgagagaacagacgttgggaccaacgggtaacccgtaggtaccaaccggttcctacctccgaacgtcccgtaccgaaccccgaaaggggccccaatccgggttacccttcccccgtcggtcccggccctcggtccaccgtaggacgtccaacctccgagaccgctacgagccggtccctgggacncgtccncggtactaacggacttacttccgaaactcaaccgtactacgtgagtcgacgtggacctaagcgcatcgnnnnnnnnnnnnnn

SEQ ID NO: 58176 - DNA, 619 bp, Homo sapiens
  misc_feature: GYAE6OF02I4DM9.37.33.C11.1.454.CMB.1.raw
  modified_base (195)..(195): a, c, t, g, unknown or other
  misc_feature (195)..(195): n is a, c, g, or t
  modified_base (397)..(397): a, c, t, g, unknown or other
  misc_feature (397)..(397): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtagganacagagtcaccatcacttcgccgggccagtcggactattagtacctggttgcctggtatacaacagaaaccgagggaaacgccccgtaaggtcctaggactacgtactgatcgcctcctacgtttaggaaacgtcggggtaccagtacgaaggttccaggcgacgtagtgtactcgagggacaggtattcacgtctacactntacagtacgcctgcacgcctagattgtatttacgacttaacgtttacttacgtacgtactacgtctaacgttaatacggtacgggtaagttacgttaccgggacggtaacgggtaccgtaagggttacgaagttaacgtacgaaacgttacgttcggtacggtacgttacgaccgtaaccgtagttacgtaccggtttactaccgttacttcccgtaccccg

SEQ ID NO: 58177 - DNA, 545 bp, Homo sapiens
  misc_feature: GYAE6OF02IQ76P.37.33.C11.1.454.CMB.1.raw
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
  modified_base (494)..(495): a, c, t, g, unknown or other
  misc_feature (494)..(495): n is a, c, g, or t
  modified_base (497)..(498): a, c, t, g, unknown or other
  misc_feature (497)..(498): n is a, c, g, or t
  modified_base (511)..(511): a, c, t, g, unknown or other
  misc_feature (511)..(511): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
  modified_base (542)..(542): a, c, t, g, unknown or other
  misc_feature (542)..(542): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatatattactgtacgagagaacagacttggggccaagggaaccctggtcaccgtctccncncgcctccaaccgaggcccatcggtccttcccctggccgtccctgcctccgaggcgaccaccgtcgagacgacacacggccggccctcggggctcgtccgtgggtacaaacggtacttaccgttccattaccgtacctaaccgtacgttggacggccgggcgtagggacgaacgggccgacgtaagtaagctgactnanacgctagctcgangcgcnncnngtacgcgtcgcancgtcagacgacacgcacncncnctgngacanctc

SEQ ID NO: 58178 - DNA, 723 bp, Homo sapiens
  misc_feature: GYAE6OF02HAHK8.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacagtccagatgaccagtctccttccacctgtctgcatctgtaggagacagacgtcaccatcacttgccgggccagtcggacttattacgtaccgtggttgccgttggtactcaacgaacgaaaaccgtagggaaacgaccccgttaaagggtccctagactactagtgagtcgcccttaccgtacgttttacgggaaaacggtcccgggttaaccctagtaccgtaaaggttcgacggcggactaggttgtactcgtagggacagtaacttcactcctccacctagtacgtacgtaacgtccctagccgacgtccgtagtacgtaggttaacttttacggaaccttaaacgttttaactacgttacgttacgtaacgtactaaccttaaggttaaaggtaccgggtaagtaaccgggtttccgggaaccgggtaacgggggttaacccgtagggggttaacgacggtaacgtaccgtaaaccggttaaccggtgggttaccggaccgttacggtaccctaaccggttacttaccgttccgttttaccgttccgtttacccgtcccgtttacccccg

SEQ ID NO: 58179 - DNA, 601 bp, Homo sapiens
  misc_feature: GYAE6OF02JJJNS.37.33.C11.1.454.CMB.1.raw
  modified_base (342)..(342): a, c, t, g, unknown or other
  misc_feature (342)..(342): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
  modified_base (590)..(591): a, c, t, g, unknown or other
  misc_feature (590)..(591): n is a, c, g, or t
  modified_base (594)..(596): a, c, t, g, unknown or other
  misc_feature (594)..(596): n is a, c, g, or t
  modified_base (598)..(600): a, c, t, g, unknown or other
  misc_feature (598)..(600): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccgaacataaaagcgagatggaagcgagaaatactatgtggactctgtgagggccgattcaccatctcacagacaaagccaagaaatcaatcttttgcaaatgaacagtctgagagtcgaggacacggccatgtattactgtacgagagaacagacttgggccagggaaccctggtcacgtctccncacgcctccaccgaacgggcccctaagtccggtaccttccccgtggtcccgcccgtgccttacccgacgggtacgccgtacccgtccgaagcgtaccactacggcccggtacccgtcgggcctcggccgttacggttaccgaaacggtacctaccttaccgtactaccttaacctaccttacgtacgtaacggtccgggtaccgttcgggacaaacgggtccgacaccgttagacgnacgngacgngnngcnnncnnnc

SEQ ID NO: 58180 - DNA, 635 bp, Homo sapiens
  misc_feature: GYAE6OF02GRDUX.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctggtagagacagatcaccatcacttggccggccagtcgactagttacgtaccgtggttcggcctggtactacaacaagaaaaccgagggaaacaccccgtaaggtccctagactactatgactcgcctactactttagggaaacggtccgggtacctagtaccgaaggttcgaacggcggtactaggtcgttacgtcggtaggggactaaggtaacttccacttctaccacatacgagtacgtctgacacgtctgtattcgtactttacgacttaacttattaccgtgtacagtactaacttaagtaacggtagggacgttacggttaccggaccggtacgggtaccgtaaggggttacgaagtaccgtaacgaacggtaccgtgggtaccgtacggacgtaccgaccgttactcgttacgttcccttacgtaccgttccctaccccg

SEQ ID NO: 58181 - DNA, 631 bp, Homo sapiens
  misc_feature: GYAE6OF02FJVKD.37.33.C11.1.454.CMB.1.raw
  modified_base (429)..(429): a, c, t, g, unknown or other
  misc_feature (429)..(429): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatggtgacatccagactgaccctagtctccttccacctgtctgcatctgtaggagacagagtcacatcacttcggccggacaggtccggattattacgtacctggttcgcctggtatcaaacacggaaaccgagggaaacgccccgtaaaggtcctgactctaatgactacgtcctacctacgtttagggaaacggtccgggtaccaagtacgtaacggttcgaggcgagacgttagtagcgtaggaactagattcaactctacacctatctaagtcgtacgtcganacgtctagattacgttactttcgacttaactttactttacgtgtacacgtacttaacgttaagtaacggtagggtaacgttcgttaccggggacgtaacggggtaccggtaggttagaacgtagttaccgaaacgtaggttcggacggtaccgtcggacctaacactttcgtcgtttaccgttctaccgttcccttacccgg

SEQ ID NO: 58182 - DNA, 756 bp, Homo sapiens
  misc_feature: GYAE6OF02FIQU2.37.33.C11.1.454.CMB.1.raw
  modified_base (292)..(292): a, c, t, g, unknown or other
  misc_feature (292)..(292): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtctccttccaccctgtctgcatctgtaggagacagatcaccatcacttcgccgggcagtacggtactagttagtacctggttcgcctggtactcaacagaaaccgagggaaacgccctaaggtcctnatctatgatcgcctaccgtacgtttagggaaacggtccgggtacctagtaccgtaacgggttcaacgggtccggacgtacggttacggtaacgtccggttagggaaaccgtaagtaaacgtttaccaaccttccgttacccaacccgtaactaccgtaacgtttaacgcccgtacggtacctaccggtccccgttaggtaactttacgggtttactttttaggaaccctttaaaaccgttttaacgttttaaccgttaggttacccaacggttcctaaaacctttaagttaaagggttcgggtaagttaaccgggttaccgggtaaccggggtaaccggggaaccgtttaaggggttacgaacgtaacgttaacccgaaaacggttaacgttcgggtacggtacctaacggacccaaccgttactccgtttacgtccctttactacccgtttcccgttaacccg

SEQ ID NO: 58183 - DNA, 773 bp, Homo sapiens
  misc_feature: GYAE6OF02JGCFQ.37.33.C11.1.454.CMB.1.raw
  modified_base (699)..(699): a, c, t, g, unknown or other
  misc_feature (699)..(699): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccgaggagccaaatgtagacatccagatcgacccagtctacctccaccctgtctgctatctgtaggagacagagtccaccatctacgttcggccgggccagtccggtacttagttacgtcctggttcggcctggtatacaacgaacggaaaccgtaagggaaaccgtaccccgtaaggtccctagtacttcgtatgtatccgtcccttaccgtacgtttacgggaacgggtaccggggtaccctagttaccgtaaggggttccgacggtacggtaccgagttacggttacgtacggtgggaaccgtaagtaacgttaccaccgtttaccaccgtaaccagtttccgaacgttaccgtcccgtccggacgtaacgtcccgtaaggtgttaaccgtttacgttttacgaaacccgttttaaccttttaacgttaccgggttacctacgtaaccgaaaccttaaccggtttaaggaaggtttagggaaccgttaagggttccccgggaaccgggtacggggtaccggtaaggggttataccggtaacgtaaccggaaaccgttcggtcggngggtttacccaggtaacccgtaccctaggttacccgttacgttcccgttacttaccccgttccccttaccccgg

SEQ ID NO: 58184 - DNA, 643 bp, Homo sapiens
  misc_feature: GYAE6OF02GAXPA.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacagtccaagatgacccagtctccttccaccctgtctgcatctgtaggacgacagtacgtcaccatcacttgcccgggaccaggtcggaactagttagtaccgtggttcggccttaggttataccaaacgaacgaaaacccgaagggaaacgccccgttaaaggtcctgactcgtaatcgatcgcctacgtactttaggaacgcgggtccatcaaggttcacggcggacgtagtcgtagtcgtaggacaggtaattcgacttctccgaacctactcgtacgtacgtaccctagacgtacgcccttagagttgttaacttttcgacttaaactttagtacctcgtacagtacctaagttacgtaagtgggtaagtacggttaccgggacgacgggtacgtagggttacgagtaccgttacgaaacggtaccgttggtacgtccgtaacggacctaaccttagtccgttagtttccctaactccttcccgttacccccg

SEQ ID NO: 58185 - DNA, 939 bp, Homo sapiens
  misc_feature: GYAE6OF02G2YZB.37.33.C11.1.454.CMB.1.raw
tcagtagtgtagatcacgaccggtgctcgatttagagtgagctcgttgggtttgggggtcagactcagtcaggacacagcatggacatgagggtccccgctcagctccgtgggctcctgctgctcgtggcctccgaggacgaccaaatgtagacatccagactcgaccctagtcctcccttcctacccgttgtcctgaccagttccgtaggtagggacgaacgtagtacgtaccacctataccgtacgttccgggcccggggtacctacgggtaccggtaacttaacgttaaccggtccgttggggttcggtccgttagggtaactacgaaaccgtaacggtaaaccggaagggggtaaaccgtacccccggtaagggttacctaggtaccttacgtaacgtagtaacgtccgtacccgttaccgtacggtttacgggaaacggtcccgggtacctagtaccgtaacggttccgaggtaccggtactagggttaacgtcgttaccgggtacggtaacgtaacggttaacgtttacccgtaccttaccgttaacccgaccgtaactttcgggtaaccgtaccgtaccggtacgtaaccgacgtaccgttaggttaacttacgtttagttttaacccgtaacttttaaaccggtttactttaaccggtacgttaaaccgtaccgttaaacggtaaaccgtttaacggtttaaacggggttaccggggtaaaccgtttaaccgggtttaccccgggggaaccggggttaaccgggggttaacggtaaaccgggggtttaacaaacccggggtttaactaaccccgggttaaagttaaccgggttccggtacgggttacccttacggaaccccgtttaacccgttccggtaccggttttaacccgtaccgtttaccccgtttaccccggtaacccgttaccgg

SEQ ID NO: 58186 - DNA, 457 bp, Homo sapiens
  misc_feature: GYAE6OF02F104Z.37.33.C11.1.454.CMB.1.raw
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
  modified_base (448)..(448): a, c, t, g, unknown or other
  misc_feature (448)..(448): n is a, c, g, or t
  modified_base (453)..(457): a, c, t, g, unknown or other
  misc_feature (453)..(457): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccagagacaacgccaaaaactcactgtatctgcaaatggacggcctgagatccgaggacacggctgtgtattattgtgcgagagatttagactacaaagtttcgagtgactggtatgatgcttatgatacctggggccaagggaccatggtcaccgtctcttcagcctcaccaaggccatcggtcctcccctggccncctgctccaggacnccacctccgagacgcacagccggccctgggctgccgtggtcaaggacttacgtccattctacactactgagcgggctggcaggcncatgnnnnn

SEQ ID NO: 58187 - DNA, 553 bp, Homo sapiens
  misc_feature: GYAE6OF02FRF03.37.33.C11.1.454.CMB.1.raw
  modified_base (274)..(274): a, c, t, g, unknown or other
  misc_feature (274)..(274): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccggccagtcggactattagtacctggttcgcctggtatcaacagaaaccgagggaaacncccctaaggtcctgatctatgatgcctccagtttaggaagtccgggtccatcgaaggttcaggcggcaggtgtatcgtagggactagaacttcactctacacatacagtcgctgcagctgatgtatttgacttaacttatactgtacagactaactataagtgggatacgttccggaccggaaggtaccgtagggttagagtacgtacgaaacgtacgttaggcggtactcgaccgaaccgtacttcgttacgttacctaccttacgtccgttaccccg

SEQ ID NO: 58188 - DNA, 466 bp, Homo sapiens
  misc_feature: GYAE6OF02HWUM2.37.33.C11.1.454.CMB.1.raw
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (432)..(466): a, c, t, g, unknown or other
  misc_feature (432)..(466): n is a, c, g, or t
tcagtagtgtagatcacgaccggtgctcgatttagagtgagctcgttgggtccgccaggctccagggaaggggctggagtgggtggccaacataaagcgagatggaagcgagaaatactaatgtggactctgtgaggggccgattcaccatctccacagacaaacgccaaagaaatcaatctttttgcaaatgaacagtctgagagtcgaggacacggccatgtattactgtacgagagaacagacttggggccagggaaccctggtcaccgtctcctcagcctccacaaggccatcggtctccccgtgcnccctgctccaggcnccacctcgagagcacgacggccggcctgggctgccgtggtaccgaaggacctacgttccatcgtacactacgtgaggcggacgtggacgagggcacatagcncgncnnnnnnnnnnnnnnnnnnnnnnnnnnnnnnnnnnn

SEQ ID NO: 58189 - DNA, 582 bp, Homo sapiens
  misc_feature: GYAE6OF02GPH0V.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctccccaggagccaaatgtggacagtccaaggatgaaccctagtctccttccaccctgtctgcatctgtaggagacagagtcaccatcacttgccggcagtcggactatagtacctgtgctgtatcaacagaaaccaggaaacgccctaaggtcctagatctatgatgcctcactttaggaaagcgggtacccagtactaaggttcagcggctagtgtatcgtagggacagaattcactcacacatcagtagcctgcacgtctgtatagtattttgacttaaatttactttactacgtcaagctaattaataagtagggagtacgttccgggaccgtaagggtaccgtagggttaagacgaacgtaacgaaacggtaacgttacggtacggtacctaacggtaccctaaccgtacgttccttacggttacctttacgtaccttcccttaccccg

SEQ ID NO: 58190 - DNA, 727 bp, Homo sapiens
  misc_feature: GYAE6OF02H9D83.37.33.C11.1.454.CMB.1.raw
  modified_base (183)..(183): a, c, t, g, unknown or other
  misc_feature (183)..(183): n is a, c, g, or t
  modified_base (432)..(432): a, c, t, g, unknown or other
  misc_feature (432)..(432): n is a, c, g, or t
tcagtagtgtagatcacgaccggtgctcgatttagagtgagctcgttgggtttgaggtctcagagaagagccttagccctggactccaaggccctttccacttggtgatcagcactgagcacagaggactcaccatggaattggggctgagctgggttttccttgttgcttattttagaggtntccagtgtgagtgcagctggtggactcgtgggggagccgtggtccaggcggtgggggtccctgagactctcctgtcgccaacctgtggtcttacgagttgtagtgagtttgttggtagttggggttcggtccgccgcggtccgtacgacggggacggggtcgtaggggtagggttggggtccggaaccaacgtaagtaaaacggcgtaaggacgttaggggaaagacgaaagaaacttacgtaagttgnggtaacttcgtggtaggtacgggggaccgtatacccgtaacctacgtcctaccaacgtagaaccgaaccgtaacaaagtaaaccttacttaaactttacgttttacgaactaaacgtaacgaaacgttagtacgttggaaacgtacgtaccggaaacggtaaccgaccggtactaagttacgtaacgtttaacgtacggtaaacggacgaaacggtaaccgtaacggttacccggtacgggaaccccggtaaaccgggtaacccggtaccggttaccccgtacccgttaccccgg

SEQ ID NO: 58191 - DNA, 642 bp, Homo sapiens
  misc_feature: GYAE6OF02FYS69.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatcgtagtaggacgacagacgtccacatccacttcggcccgggctaggtccggacttagttacgtaccgtggttcgccgtggtactacaacgaacgaaaccgagggaaaccgtcccgtaaggtcctagactctagtgatcgaccctcctacgtttagggaaacggtccgggtaccctagtaccgtaaggttcgaggccggtctaggttgtaacgtcgtagggaactaagtaacttcgactctacactatcgagtcgcgtgaccgagtccgtagattagttactttcgactttaacgtttatacgttgtacagtactaagtaataaggtcgggtaatacggttccgggaaccggttaacgggtacggtaagggttagaacgtaacgtacgtaaacgtacgtgggtacgtcgtacgtaccctacgtacttcgttcgttactcgtaccttccgtaccccg

SEQ ID NO: 58192 - DNA, 701 bp, Homo sapiens
  misc_feature: GYAE6OF02H9WV3.37.33.C11.1.454.CMB.1.raw
  modified_base (100)..(100): a, c, t, g, unknown or other
  misc_feature (100)..(100): n is a, c, g, or t
  modified_base (405)..(405): a, c, t, g, unknown or other
  misc_feature (405)..(405): n is a, c, g, or t
tcagtagtgtagatcacgaccggtgctcgatttagagtgagctcgttgggtttgggggtcagactcagtcaggacacagcatggacatgagggtccccgntcagctccgtggggctcctgctgctctggctcccaggagccaaagtggtcgacagtccaaggactcgaacctagtcctccttacccaccttgtctgactatctggaggacgacagatccacctataccacgttcggaccggaccaggttccggaattagttacggtaccttgggttacgccgttggtaactacaaacgaacgtaaaccgaaggggaaacctcccgtaaggtcctagaattcgtatcgactcgacctcgtagttacgggaaccgtcggtacccagttacgtaggtcacgggtcggntacggtgttagcgtaaggactaagacttcacttcacactataccgagtacgacgtcgactacgtctagtagttacgttatttcgaactttaacgttaactttcggtacgttaccgtagtaactaacgttagttaacgggtaaggtacgttaaccgttaccgggaaccgggttaacgggtaccgtaaggggttaacgaacggtaacttaaccggtaaacgtacggtcgggttaccgtacgaccgtacctacggtttactccggttccgttacctttacccgtacgttccccgttacc

SEQ ID NO: 58193 - DNA, 658 bp, Homo sapiens
  misc_feature: GYAE6OF02F9FP7.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagctgggttttccttgttgctattttagaaggtgtccagtgtgaagtgcagctggtggactcgtgggggaggcctggtccagccgtggggggtccctgagactctcctgtgcaacctctggattcgagttgtagtgtatttgttggagttggggttcgggtccgccgaggcctccggagggggtaacgggggcgtggggaggtgggggtacggacccaaaacgtaagtaaaacggcggaaggtaagtaggggaaacggcggaaagtaaaataacttagtggtgacgtcttaggtgggacggggtccgtacgttaccaaccgtactcctaccacgacgaaaccgaaaccgacccaaagaaacttactaaactttactttttagactaaatagaactagtacgtagagagtacggaagtacgaccgactagttagtagttacctaggtaacggagtaacggaacgagtacggttacgggaccgaaccgggtaccgtcggtacctaccgtccg

SEQ ID NO: 58194 - DNA, 793 bp, Homo sapiens
  misc_feature: GYAE6OF02I61AO.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaatgtgacagtccagatcgaccagtctcctccaccctgtctgcatctagtaggacgacagacgtcaccatctacttcggcccgggtaccgaggtaccggactacttacgtacccgttggttcggtccttcgggtaatacctaaacgaacggtaaaacccgaagggggtaaaccgtaccccccgttaaaggtccccgttaggtaaccttaacgttaacgtcggtaaagttccgggtacccttacccgtaaacggttttaacggggaaaacgggtccccgggggtttaacccctaaggttaccgtaacgggtttaccgacgggtacggacgtacggttaggttacgttacggtacgggacctaaggtaacttaccgtactaccgttaccaaccgtactagtaccgtacgtaccctagactacggtcccttagttaacttagttacttttaacggtaccttaaacgttttaacgttaccgttacgtacgttacgacccgttaaagttacgttaaagggtacggtacgggtacggttcccggggtaaccgggtaacggggtacccgtaagggttacgaacgtaggttaaccgaactacggtaggtccgtacggcacccgtagtcgtacgttcgttacctcgttacctccttaacccg

SEQ ID NO: 58195 - DNA, 530 bp, Homo sapiens
  misc_feature: GYAE6OF02HAY42.37.33.C11.1.454.CMB.1.raw
  modified_base (369)..(369): a, c, t, g, unknown or other
  misc_feature (369)..(369): n is a, c, g, or t
  modified_base (495)..(495): a, c, t, g, unknown or other
  misc_feature (495)..(495): n is a, c, g, or t
  modified_base (497)..(498): a, c, t, g, unknown or other
  misc_feature (497)..(498): n is a, c, g, or t
  modified_base (500)..(530): a, c, t, g, unknown or other
  misc_feature (500)..(530): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaaagaaatcaattcttttttgcaaatgaacagtctgagagtcgaggacacgggccatgtattactgtacgagagaacagacgttggggccagggaaccctggccaccgtctcctcacgccctccaaccgaacgggccccagtccgggtcccttcccccgtgggcccgccccgtcgcctccgacggacgccacccgtccgaagngaccacgacggccggcccgtcggggctcggccgtcgggtaccaaacggtaccttaccttacctacttcctaaccaccttaccgaggtacggcccggggtctcgggaccgaacgggccgagacgtancnntnnnnnnnnnnnnnnnnnnnnnnnnnnnnnnn

SEQ ID NO: 58196 - DNA, 600 bp, Homo sapiens
  misc_feature: GYAE6OF02JBBEJ.37.33.C11.1.454.CMB.1.raw
  modified_base (561)..(562): a, c, t, g, unknown or other
  misc_feature (561)..(562): n is a, c, g, or t
  modified_base (565)..(567): a, c, t, g, unknown or other
  misc_feature (565)..(567): n is a, c, g, or t
  modified_base (569)..(569): a, c, t, g, unknown or other
  misc_feature (569)..(569): n is a, c, g, or t
  modified_base (571)..(600): a, c, t, g, unknown or other
  misc_feature (571)..(600): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaattctttttgcaaatgaacagtctgagagtcgaggacacggccatgtattactgtacgagagaacagacttgggggccagggaacccctgggtccacccgtctccctcacgccctccaacccgaacggggccccctagtccggttccctttcccccccgtgggcccgcccccgtgcccgtacccgaaggggaccgccctacccgtccccggaaggaccgcccaacccgtacggcccgggtccccgtgggggccttcgggcccgttggggtaccaaaaccgggtacccttaccctttccgaactttcccgtaaacctaccttaaccgttgggaaccgggtccggggtacctcggggaaccgaaacggggccacgtaacgtaggcacnngcnnngncnnnnnnnnnnnnnnnnnnnnnnnnnnnnnn

SEQ ID NO: 58197 - DNA, 694 bp, Homo sapiens
  misc_feature: GYAE6OF02GMJUU.37.33.C11.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtcctccttaccacctgtctgcatctgtagganacagngtcaccatcacttggccggcagtcgactattagcctgtcgctgatacaanagaacaggaactccctaaggtcctagactctaatgatcgcctaccgtacgttaggaacggccgggttaccagtaccgtaggttacgaggacggcgtaagttcgtagcggtaacgggtactaagtaacttcaaccgttctaccaccttagtacgacgtacgtccgtacgacgtacgtccgtagtattacgtttaattacggactttaacgtttaactttaccgttagtaacccgtataccgtttaaactacgtttaaggtacgggtaccgtttaacgggtccgggaaccgggtacgggttaacccggttaagggttaacggaacgttaacggtaacccggtaaaggttacggttaacgggtccggtaaccgacccgtaaccgttacgtaccggtttaccttacgggtttaccttacccgttaccgtttacccccgttacccgg

SEQ ID NO: 58198 - DNA, 764 bp, Homo sapiens
  misc_feature: GYAE6OF02GCCKW.37.33.C11.1.454.CMB.1.raw
  modified_base (513)..(513): a, c, t, g, unknown or other
  misc_feature (513)..(513): n is a, c, g, or t
  modified_base (527)..(527): a, c, t, g, unknown or other
  misc_feature (527)..(527): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatcgacccagtctcccttccaccctgtctgcatctgtaggagacagacgtccacctatccacgttcggcccggggtccaaggtccggtaacttaagtttacggttaacccgttggggtttacgggtccgttagggttaataccgtaaaccgaaacgggaaaaacccgtaagggggaaacccgtacccccgttaaacgggttccttaggaacttaccttagtggtattccgtcccttaccgtacggtttaacgggaacgggtccggggtaccctacgtacgtaacgggttcgacgggtaccggacgtaggtacgtacgtacggtacgggactaagtaacttccgtacttctacctaacncttacacgggtacnccgtagaccgtacgtccgtagtaacgttacgttaacttttcgaacctttaagtttaacttacgttacggttacaacgggtacttaaacttaaggttaggtacgggtaagtaaccgggtttccggaaccgggtacgggaacgggtacggttacgaacgttaacgtaaccgtaacggacggttcggtacgtcgtacgaactacgtactcgttcgtaccgttcctacgttcccgtacccg

SEQ ID NO: 58199 - DNA, 700 bp, Homo sapiens
  misc_feature: GYAE6OF02J1253.37.33.C11.1.454.CMB.1.raw
  modified_base (528)..(528): a, c, t, g, unknown or other
  misc_feature (528)..(528): n is a, c, g, or t
tcagtagtgtagatcacgaccggtgctcgatttagagtgagctcgttgggtttgaggtctcagagaagagccttagccctggactccagggcctttccacttggtgatcagcactgagcacagaggactcaccatggaagttggggctggagtcgttgggttttccttggttgcttattttagaaggtgtccagtgtgaagtgcgagctggtggacgtcggtgggggaggtccgtggtccgaggtccggtcggggggtccctggagtccttcctccgtgtcgaccctacctcgtggtacttcgagttgagttgtattggtggtagtgggttcgggccgcgtaggccgtacgaagggggagggcgtgggtaggtggggtcgaccaagaagtaacgcggagtagtaggaaggcgaagtaaatcgtagtggtacgacgtcgtggtcggtacgggccgtagttaccgactacgtacctacccgaagtaaccgaacgtaaccgaccaaagtaacgtactaaactttcgtttanaacgtaaagtcggaaactccggttagaggtaagacggtacgaacgggtacccgacgtaccgtagttacgggtattaacccggttaggaaacccggtaggtaaccgaaacgttaccggtaggttaaccggggacccgaaagggttacccgtgggttaccccaaccggttcccg

SEQ ID NO: 58200 - DNA, 693 bp, Homo sapiens
  misc_feature: GYAE6OF02GLV5I.37.33.C11.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
tcagtagtgtagatcacgaccggtgctcgatttagagtgagctcgttgggtttgggggtcagactcagtcaggacacagcatggacactgaggtcccgctcgagctcctgggctcctcgctgctctggctcccaggagtcccaaagtcgtagtacagtccagactgaccctacgtctccttccaccctggtctcgcgagtctcggtagntacagctcaaccntcacttagccggtccagtcgactattacgacctgtggcctggtancaacgacgaaccgaggaacgtcccctaaggttcctgatctactgacgtcgcctactacgtttagggaacgtccggggtcccagttacgaacggttcctaggccggtcgtaacggttcgtaacgttccgtacggggaactaacggttaaccttacccaaaccgttctacccgtaaccctaccgttacgtaccgtaacgtcccgtacgtacgtacgtacccgtagtaccgttaggtaacgttttacggaccgttaaacttccgttaattcccgtagtaacgttcaaacttagttaacgtgggtaatacggttccgggtaccggaagggttaccgtaggggttagtagaaacggtacgtaaacggtaacgtggtacgaccgtcgtaccgtactacgtcgttactaccggtcttcccgtacccgttcccg

SEQ ID NO: 58201 - DNA, 704 bp, Homo sapiens
  misc_feature: GYAE6OF02H0MU1.37.33.C11.1.454.CMB.1.raw
  modified_base (612)..(612): a, c, t, g, unknown or other
  misc_feature (612)..(612): n is a, c, g, or t
  modified_base (616)..(616): a, c, t, g, unknown or other
  misc_feature (616)..(616): n is a, c, g, or t
  modified_base (624)..(624): a, c, t, g, unknown or other
  misc_feature (624)..(624): n is a, c, g, or t
  modified_base (629)..(629): a, c, t, g, unknown or other
  misc_feature (629)..(629): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (669)..(669): a, c, t, g, unknown or other
  misc_feature (669)..(669): n is a, c, g, or t
  modified_base (673)..(673): a, c, t, g, unknown or other
  misc_feature (673)..(673): n is a, c, g, or t
  modified_base (698)..(698): a, c, t, g, unknown or other
  misc_feature (698)..(698): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaaagaaatcaatctttttgcaaatgaaacagtctgagagtcgaggacacggccaatgttaattactgtacgagagaacagacgttgggccagggaaccctggtaccaccgtctcctcacgcctaccaaccgaacgggccccaacgttccggtaccctttaccccccgtgggaccggtaacccttcggccgtacccaagggaccgacccgaacccgttaccccggaagtacgaccaaacgtaacggcccggggtaccccgttagggggaccctttcgggtccccttagggggttaccgaaaaacgggttaaacccgttaacccgttttaccccaaagtttaccccttaaaccgtaacccgtttaaccggttaacgggaacggggacccgggggtacgttaacgggggaacccgtaaaacggggaccgtacgtaaacgtaggagacgnacgngcgacagngacanacgnacngacgacgtacgatacacgananatacgtacganaganacacacgacgtacgacgtatactanagtacg

SEQ ID NO: 58202 - DNA, 744 bp, Homo sapiens
  misc_feature: GYAE6OF02IRWRM.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagttctccttccaccctgtctgcatctggtaggagacagagtcacatcacttgccggcagtcggactagttagtaccttggttgccgtggtactacaaacgaacgaaaccgacgggaaaccgtaccccgtaaggtcctagtaactcgtagtgacgtcggaccctacgtaacgtttagggaaacggtccgggttacccaagtacgtaacggttccgacggcggtactaggttacgtacgttcggtaggggtaactaaggtaacttccaaccttccgtaccaccaagtccgtaaggtaccgaccctggaccgtaacggtcccttaggtaagttcggttaacgttttcggaaacctttaaacgtttactttacgttacgttaaccgacgttacctaagtttaaagttaacgggtacgggtaacgttaaccggttccggggaacccgggtaacggggtaaccggtaggggttaacgaacggtaaccgtaaccgtaaaacggttcggttgggtaccgtccgttaacggaacctaacgtttacggtccgttacgttacccgttacgttaccgttcccccgtaccccgg

SEQ ID NO: 58203 - DNA, 655 bp, Homo sapiens
  misc_feature: GYAE6OF02F4GS7.37.33.C11.1.454.CMB.1.raw
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (651)..(651): a, c, t, g, unknown or other
  misc_feature (651)..(651): n is a, c, g, or t
  modified_base (653)..(654): a, c, t, g, unknown or other
  misc_feature (653)..(654): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccgagggaaggggctggagtgggtggccaacataaagcgagatggaagcgaagaaatactatgtggactctgtgagggccattcacatctccacagacaacgaccaaagaaatctaattctttttagacaaaatagaacagtctagagagtacgacggacacggacatagtaattactgtaacgagagaacagtacgtgggacgaacgggaaccctggtaccaccgtctacctcgacgccctccgaacgaacgggtccccagttaccgggtcccttccccggtggcccgtccccgtcgcccttacgaacggggacacccgtacccgtaccggaacgaccgacgaaccgaccgggcccggtaccccggtgggccgttccggtcccgttaggtaaccggtaaaccggtaccgttaaccttaccgtaactaccttaaaccgtaaccgttaaccgtgggaacggtacccgggcgttaccggaagtaaccggacgactacgtagagcagcacgtgacangnagcncnnc

SEQ ID NO: 58204 - DNA, 716 bp, Homo sapiens
  misc_feature: GYAE6OF02JBH2M.37.33.C11.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
tcagtagtgtagatcacgaccggtgctcgatttagagtgagctcgttgggtttgggggtcagactcagtcaggacacagcatggacatgagggtccccgctcagctccgtggggctcctgctgctctggctcccaggagccaaatgtgacatccagatgacccagtcctccttccaccctgtctgcatctgtagganacagntcaccatcacgtcgccggccagtcggactattagtaccgttggttcgcctggtatacaacaagaaaccgaaggaaacgtaccccgtaacggtccgtagactctagtgactccgtcccgtacctaacgtttacggaaacggtccggggtaccagtacgtaacggtcgacggcgacgtagtagtatcggtacggaacgtaacgtaacttaccactcctacaccctatactacgtaccgtccgtacgccgtcgaccgttagtattacgttatttacgtacgttaactttactttaccgttagtaccgtaacgtacctaagtttaaactaaggttacggggtaacgtaccggttaccggggtaccgggaaccggggtaaccggttaagggttaacgtaaacggttacgtaaaccgtaaaccggtaacgtttcgggttaccgggtaccgttaccggaccctaccgttaccgtttccgtttacgttacccttttacgtacccttacccgtttacccccgg

SEQ ID NO: 58205 - DNA, 577 bp, Homo sapiens
  misc_feature: GYAE6OF02HFA2J.37.33.C11.1.454.CMB.1.raw
  modified_base (229)..(229): a, c, t, g, unknown or other
  misc_feature (229)..(229): n is a, c, g, or t
  modified_base (266)..(266): a, c, t, g, unknown or other
  misc_feature (266)..(266): n is a, c, g, or t
  modified_base (391)..(391): a, c, t, g, unknown or other
  misc_feature (391)..(391): n is a, c, g, or t
  modified_base (429)..(429): a, c, t, g, unknown or other
  misc_feature (429)..(429): n is a, c, g, or t
  modified_base (561)..(561): a, c, t, g, unknown or other
  misc_feature (561)..(561): n is a, c, g, or t
  modified_base (563)..(565): a, c, t, g, unknown or other
  misc_feature (563)..(565): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(574): a, c, t, g, unknown or other
  misc_feature (572)..(574): n is a, c, g, or t
  modified_base (576)..(576): a, c, t, g, unknown or other
  misc_feature (576)..(576): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaaacataaaagcgagatggaagcgaagaaatactatgtggactctgtgaggggccgaattcacatctccanagacaacgaccaagaaatcaattctttttgacaaatnaacagtctagagagtcgagacacggcatagtatactgtaacgagagaacagacgttgggaccagggaaccctggtccaccgtctcctcacgcctaccacgaacggcccagtccggccttccccgngccgtcctcgacctcgacggacgacaccgtaccgaaanacgaacacggccgacccgtgggacctcggcccgtggttaccgaacggtaccttaccgttacctacgtaaccttaactaaccgtacgttacgacgggacggtcgtcgacgaacggcaacgactagcagcacgncnnncgnanannnana

SEQ ID NO: 58206 - DNA, 477 bp, Homo sapiens
  misc_feature: GYAE6OF02G5Z31.37.33.C11.1.454.CMB.1.raw
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (409)..(409): a, c, t, g, unknown or other
  misc_feature (409)..(409): n is a, c, g, or t
  modified_base (440)..(440): a, c, t, g, unknown or other
  misc_feature (440)..(440): n is a, c, g, or t
  modified_base (444)..(477): a, c, t, g, unknown or other
  misc_feature (444)..(477): n is a, c, g, or t
tcagtagtgtagatcacgaccggtgctcgatttagagtgagctcgttgggttgggtccgccaggctccagggaaggggctgggagtgggtggccaacataaaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccaggggaaccctggtcaccgtctcctcagcctccaccgaagggcccatccggtccttcccccgnggccgccctgcctaccgaggacncaccctcgacgagccacngccggccgtgggctgcagtggtacaagactactccatcacactacgngacgcgggctggacaagggcgactaagagcngacnnnnnnnnnnnnnnnnnnnnnnnnnnnnnnnnnn

SEQ ID NO: 58207 - DNA, 451 bp, Homo sapiens
  misc_feature: GYAE6OF02GLL1T.37.33.C11.1.454.CMB.1.raw
  modified_base (427)..(427): a, c, t, g, unknown or other
  misc_feature (427)..(427): n is a, c, g, or t
  modified_base (432)..(438): a, c, t, g, unknown or other
  misc_feature (432)..(438): n is a, c, g, or t
  modified_base (440)..(451): a, c, t, g, unknown or other
  misc_feature (440)..(451): n is a, c, g, or t
tcagtagtgtagatcacgaccggtgctcgatttagagtgagctcgttgggtccgccaggctccagggaaggggctggagtgggtggccaacataaaagcgagatggaagcgagaaatactatgtggactctgtgaggggccgattcaccatctccacagacaacgccaaagaaatcaatctttttgcaaatgaacagtctgagagtcgaggacacggccatgtattactgtacgagagaacagacttggggccagggaaccctggtcaccgtctcctcacgccctcccaccaacgggcccagtccggtccttcccccctgggccgccctggcctccgagggacgccacctccgagacgcacaggccggcccgtgggctgcctggacaagactacttcatctacactactgacgcggctggcaaggcnatagnnnnnnncnnnnnnnnnnnn

SEQ ID NO: 58208 - DNA, 573 bp, Homo sapiens
  misc_feature: GYAE6OF02GC91T.37.33.C11.1.454.CMB.1.raw
  modified_base (397)..(397): a, c, t, g, unknown or other
  misc_feature (397)..(397): n is a, c, g, or t
  modified_base (554)..(554): a, c, t, g, unknown or other
  misc_feature (554)..(554): n is a, c, g, or t
  modified_base (560)..(560): a, c, t, g, unknown or other
  misc_feature (560)..(560): n is a, c, g, or t
  modified_base (566)..(567): a, c, t, g, unknown or other
  misc_feature (566)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
tcagtagtgtagatcacgaccggtgctcgatttagagtgagctcgttgggtttgggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgaggggccgattcaccatctccacagacaacgccaagaaatcaattctttttgacaaatgaacagtctgagagtcgaggacacggccatgtacttactgtacgagagaacagtacgttggggccaagggaccctggtaccaccgtctcctcacgccctccaccgaacgggcccaagttccggtccttcccccgnggtccgccctgcctccgacggacgccacctcccggaagcgaccacgcgccggcccgtgggctcgcgttcgacaaggcctacgttccactacctactaacctcgtacggacggccgggtacgtcggaccgaaggccgaaccgtaggtcgagtcgtacngacgtngcgcgnncncngn

SEQ ID NO: 58209 - DNA, 819 bp, Homo sapiens
  misc_feature: GYAE6OF02IFRAX.37.33.C11.1.454.CMB.1.raw
tcagtagtgtagatcacgaccggtgctcgatttagagtgagctcgttggggtttgggggtcagactcagtcaggacacagcatggacatgagggtccccgctcagctccgtggggcctcctgctgcctcgtcggctcccgaggacgccaaatgtgacatccagatacgaccctacgtccttcccttacccaccccttgttcgtcgtactattccgttaggtaacggaggaactacggacgtaccacctacttccaccgttaccggcccgggtaccacggttaccggtacttagttacgtaccgttgggttcggtccgttaggttactacgaaaccgtaaacgaaaaccggacggtaaaccgtaaccccgttaacggttcctagacttacgtagttacggtaactccgttaccgttaccgttacggttacgggaacgggtccgggtacctagtaacgtacggttacgacggcggtacagttacgtacgttcggtaggaacctaaggtaaccttacctaccgttaccgaacccaccgtaaacttacgtaaccggtacgtaccctgggaccttacggtacctagttagttcgttaactttagtaactttaacctttaacgttaccgttaacgttccgtaaccgtattaaacccgttaggttaagggttagacggtttaccggggtacggtaacccgggaacggttaggttacggggttaaactaacgttaaccgaaccgtaaacgtccgggtattacccggtgtacccgtaacgtaaccgttcttacggttacttcccgttacgttccctacccggttcccc

SEQ ID NO: 58210 - DNA, 625 bp, Homo sapiens
  misc_feature: GYAE6OF02FUUZC.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtcctggttgcctggtatcaacagaaaccagggaaacgcccctaaggtcctgatctagtgatgcctcacgtttggaaacggtccgggtcccaagtcgtaaggttcaggcggacagtagtatcgtgggacagtaacttcactctacacctatcagtacgctgacacgcctagtacgtgtaattttgacttaaactttagttacttcgtactaagtacctaataagttaaacgtggggtaactaacgggtttccgggaacccgggaaggggttaacccgtaggggtttaccgaaggtaacgtacggaaaaccggtaacgttgggtacggtaccgtacgtacccgtaaccgttactccgtttacgttcctttacgtaccgttcccgttaaccccg

SEQ ID NO: 58211 - DNA, 430 bp, Homo sapiens
  misc_feature: GYAE6OF02G7B5O.37.33.C11.1.454.CMB.1.raw
  modified_base (410)..(410): a, c, t, g, unknown or other
  misc_feature (410)..(410): n is a, c, g, or t
  modified_base (415)..(430): a, c, t, g, unknown or other
  misc_feature (415)..(430): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaaggcccatcggtcttcccctggccgccctgctccaggacgcacctccgagacgcacagccggccctgggcctgcctggtcaaggcttactccatctacactacgtgagcggctggcaaggcanatagnnnnnnnnnnnnnnnn

SEQ ID NO: 58212 - DNA, 651 bp, Homo sapiens
  misc_feature: GYAE6OF02FPX9X.37.33.C11.1.454.CMB.1.raw
  modified_base (619)..(619): a, c, t, g, unknown or other
  misc_feature (619)..(619): n is a, c, g, or t
  modified_base (624)..(624): a, c, t, g, unknown or other
  misc_feature (624)..(624): n is a, c, g, or t
  modified_base (638)..(638): a, c, t, g, unknown or other
  misc_feature (638)..(638): n is a, c, g, or t
  modified_base (644)..(644): a, c, t, g, unknown or other
  misc_feature (644)..(644): n is a, c, g, or t
tcagtagtgtagatcacgaccggtgctcgatttagagtgagctcgttgggtttgggggggtccctgagactctcctgtgcaacctctggattcagttgtagtgattgttggatgggttgggtccgccaggctccgagggaaggggctgggagtgggtggccaacataaagcgagatggaagcgagaaatactatgtggactctggtggaggggccgattcaccatcctccacagacaacgaccaagaaatctaattcttttgacaaatgaactagtcgtagagacgtacggaaggacgaccggaccagtgttacgttactaggtaacggagaagaacgagtacggttcgggaccgtacgggtaaccgtggtaccaccgttccgtcctcgacgccctaccgaccgaaccggcctacgttccggttcccgttcccgtcggccgtcccgtcgcctaccgagacgccaccgtaccgacgacgacgacgacggccggtccgtcgggcgtcgtccggttacggtaccgtaacggtaccgtaaccgttacctaaccgttcctaacctacgttaccgtagggtaccggtccgggtacgtacggacgaacggacgaccgtagacgtgngtcgncgagcgacgcgtcncgtacncgtgtcg

SEQ ID NO: 58213 - DNA, 698 bp, Homo sapiens
  misc_feature: GYAE6OF02GQFZB.37.33.C11.1.454.CMB.1.raw
  modified_base (438)..(438): a, c, t, g, unknown or other
  misc_feature (438)..(438): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtcctccttccaccctgtctgcatctggtaggagacagagtcaccatcacttcggccgggcaggtcggactagttagtaccttggttggcctaggtactcgaaacgaacggaaaccgaagggaaacgccccgtaaggtcctagatacgtatgtatcgtccctccgtacgtttagggaacggtcgggtacccagtacgtaacggtacgacgacggtactaggtgtacgtcgtggaactagtaattccgtaactcgtaccaccatacgtaacgtacnccgtagaccgacgtacccgtgtaacgttacgttaacgttttcgaaccttaaacttttacgttaacgttcggtacctaacggtcctaaacgttaaacgttaaacggttaggggaaccggttagggttaccggggtacccgggtaacggggtaacgttaggggtaagaacgtaactaacggaaccgtaacggtggtacggtacctaccggtccgtaaactcgtttaccgtcgttaaccttccgttaccgttccccttccccg

SEQ ID NO: 58214 - DNA, 673 bp, Homo sapiens
  misc_feature: GYAE6OF02GUCDB.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccacctgtctgcatctgtagagacagagtcaccatcacttgccggcagtcgactattagtacctggttgcctggtatcaacagaaaccaggaacgccctaaggtcctagatctatgatcgcctaccacgtttaggaaacgtcgggtacccagttacgtaacggttcaggccggactagttgtatcgtagggacaggtaacttcgacttctacacctatacgagtacgcctagacctacgtccttaggtactttaggttacttttcgaaccttaacgttttaactttaccgttacggttaccaacgtaccttaacgttaaacgttaagttacggggtaacgttaccggttaccgggtaccggtaacggggtaaccggttagggtttaacgaacggttaacctaccggtaaaccggtacggttcggtacggttaccgtacgtaacccgtaccgtacgttccggtttaccgttacctttaccttacccgttcccgtttaaccccg

SEQ ID NO: 58215 - DNA, 625 bp, Homo sapiens
  misc_feature: GYAE6OF02F0SJW.37.33.C11.1.454.CMB.1.raw
  modified_base (542)..(542): a, c, t, g, unknown or other
  misc_feature (542)..(542): n is a, c, g, or t
  modified_base (598)..(598): a, c, t, g, unknown or other
  misc_feature (598)..(598): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (621)..(622): a, c, t, g, unknown or other
  misc_feature (621)..(622): n is a, c, g, or t
tcagtagtgtagatcacgaccggtgctcgatttagagtgagctcgttgggtttggggggtccctgagactctcctgtgcaacctctggattcagttgtagtgattgttggatgggttgggtccgccaggctccagggaaggggctggagtgggtggccaacataaagtgagatggaagcgagaaatactatgtggactctgtgagggccgattcaccatcctccacagacaaccgaccaaagaaatactaattctttttagacctaaaatagaacagtcgtgagagtcgaggaacacggccatgtatactgtacgagagaacagacgttcgggacgacgggaacccgtcggtccacccgtcctccgtcacgtcctacccaccgaaccgggcccacgtccggttaccccttcccccggtacggcccgtccctcggtccctaccgacggacgccaacccgtccgaacggaccgcacgtacggccggcccgtcgggcctcgtaccgtgttaaccgaggtacccttaacgtcctaattacccgtanaacccgttagacggtcgggacgtaccgtcgggacgaacgggcctcgtagtacgcgngtagctcgactagtncncngcgnngac

SEQ ID NO: 58216 - DNA, 599 bp, Homo sapiens
  misc_feature: GYAE6OF02GSCFZ.37.33.C11.1.454.CMB.1.raw
  modified_base (250)..(250): a, c, t, g, unknown or other
  misc_feature (250)..(250): n is a, c, g, or t
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
tcagtagtgtagatcacgaccggtgctcgatttagagtgagctcgttggggtttgggtccgccaggctccagggaaggggctggagtgggtggccaacataaagcgagatggaagcgagaaatactatgtggactctgtgagggccattcaccatctccacagacaacgccaagaaactcaattcttttgactaaatgaacagttctgagagtcgaggacacggccattgtacttacgtgtaacgagaanaacagtaccgttgggaccaagggaaccctggtcctaccgtctccncgacgtcctacaccgacggtcccagttccgtccttccccgnggccttccncgcctacgaggtacnccaccgtcgagaccnacgcggcgtccgtggccngccgtgaacgtagaccttcgtactcgtacttacgtactacggtggaccgtcgggactcgggacgtacggctacgtatcgntacgngatgntacgcangttcacgtcacgttcgcagcgtacgtacggctatacggttcaccggtaacttgtaacggacctaggttccgtaaggacgggttcccgttaacgtacgtacgtacgtacg

SEQ ID NO: 58217 - DNA, 705 bp, Homo sapiens
  misc_feature: GYAE6OF02GONL8.37.33.C11.1.454.CMB.1.raw
  modified_base (504)..(504): a, c, t, g, unknown or other
  misc_feature (504)..(504): n is a, c, g, or t
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgacatccagatcgacccagtctccttccaccctgtctagcatcgtagtaggacgacagagtaccaaccattccacgttcggcccgggacctaaggtaccggaacttaacgtttacgtacccgttgggttcggtccgttaggtacgtactaaacgaacgaaaccgaacgggaaacgacccccgttaaaggtcctagtactaccttaagtagacgtcgtacctaccgtaacgtttaggaaaccggtccggggtaccctaacgttaccgtaaacggttcgaacggcggacgtaggttagtacgtcggtagggaactaacgtaacttcgacctctaccactatacgacgtaccgcgtacggtnacgtaccttgacgttagttaacgtttacgaacctttaacgttactttacccgtagttaccgaacgtactaacttaacggttaagtacgggttacgtacggtttaccggaccggaacgggttacggtagggtagtaacgtacgttaacgaacgtaacgtggaacgctacgactactacgtcttactctacctcgtcctaccg

SEQ ID NO: 58218 - DNA, 545 bp, Homo sapiens
  misc_feature: GYAE6OF02GX9CO.37.33.C11.1.454.CMB.1.raw
  modified_base (510)..(545): a, c, t, g, unknown or other
  misc_feature (510)..(545): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaaattcttttttgcaaaatgaacagtctgagagtcgaggacacggccatgtattactgtacgagagaacagacgttggggccaggggaaccctggtccaccgtcctcctcagcctccaccaacgggcccagtccggttccttccccccgtggccgccccgtgcctccgaggacgccaacccgtccgagacgccaacgacggcccggcccgtggggcctcggtcccgtggtacgaacggtaccttaccttccgaacttcctaacctaaccgttacgtacggtacggccggggtaccttcgggacgtaacgggccgacgtaagtacgcagtannnnnnnnnnnnnnnnnnnnnnnnnnnnnnnnnnnn

SEQ ID NO: 58219 - DNA, 645 bp, Homo sapiens
  misc_feature: GYAE6OF02HGG2Z.37.33.C11.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (621)..(621): a, c, t, g, unknown or other
  misc_feature (621)..(621): n is a, c, g, or t
tcagtagtgtagatcacgaccggtgctcgatttagagtgagctcgttgggtttgggggtcagactcagtcaggacacagcatggacatgagggtccccgctcagctcctgggctcctgctgctctggctcccaggagccaaatgtgactataccagatgacccagtctccttccaccctgtctgcatctgtaggngacagagtacacanctactggccggccagtcgtacttattaggtactggttcggcctggtactacaacgaagaaaaccgaagggaaccgacccgttacggtcctagtactctagtgtactcgtcctcctacgttaggaacgtccgggtaccagtacgtaaggtcgaggtcgactgtgatcgtagggacagtaacgtctacctaccgtacctacctaagtccgtaacgtacgtactcggacgtaccgtcgtagtagttacgttagtttacgtaccttaaacgtttacttaccgttacgtacctactaccttaacgtaacgttaaggtaacgggtaggttaaccggttcgggaccgggtaaacggggtacggttacggtaggacgtagtaaccggaagtacggtcggacggtcgtaacgacctacgtntcgtagtcctactcgtcctacccg

SEQ ID NO: 58220 - DNA, 751 bp, Homo sapiens
  misc_feature: GYAE6OF02IOLCB.37.33.C11.1.454.CMB.1.raw
  modified_base (287)..(287): a, c, t, g, unknown or other
  misc_feature (287)..(287): n is a, c, g, or t
tcagtagtgtagatcacgaccggtgctcgatttagagtgagctcgttgggtttgggggtcagactcagtcaggacacagcatggacatgagggtccccgctcagctcctggggctccctgctgctctggctccccaggacgccaaatgtgacatccagatcgacccagtcctccttcccaccctgtctgcatctgtaggagacagagtcaccatcactcggccggccaggtcgactattacgtaccgtggtcgtcgtggtatacaacgaacgaaaccgaagggaacnccccgttaagtcctgtaatctatgtatcgcccttcctaacgttaggaacggtccgggtaccctagttacgaacggttcaacggtcggtacgtaggttcgttaacgcggttagggaacgtaacgtaaacgtttacctaaccttaccgtaccctaaccgtaagttaccctacggttaccgtacccgttaacggcccgaacgggtcccgttaagttaaacggttcgtttaaacggttttaaccgtaaccttttaaaaccttttagtttaacccgttagtttaaccaaacgtaccctaacgtttaaggtaacgggttagggacgtttaacgggttcccgggaaccggggtacggtaaccggtaagggtacgtaacgtaaccgtaagtaaaaccggtgttacgggtacgacggtacgaccctaacgtcgtcctttacggtacctttaccgtacccgttcccgttacccg

SEQ ID NO: 58221 - DNA, 852 bp, Homo sapiens
  misc_feature: GYAE6OF02I0M07.37.33.C11.1.454.CMB.1.raw
  modified_base (410)..(410): a, c, t, g, unknown or other
  misc_feature (410)..(410): n is a, c, g, or t
tcagtagtgtagatcacgaccggtgctcgatttagagtgagctcgttgggtttgaggtctcagagaagagccttagccctggactccaaggcctttccacttggtgatcagcactgagcacagaggactacaccatggaattggggctgagctgggttttccttgttgctattttagaggtgtccagtgtgaagtgcagctggtggactcgtgggggacgtccgtcggtccgagcccggttcggggggtccctaggacgaccttccgtcctgtcgaccaacccttctaggacttcgtacgttggttagtgtatttggttaggtacgttgggggtttcgggtccgacctaagggcctacccgggaaggggtaacggggcgttagggaacggtggggtacggtacccgaaanaacgtaaaagacggaagacgtagggtaaaggaccggaaagaaaaactttacgtaaagtcggtaggtaaccctttcgttggggtacgggttaaccgggggtaccgttaacgttaccccgtaaacctaacgtttaccccgttaacccgtaaccgaaacggaaaccgtaaaaccggaaacccgtaaaaagtaaaaccttactaaaacgttttacgttttttaacgaaccgttaaaaacgtacgtaaaacgtacggttaaacctaggaaacgggttaacggtaccggaaccgggtaacctaaacccgggtaaccctaagtttaagtttaaacgtttacgtaacgggttaaacccgtaagggaaacctaaaccgaacggttaacggttacccggggtaccggaaccgggtaaacccccgtcggggtacccgtaacccgttaacccgg

SEQ ID NO: 58222 - DNA, 686 bp, Homo sapiens
  misc_feature: GYAE6OF02JH8VC.37.33.C11.1.454.CMB.1.raw
  modified_base (269)..(269): a, c, t, g, unknown or other
  misc_feature (269)..(269): n is a, c, g, or t
  modified_base (660)..(660): a, c, t, g, unknown or other
  misc_feature (660)..(660): n is a, c, g, or t
  modified_base (669)..(669): a, c, t, g, unknown or other
  misc_feature (669)..(669): n is a, c, g, or t
  modified_base (674)..(674): a, c, t, g, unknown or other
  misc_feature (674)..(674): n is a, c, g, or t
  modified_base (679)..(679): a, c, t, g, unknown or other
  misc_feature (679)..(679): n is a, c, g, or t
  modified_base (682)..(682): a, c, t, g, unknown or other
  misc_feature (682)..(682): n is a, c, g, or t
tcagtagtgtagatcacgaccggtgctcgatttagagtgagctcgttgggtttggggggtccctgagactctcctgtgcaacctctggattcagttgtagtgattgttggatgggttggtccgccaggctccaggaaggggcgtggagtgggtggccaacataaagcgagatggaagcgagaaatactatgtggactctgtgagggcgattcacatctccacagacaaccgacaagaaatcaatctttttgacaatgaacagtctgagngtacgagacgacggccatgtattacgtagtagagagaacagtacgttagggccgaacgggtaccctaggcctaccggtcctaccgtacgacgccctccaacgaaccgggcccagttccggtacccgttcccctcggccgcccgttcgacccttcccggacggtaccgccctaacccgtccggaacgtaccgactacccgaccggtacccgggcccgtagggtcccgtaccggtccggtacggttaccggaaccggttaccttaacccgtacccgttactttacccgtaaccgtaacccgttaaccgtccgggtaaacgggtcccgggaaccgtttacggggacctaaaccgggggtccgtaaccgtacgttaacggcaacggtcgaaccgngtacgacgngtacngacgngcngtag

SEQ ID NO: 58223 - DNA, 546 bp, Homo sapiens
  misc_feature: GYAE6OF02F1EHQ.37.33.C11.1.454.CMB.1.raw
  modified_base (523)..(524): a, c, t, g, unknown or other
  misc_feature (523)..(524): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
  modified_base (536)..(546): a, c, t, g, unknown or other
  misc_feature (536)..(546): n is a, c, g, or t
tcagtagtgtagatcacgaccggtgctcgatttagagtgagctcgttgggtccgccaggctccagggaaggggctggagtgggtggccaacataaaagcgagatgggaagcgagaaatactatgtggactctgtgaggggccggttcaccatctccagagacaacgccaagagctctctgtttctgcataatggacagcctgagagccgacgacgcggctctatattactgtgcgagatggacggcggtggctggtgcgtcggtgacttcttacgactactatcgcttcatcggacgtcgtcggggacgaaacgggaccacggtcaccgtctcctccgcctccaccgaacggccctagtccggtccttccccctggccacccctctaccaacgacgacacccgtcgaggggccacgacgccggtccgtcgggctcgtcctcggtaccgaacggtaccttaccgttaccattctaaccactaactggacgccgggactcggacgagggacgacaagtacgctannctagntacgnannnnnnnnnnn

SEQ ID NO: 58224 - DNA, 796 bp, Homo sapiens
  misc_feature: GYAE6OF02JZFYK.37.33.C11.1.454.CMB.1.raw
  modified_base (150)..(150): a, c, t, g, unknown or other
  misc_feature (150)..(150): n is a, c, g, or t
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacntccagatcgacccagtcctcccttccaccctgtctcgctatctgtacggagacagacgtccaacctatcctacttcggcccgggacctaggtccggaacttacgttaacggttccgttggttcggtccttgggtacttaccgaactaacgaaaaccgaacgggaaacgtaccccgtaaacggtcctagtactcgtatgactcgtacctaccgtaacgtttagggaaacggtcccggggtaccctacgttacgtaaacggtttccgaacggtccgggtactacggttacgttaacggtacggttacgggtaacccgtaagttacgttaaccgtaccgttaccttaacccgtaaccctaccggttaactacgggttaaccgtcccggttacgaaccgtcgtacccgttagtacgtttaacgttagttttacggtacttaacctttaacgttcttacgtacctaacgttccgtaaacgttagttaaggtacgggttaacgtacgttaacgggcccggggttaaaccgtaacgggtaacggttacgtaaacggtacgtaccggtaaagtaccggtcggttacggaccttaaccgacccgtacttacgttcttaccggtttactaaccggtttccgtacccgtttaccccg

SEQ ID NO: 58225 - DNA, 844 bp, Homo sapiens
  misc_feature: GYAE6OF02I84DI.37.33.C11.1.454.CMB.1.raw
tcagtagtgtagatcacgaccggtgctcgattttagagtgagctcgttggggttttgggggtcagactcagtcaggacacagcatggacatgagggtccccgctcagtctcctgggctcctgctgactcgtggctccgaggacgccaaagtggtcgacgatacgagatcgaccagtcctccgttccaccctgtctagctctcgtgtagacgacacgactcaccgtatactacgttcggccgggcctacggtcggacgttacgttacgtaccgttgggttcggccttaggtactacgaaacgaacgaaaaccggaagggaaacccgtacccgtaacgggttacctaggtaacttcgttaagtcgtaacgttccggtccctttacccgttaaacgttttaacggggtaaaacgggtcccgggggttaaccccttaacgttaaccggttaaaacggttccggacggttacccggacgtaaggttaggttaacgttcggtacggaacgtaacggtaaccttacgtaccttaccgtactaaccctagtcgtaacgccgtaacgtccgacgtcgtaccgtacggtacgtttgtttactttaccggtaacctttaaggtttttaaccttacccggtttaagtccccgttaaagttcccttaaaacgtttaaaggttaagggtcgggttaacggttaaccggttaccggggggaaccgttacgggggtaaccgttaggggttacgaacgttaacgaaccgttaaccggtaacggttggttacggtaccgttacgaaccgtaacgttacggttacctttcgttaccctttagttaccccgttacgttaccccg

SEQ ID NO: 58226 - DNA, 439 bp, Homo sapiens
  misc_feature: GYAE6OF02F9U9U.37.33.C11.1.454.CMB.1.raw
  modified_base (342)..(342): a, c, t, g, unknown or other
  misc_feature (342)..(342): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (431)..(439): a, c, t, g, unknown or other
  misc_feature (431)..(439): n is a, c, g, or t
tcagtagtgtagatcacgaccggtgctcgatttagagtgagctcgttgggtccgccaggctccagggaaggggctggagtgggtggccaacataaaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacgttggggccacgggaaccctggtcaccgtctcctcacgcctccaccgaacgggcccatccggtcttccccccgtggcccgccctgcctcccgaggacncaccctccggagacgccacagccggccgtgggctgccgtggtcaaggtctactcactctacactagtgagcggntcggacaggcnatgnnnnnnnnn

SEQ ID NO: 58227 - DNA, 926 bp, Homo sapiens
  misc_feature: GYAE6OF02HIWV6.37.33.C11.1.454.CMB.1.raw
  modified_base (421)..(421): a, c, t, g, unknown or other
  misc_feature (421)..(421): n is a, c, g, or t
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagcgttgggttttcctgttgcttattttagaaggtgtcagtgtgagtgcagctggtggactcgtgggggacgccgtggtccaggccggttcggggggtcccctggacgtaccttcgtccgttgtcgacctaaccttcgtaggtacttccgtaggtttcggtacgttgtaagtttggttggaggtttggggttacgggtcccgaccgtagggtcctaaccgggaagggggaacggggtccgtagggaacgggttcggggtacgaaccgtaaaanaaggtaaacggcgtaaaggagtagggaaaggccggaaagaaacttaacgttaagtcggttacgaaccttcggttaggtacggggaaggggtcccgttacgttaccgaccgtacgttaacccgtacccgaaacgaacggtaaacccaaacccggtaaccgaaaaacgttaaacgttaacctttaaacgttttaccgttttttaccggaaacttaaaacgttaacggtaaaaccgtttaacgggtttaaccgttaacgggtaaacggttaacgggttaacccgggtaaaacgggtaaccccgggtaacccgggttaaacccgttaacgtttaaccggtttaacgttttaaccggttaaccggggttaaacggttaaaccgggtaaaaccggtaaaccggttaaccgggtaccggggtttaaccccggggggtaacccgggttaaaacccggggttaacccccgggttttacccgggttacccccggttacccccggtttacccccgg

SEQ ID NO: 58228 - DNA, 749 bp, Homo sapiens
  misc_feature: GYAE6OF02JRBUF.37.33.C11.1.454.CMB.1.raw
  modified_base (349)..(349): a, c, t, g, unknown or other
  misc_feature (349)..(349): n is a, c, g, or t
  modified_base (574)..(574): a, c, t, g, unknown or other
  misc_feature (574)..(574): n is a, c, g, or t
  modified_base (658)..(658): a, c, t, g, unknown or other
  misc_feature (658)..(658): n is a, c, g, or t
  modified_base (688)..(688): a, c, t, g, unknown or other
  misc_feature (688)..(688): n is a, c, g, or t
  modified_base (745)..(745): a, c, t, g, unknown or other
  misc_feature (745)..(745): n is a, c, g, or t
tcagtagtgtagatcacgaccggtgctcgatttagagtgagctcgttgggtttgggggtcagactcagtcaggacacagcatggacatgacgggtccccgctcagctccgtggggctcctgctgctctggcctcccaggacgaccaaattgtgacatccaagatcgacccagtctccttccaccctgtctgctatcgtaggtaggagacaggtactccaactctcctacgttccggcccgggactacggtccggtacttaacgttcgtacccgttgggttcggcttacggtactacgaaaccgaagaaaccgtaacgggaacctacccgtacgtacctgtaactctagntcgtacgcctccgtacgttaggaacggtccggtacacggtaccgtaacggtgaacggtccggtatacggttacgtaagtcggtacggtaagtaacgttaactcgtaaccctacgtaccaacctagtaccgtacggtacgtcccgtagtcccgtaaacgtacggttacgtaaagtttccggtttaactttaccgaaacctttacgtttacttaacggtaccgttanacccgtaccttaagttaaagttaaccgggttacggaccgtttacgggtaccgggacgggttaaacccggtagaacggggttaanacgttacggaaaccttacgggtaacggttnacgttacgtaacccggtacaacgtttcgtactacgtccgttaacctcccgtttaccncccg

SEQ ID NO: 58229 - DNA, 551 bp, Homo sapiens
  misc_feature: GYAE6OF02F2VIJ.37.33.C11.1.454.CMB.1.raw
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (470)..(471): a, c, t, g, unknown or other
  misc_feature (470)..(471): n is a, c, g, or t
  modified_base (473)..(474): a, c, t, g, unknown or other
  misc_feature (473)..(474): n is a, c, g, or t
  modified_base (477)..(477): a, c, t, g, unknown or other
  misc_feature (477)..(477): n is a, c, g, or t
  modified_base (480)..(482): a, c, t, g, unknown or other
  misc_feature (480)..(482): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
tcagtagtgtagatcacgaccggtgctcgatttagagtgagctcgttgggtccgccaggctccagggaaggggctggagtgggtggccaacataaagcgagatggaagcgagaaatactatgtggactctgtgaggggccgattcaccatctccacagacaacgccaagaaatcaatcttttgctaaatgaacagtctgagagtcgagacacggccatgtattactgtacgagagaacagacgttggggccaggaaccctggtcaccgtctcctcacgcctaccaccaacgggccccacgttccggttccttcccccccgtggccgcccgtgccttccgaggcgccacccgtaccgagacgcgacacggccggcccgtgggcctgtccgtcggtcgaaacggtacctacttccagtcctaacactactgacgtcgggctcggacgaacgggcgtcgaagtacgngangcnncnngtnacnnngcgngacagcancgangatcgagtagtcgctacgtcgagcttacgcgtaccgacgtactcgagtaccgg

SEQ ID NO: 58230 - DNA, 727 bp, Homo sapiens
  misc_feature: GYAE6OF02GQ89L.37.33.C11.1.454.CMB.1.raw
  modified_base (99)..(99): a, c, t, g, unknown or other
  misc_feature (99)..(99): n is a, c, g, or t
  modified_base (192)..(192): a, c, t, g, unknown or other
  misc_feature (192)..(192): n is a, c, g, or t
tcagtagtgtagatcacgaccggtgctcgatttagagtgagctcgttgggtttgggggtcagactcagtcaggacacagcatggacatgagggtcccgntcagctcctggggctcctgctgctctggctcccagggagccaagtggtcggacagtccaaggactcgaaccgtagtctccttccacctgtctncatctggtaggagacaagtcgtccaacctatccacgttcggcccggggtaccacggtcggtacttagttacgtaccgttgggttcggtccttggttactacgaacgaacgaaaaccgaagggaaaccgccccgtaagggtcctagtatacgtagtagactcgtccttacctagtttaggaacggtccgggtaccctagtcgtaaacggtcgaggccggtaccgtagttcgtaacgtggtacgggtaccaagtaactttaccaaccttcacaacctacgtacgacgttaccgtcgacgtacgtaccgtacgtagttgtaaccgttaggtttactacctttaaacgtttacgtttacgttcgtaacgtacgtaccttaacggttaatacggtttacgggacgttacggtaaccgggtcccgggtaagggttacccggagggttaaccgatacgtacgtaaggtaccgggtagtaccggtgcgttaccgtagttacgtacggtttcctacggtttccctaaccgtttcccgttacccc

SEQ ID NO: 58231 - DNA, 658 bp, Homo sapiens
  misc_feature: GYAE6OF02HLTMC.37.33.C11.1.454.CMB.1.raw
  modified_base (186)..(186): a, c, t, g, unknown or other
  misc_feature (186)..(186): n is a, c, g, or t
  modified_base (312)..(312): a, c, t, g, unknown or other
  misc_feature (312)..(312): n is a, c, g, or t
tcagtagtgtagatcacgaccggtgctcgatttagagtgagctcgttgggtttgggggtcagactcagtcaggacacagcatggacatgagggtccccgctcagctccgtggggctcctgctgctctggctcccgaggacgccaaatgtgacatccagatgacctagtcctccttccaccctgtcngcatcgtgtaggagacagacgtcaaccatcctacttcggccggccacggtcgtacttattacgtaccgtggttcgccttggtactacaacgaacgaaaccgaagggaaccgaccccgtaaggtccnggactcgtatgagtcgcccttcgtaacggtttacggaacggtccgggacctagtaccgtaaggttccgaaggtccggacgtagttcgtagtccggtagggaaactaacgacgttaccaacgttaccctacaaccgagttccaagttacgacgtcgacgacgtcgtagttagtattagtttacgtacttaatttacgttacgtcgtacacgtaccaattagtaacgtagggtaacgtacggtccggacggtacgggtaccgtaagggttcgtagaacctaacggaacgtacggtggtaaggcctacgacgtacgtcttacgtgttaccgtacttaccgtcccgtacg

SEQ ID NO: 58232 - DNA, 844 bp, Homo sapiens
  misc_feature: GYAE6OF02G2CDX.37.33.C11.1.454.CMB.1.raw
tcagtagtgtagatcacgaccggtgctcgatttagagtgagctcgttgggtttggaggtctcagagaagagccttagccctggactccaaggcctttccacttggtgatcagcactgagcacagaggactcaccatggaattgggctgagcgttggtttctgtgctatttggaggtgtccagtgtgaagtgcagcgtggtggactcggtgggggaggtcctggtccgaggtccgtacggggggtccctggagacctctcctgtcgcctaacctcgtggtacttctagtttcgtagtcgtagtttggttcggagttcggggttacgggtccggaccgtagggtccgttacccggaagggggtaacgggggtccgttaggggaggggttcggggttcggaccctaaaacggtaagttaaaacgggccgtaaaggtacgttaggggtaaacgcggtaaagtaaaacttaccgtaggttacgggtacggtaaccgttcggtaggggttaccgggtaacgggggtacccgttaacgttacccgtaaccgtaacgtttccccgtaacccgtaaccgtaaaccggtaaacccgaaaacccgtaacccggaaaaacggttaaaaccgttaaccgttaaaccgttttaccgtttttaaccgaacgtttaaaaccggtaaccggtaaaccgttaacggttaaccggtacggtaaggtaaccgggttacgggaaccggtaaccggtaaccggtaccgtaagttacggttactacggtacgtaacggtaagaacggtaacgtacggtacggtacgggaccgtaacgggttaccggtcggtaccgtaccgttacccg

SEQ ID NO: 58233 - DNA, 660 bp, Homo sapiens
  misc_feature: GYAE6OF02HP7GJ.37.33.C11.1.454.CMB.1.raw
  modified_base (197)..(197): a, c, t, g, unknown or other
  misc_feature (197)..(197): n is a, c, g, or t
tcagtagtgtagatcacgaccggtgctcgatttagagtgagctcgttgggtttgggggtcagactcagtcaggacacagcatggacatgagggtccccgctcagctcctggggcctcctgctgctctggctcccaggagccaaatgtgacatccagatgacccagtcctccttccaccctgtctgcatctgtagganacagatcacatcacttcggccgggccagtcggactattacgtacctggttggcctggtatacaacaagaaaccagggaaacacccctaaggtcctagatctatgactcgcccttccaacgtttgggaaacggtccggggtcccaattaccgaagggtttacaggccggactacggttagttacgtacgtgggaactaaggtaactttccacttacgtaccaacgtatacgtaacgtcgccctgacctacgtccgtagtacgttgtattttcgaccttaacgtttactttacgtacttacgacgtacctaattagtaacgttagggacgtacgttaccgggacgtaaccgggtacggtagggtacgaacgtaacggtaaccgaaacggtaggttcggtacgggtcttacgacccgtaactacgttaccgttgtttacccttacgtacccgttcccgttaccccg

SEQ ID NO: 58234 - DNA, 783 bp, Homo sapiens
  misc_feature: GYAE6OF02GVE98.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctcctggggctcctgctgctctggctcccaggacgccaaatgtgacatccagatgaccagtctctcaccctgtctgctatctgtaggagacaggatcaacctatcacttgccggcagtcgactagttagacctggttcgccgtgtatacaacagaaaccagggaacacccctaagtcctagaactctagtgatcgccctacgtacgtttaggaaacgtcgggtaccctaagtaccgtaaagggttccaaggcggacgtaggtaggtactactaggactaaccgtaaggttaactttccaaccgtttacctaccaaccctaattaccgaacggtaccaacggtccgtaggtaccgaacggtaccgtaaaggttaaagttaaacgtttttccggaaaccgtttaaaccgttttaaactttaaccgttaaacggtttaaccctaaaaccggtaaacgtttaaacctttaaaccttaaaccggtttaacccctttacgggtttaaacccggttacccgggtaaaaccgtaaaccgggggttaaaacccgtaaaggggtttaacggaaaccggtttaaccgtaaaaacggtaaccgttacgggttaccggaacggttaccaaccgtaaacccgtagtttcccgtaacggttaccttttaacggtaccttcccgttaacccccgg

SEQ ID NO: 58235 - DNA, 593 bp, Homo sapiens
  misc_feature: GYAE6OF02HVVGE.37.33.C11.1.454.CMB.1.raw
  modified_base (208)..(208): a, c, t, g, unknown or other
  misc_feature (208)..(208): n is a, c, g, or t
  modified_base (399)..(399): a, c, t, g, unknown or other
  misc_feature (399)..(399): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (549)..(549): a, c, t, g, unknown or other
  misc_feature (549)..(549): n is a, c, g, or t
  modified_base (580)..(584): a, c, t, g, unknown or other
  misc_feature (580)..(584): n is a, c, g, or t
  modified_base (586)..(593): a, c, t, g, unknown or other
  misc_feature (586)..(593): n is a, c, g, or t
tcagtagtgtagatcacgaccggtgctcgatttagagtgagctcgttggggtttggggggggtccctgagactctcctgtgcaacctctggattcagttgtagtgattgttggatggggttgggtccgccaggctccaggggaagggggctggaggtgggtggccaacaataaagcgagatggaagcgaagaaatactatgtggactntgtggacgggcgattcacatctccacagacaacgaccaaagaaatacaatttctttttacgactaaatagaactagttacgtagagaggtacgaaggaaccgacggaccattaggttaactttacgtagtaacgaggaagaacaaggtacgttggggaccgacgggaaccctggtccaccgtctcctgacnccctaccaaccgaacggccctaacgtccggttcccttccccgnggccctcccgtcncctccgaaggcaccctaccgtcggaacgcgacacgacggccggccgtcgggctcgccgtagacgaacgtcttactcacttacaacctactacgngcggcgggcgtacggacgacggcgacagagnnnnnannnnnnnn

SEQ ID NO: 58236 - DNA, 826 bp, Homo sapiens
  misc_feature: GYAE6OF02GTLFE.37.33.C11.1.454.CMB.1.raw
tcagtagtgtagatcacgaccggtgctcgatttagagtgagctcgttggggtttgggggtcagactcagtcaggacacagcatggacatgagggtccccgctcagctcctggggctcctgctgctctggctccgaggagccaaatgtgacatccaagactacgacccagtccttcccttcccaccctgtctgctatcgtagtaggagacagagtaccacctatcacttcggccggaccaggtcggaacttagttacgtaccgtggttacggccgttaggtactacaaacgaacgaaaaccgtaaggggtaaacccgtaccccttaaagggtccctaaggtaactacgttagttacgtagtccgtaccccttaccgtaacggttttaacgggaaaccgggttacccggggttaccctaaacgtacggttaaacggggttaccacgggaccggtaaccgtaaggttacggttaagttcccgggtaagggtaaccgtaaaacggttaacttaccctaacggttaccctaaccgtaacctaacgtacgtaacggtaccgtcccgaggtaccgacgtccgtagtaacgttagtttacgtttaacgaccgtttaaacttacttagttactaccggtaactactaacgttaaacgtaaggttacgggtacgttacggacccggggtaccgggtaacggttaacgggtaacggttacgaaaggttaaccctaacgtaaaacggtacggtaacggttaacggtaccgtaccgtacgtaacctacggttttacggttaccttaccggtttaacccttaccgttaccccggtacccg

SEQ ID NO: 58237 - DNA, 468 bp, Homo sapiens
  misc_feature: GYAE6OF02I6TKL.37.33.C11.1.454.CMB.1.raw
  modified_base (448)..(468): a, c, t, g, unknown or other
  misc_feature (448)..(468): n is a, c, g, or t
tcagtagtgtagatcacgaccggtgctcgatttagagtgagctcgttgggtttgggggaagaggaagactgacggtccgccaggctccagggaagggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccaggggaaccctggtcaccgtctcctcagcctccaaccaagggccccatccggtccttccccctggccgcccctgctccaggacgcaccctccagagcacagcgcctgggctcgcctggtacaaggacctactccatctacactactgagcgggctggcaaggcgacagtacgnnnnnnnnnnnnnnnnnnnnn

SEQ ID NO: 58238 - DNA, 547 bp, Homo sapiens
  misc_feature: GYAE6OF02JCLYO.37.33.C11.1.454.CMB.1.raw
  modified_base (390)..(390): a, c, t, g, unknown or other
  misc_feature (390)..(390): n is a, c, g, or t
  modified_base (503)..(503): a, c, t, g, unknown or other
  misc_feature (503)..(503): n is a, c, g, or t
  modified_base (510)..(513): a, c, t, g, unknown or other
  misc_feature (510)..(513): n is a, c, g, or t
  modified_base (515)..(547): a, c, t, g, unknown or other
  misc_feature (515)..(547): n is a, c, g, or t
tcagtagtgtagatcacgaccggtgctcgatttagagtgagctcgttgggtcccgccaggctccagggaaggggctggagtgggtggccaacataaagcgagatggaagcgagaaatactatgtggactctgtggaggggccgattcaccatctccacagacaacgccaaagaaatcaatctttttgcaaatcgaaacagtctgagacgtacggaagacacggccatgtacttactagtaacgagagaactagaacgttggggaccagggaaccctggtcaaccgtcctaccgtgtaactcccgaccaaccgaaacgggaccccgaattcccgggtaccctttcccccgcgggccgtcccctcgtccgccaaacggtcgaccgtaccccncccgaaaggacaccgacgaacggtccgacccggtgggcccagtccgtcggtacaaacggttccaacgtccataccgtacacgtacgtgaaggcgtacgcgagacgtcacgtanagtcatnnnncnnnnnnnnnnnnnnnnnnnnnnnnnnnnnnnnn

SEQ ID NO: 58239 - DNA, 520 bp, Homo sapiens
  misc_feature: GYAE6OF02IJGOH.37.33.C11.1.454.CMB.1.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (413)..(414): a, c, t, g, unknown or other
  misc_feature (413)..(414): n is a, c, g, or t
  modified_base (490)..(491): a, c, t, g, unknown or other
  misc_feature (490)..(491): n is a, c, g, or t
  modified_base (493)..(504): a, c, t, g, unknown or other
  misc_feature (493)..(504): n is a, c, g, or t
  modified_base (506)..(507): a, c, t, g, unknown or other
  misc_feature (506)..(507): n is a, c, g, or t
  modified_base (509)..(520): a, c, t, g, unknown or other
  misc_feature (509)..(520): n is a, c, g, or t
tcagtagtgtagatcacgaccggtgctcgatttagagtgagctcgttggggtttggggggaagaggaagactgacggtccgcaggctccaggggaaggggctggagtgggtggccaacataaagcgagatggaagcgagaaatactatgtggactctggtgaggggccgattcaccatctccacagacacgaccaaagaatcaattctttttgacaatgaaacngtctagagtagtcggaggacacggactagtgttattacgtgtaacgagagaacngaacggtcggggaccgagggtaacccgtggccaccggttcacctcncgccctcgacgaccggccactccgtcctccccgtgccncctacgtccgccagggacncaccgtacgatacnccagccggcgccgnggcnncgtcgacgacgtactcgttcactacgtactactacgtgacggcggacggtcgacggacgtcgggactactggacanntnnnnnnnnnnnncnngnnnnnnnnnnnn

SEQ ID NO: 58240 - DNA, 772 bp, Homo sapiens
  misc_feature: GYAE6OF02FPEVY.37.33.C11.1.454.CMB.1.raw
  modified_base (100)..(100): a, c, t, g, unknown or other
  misc_feature (100)..(100): n is a, c, g, or t
tcagtagtgtagatcacgaccggtgctcgatttagagtgagctcgttgggtttgggggtcagactcagtcaggacacagcatggacatgagggtccccgntcagctcctgggctcctgctgctctgctcccaggacgacaatgtgacagtccagatgacccagtcctaccttccaccgtgtctgctatcgtagtaaggagacagtacgtccaaccattacgacgttcgacccgggctaggtccgacttaagttacgtaccgttggttacggtccgtaggttacgtacaacaacgtaaaccgacgggtaaccgacccgtaagttcctagtatactagtagatcgtaccctactaacggtttaggaaacggccgggtaaccctagtcgtaagttccgtagccggatagtacgtcgtacggtaggacaacgtacgttactaaccgtcttaccgaaacctagtacgacgtaaccgtccgtacgtaccgtacgtacgttacgtacgtttcggttacgttttacggaaacctttaacgtttaacgtaacgttacggttaccgaacctaccgttaaaccgttaagttacggttacggggtacgtttaaccgggtccgggtaacccgggtacgggggttaaacctacgggggttactaacgtaacggttaacgtaaaccgtaacgggttccgttaacggtaccgtaccgaaccgtaacgtttacccggtacttttaccggtttaccgtttcccttaacggttcccccgtttaaaccccgg

SEQ ID NO: 58241 - DNA, 529 bp, Homo sapiens
  misc_feature: GYAE6OF02I1PCL.37.33.C11.1.454.CMB.1.raw
  modified_base (109)..(109): a, c, t, g, unknown or other
  misc_feature (109)..(109): n is a, c, g, or t
  modified_base (244)..(244): a, c, t, g, unknown or other
  misc_feature (244)..(244): n is a, c, g, or t
  modified_base (422)..(422): a, c, t, g, unknown or other
  misc_feature (422)..(422): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (477)..(480): a, c, t, g, unknown or other
  misc_feature (477)..(480): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
  modified_base (489)..(494): a, c, t, g, unknown or other
  misc_feature (489)..(494): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(528): a, c, t, g, unknown or other
  misc_feature (527)..(528): n is a, c, g, or t
tcagtagtgtagatcacgaccggtgctcgatttagagtgagctcgttggggtccgccaggctccagggaaggggctggagtgggtggccaacataaagcgagatggaancgagaaatactatgtggactctgtggaggggccattcaccatctccacagacaacgccaaagaaatcaattctttttgacaaatgaacagtctgaggagtacgaggacgacggccatgtattacgtgtacgaganaacagacgttcggggccacgggaccctggtccaccgttctacctccacgcctccaccgacggccacgtcggtccttccccgtggccgccgtgcctcgaggcgacctccgaccgagacacacgacgccggtccgtcggcgtcgtccgtaggtacgaacggtactactaccatacctacnctaacgcgacgcggcgacggtcgaggcgagacgtgagctacgnagatcnacncgnnnngngngangnnnnnntagcgngacncgtctacgacgacacgnanancnnc

SEQ ID NO: 58242 - DNA, 703 bp, Homo sapiens
  misc_feature: GYAE6OF02IO9O5.37.33.C11.1.454.CMB.1.raw
  modified_base (99)..(99): a, c, t, g, unknown or other
  misc_feature (99)..(99): n is a, c, g, or t
  modified_base (230)..(230): a, c, t, g, unknown or other
  misc_feature (230)..(230): n is a, c, g, or t
  modified_base (398)..(398): a, c, t, g, unknown or other
  misc_feature (398)..(398): n is a, c, g, or t
  modified_base (448)..(448): a, c, t, g, unknown or other
  misc_feature (448)..(448): n is a, c, g, or t
  modified_base (497)..(497): a, c, t, g, unknown or other
  misc_feature (497)..(497): n is a, c, g, or t
  modified_base (626)..(626): a, c, t, g, unknown or other
  misc_feature (626)..(626): n is a, c, g, or t
tcagtagtgtagatcacgaccggtgctcgatttagagtgagctcgttgggtttgggggtcagactcagtcaggacacagcatggacatgaggtccccgntcagctccgtggggctccgtgcctgcctcgtcggcctcccgaggagaccaaagtgtgacactccgagactcgaccctagtccttcctaccctacccttgacctgcctactcgtagaaggacgtacaggtanaccactactccgacgttccggccgggacctaggtaccgtaacttattacggtaccgttggttccggacgttagtactacaacgtaacgaaccgaacggaacgtacccgtaagcctagtatcgtatgtactccgtccctaactacggtacggtaaccggtccggtaccngtacgtacgggttcacgtcgtacgttagtacgttacgcgtaggaacttanaaccgttctacgaccttacaacctagtcgacgtacgtccgtacgtaccncgtacgtagttacgtagttacttcgtaacgttaacttaccgttagttaccgtacgtaacgtaactaacgttagttaacgtacgggtaacgttacggtaacgggaccggttacggaccggtaacggttanaacgtacgtacgtaacgtcgacggtccgtagaccgttacaccgtacttacggtccttacggtctaccgtcctacccg

SEQ ID NO: 58243 - DNA, 840 bp, Homo sapiens
  misc_feature: GYAE6OF02FWJV1.37.33.C11.1.454.CMB.1.raw
  modified_base (77)..(77): a, c, t, g, unknown or other
  misc_feature (77)..(77): n is a, c, g, or t
tcagtagtgtagatcacgaccggtgctcgatttagagtgagctcgttgggtttgggggtcagactcagtcaggacanagcatggacatgagggtccccgctcagctcctggggcttcctgctgctctggctcccaggacgccaaatgtgacatccagatgacccagtcctccttccaccctgtcctgcattcgtaggtacggagaccaggtacgtaccaacccgtataccgtaccgttcgggaccccggggtaccaagggttacccgggtaactttaagttttaaccggttacccgttaggggtttacgggccgttacggggttataccaaacgaacggtaaaaaccccgaagggggtaaaaccggtacccccgttaaacgggttccccgtacggtaacttacgtaacgttggtaacttccggaccccttaccctaaccggttttacggggaaaacgggtcccggggtacccgtacgtaccggttaacggtttaccgacggttacgtacgtaggttacggttaattcggtacgggactaaggtaacttactaactcctaccaacctactacgtaacgtacgtccgtagaccgtacgtacccgtagtagtttacggttaattttacgaacctttaactttaacgtttacctaggttacctacgtactaacgttaagttaaaggtacgggtaacgtaacggttcgggaaccgggtaacggggtaccgtaaggggttacgtaacgtaacgtaaccgtaaacgtacggttcggtagggtacctccggtaacgtacccgtacgttaccgttagtttacccgtacttaccgttcccgttacccccg

SEQ ID NO: 58244 - DNA, 767 bp, Homo sapiens
  misc_feature: GYAE6OF02JDRGG.37.33.C11.1.454.CMB.1.raw
  modified_base (193)..(193): a, c, t, g, unknown or other
  misc_feature (193)..(193): n is a, c, g, or t
tcagtagtgtagatcacgaccggtgctcgatttagagtgagctcgttgggtttgggggtcagactcagtcaggacacagcatggacatgacgggtccccgctcagctccgtgggctcctgctgctctggctccaggagccaaatgtgacatccagatcgaccctagtcctcccttccacccttgtcctgactnttcgtggtaaggagacagacgtacaccgtatccgtacttcggcccgggcctaggtaccggtaacttagttacggtaccgttggggttcggtaccgttagggtactaaccgtaaacgaacggaaaaccggaacgggtaaacccgaccccgttaaacggtccgtagtacttacgtacgtgtactccgtaccctaccgtagtttaacggggaacggtccgggtacctacgttacgtaacggttacgacgggaccgcgtaggtcgttacgtcggtacggtaactaggtaccttacgtaacctctacgaccgtagtacgtataccgtcccgtgaccgtacgtacgtctagttacgtttacgtttagaaccttaacgtttacgttacttacgttaaccgcgttaaacttaacgttaacgttacggtaaggttacggttaccgtaccgggacgggttaacggtaacgggtaggttccgaaagttacccggtaagtaaaccggtacgttacgggtaccggtactacgggtaccctaacgttacgttcgtaccgttccttaccggttcccttcccggttaccc

SEQ ID NO: 58245 - DNA, 676 bp, Homo sapiens
  misc_feature: GYAE6OF02ID07U.37.33.C11.1.454.CMB.1.raw
  modified_base (102)..(102): a, c, t, g, unknown or other
  misc_feature (102)..(102): n is a, c, g, or t
  modified_base (632)..(632): a, c, t, g, unknown or other
  misc_feature (632)..(632): n is a, c, g, or t
  modified_base (646)..(646): a, c, t, g, unknown or other
  misc_feature (646)..(646): n is a, c, g, or t
  modified_base (653)..(653): a, c, t, g, unknown or other
  misc_feature (653)..(653): n is a, c, g, or t
tcagtagtgtagatcacgaccggtgctcgatttagagtgagctcggttgggtttgggggtcagactcagtcaggacacagcatggacatggagggtccccgntcagctccgtggggctcctgctgctcgtggcctcccagggacgaccaaatgtgacactccagatcgaccagttcctccttcccaccttgtctgcagtctacggtagagacagactcacatcacgttggccgggacaggtcggtaacttagttacgtccgtggttcgccgttggttacacgaactaacgaaaccgacgggtaaacctccccgtaaaggttcccagtacgttaactagttaggtaccttccgtaacccttccgtaacggtttagggaaaccgggtccggtaacctacggtacgtaacggttcgacggcgtacgtacgttgtcgtacggtaggaacgtagtactccgtactccgtacaccgattacgtaacgtcgcctacgaccgtacgtacctgttagtactttagttaccgtaactactttatacgttgaacctcgaattacgtagtaacggttaggccgttagaccgggaggaggttaccgggtagttagaacggttaacacctaagggttcgaaggtcnctagaccacggttntacggtnttaccgttactcctccgttaccc

SEQ ID NO: 58246 - DNA, 537 bp, Homo sapiens
  misc_feature: GYAE6OF02J0SQR.37.33.C11.1.454.CMB.1.raw
  modified_base (210)..(210): a, c, t, g, unknown or other
  misc_feature (210)..(210): n is a, c, g, or t
  modified_base (321)..(321): a, c, t, g, unknown or other
  misc_feature (321)..(321): n is a, c, g, or t
  modified_base (431)..(431): a, c, t, g, unknown or other
  misc_feature (431)..(431): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (510)..(510): a, c, t, g, unknown or other
  misc_feature (510)..(510): n is a, c, g, or t
  modified_base (512)..(537): a, c, t, g, unknown or other
  misc_feature (512)..(537): n is a, c, g, or t
tcagtagtgtagatcacgaccggtgctcgatttagagtgagctcgttgggtttgggggaagaggaagactgacggtccgccaggctccagggaaggggctggagtgggtggccaacataaagcgagatggaagcgagaaatatatgtgctctgtgagggccgtatcaccatctccacagacaacgccaaagaaatctaattcctttttanacaaattagaacagtctgacgagtccgaggacacggccatgtattacttgacgagacgtaacagacgttagggccgaacggaacccgtggtcacccggtcgtccacgtacnccctaccaccgacggtaccactccggttccctccccgttcgcccgtccgtacgacctacgcgaacgcctaccgccgacgacgccttacgacggccccggcgttcgggacncggtaccctggaccgacgacgtacttcaaacttcccatacctagnggaactcggtcacggganacccgagcacggttancnnnnnnnnnnnnnnnnnnnnnnnnnn

SEQ ID NO: 58247 - DNA, 704 bp, Homo sapiens
  misc_feature: GYAE6OF02FWSSV.37.33.C11.1.454.CMB.1.raw
  modified_base (245)..(245): a, c, t, g, unknown or other
  misc_feature (245)..(245): n is a, c, g, or t
tcagtagtgtagatcacgaccggtgctcgatttagagtgagctcgttgggtttgaggtctcagagaagagccttagccctggactccaaggcctttccacttggtgatcagcactgagcacagaggactcaccatggaattggggctgagcgttgggttttccttgttgcttattttagaaggtgtccagtgtgagtgcagctggtgactcgtgggggacgcctggtccagccggtcggggtccngagctctctgtgcacctcgtggtacttcagtttgtagtgtagttgttgggtagttggggttcgggtccgccgtacggtccgtacccggaagggggtaacgggggtccgtaggggtaagggttcgggggtacggacccgtaaaacgtaagtaaaacgggcggaaggtaggtaacggggaacgacggaaaagtaaaacttacgtagtagtacggtacttcggtggtacgggacgggtccgtagttaccacgtactcctaccaacacgaaccaaccgaaccgaaagtaactactatttacgtttaacaactaaagtacgtaacgtatacgtaggtaagacggtaacggacgacgaccgtactagttacgttacgttacgtacggtaacgaacgtaagtaacgtacgtacgggtacgggacccggtaaccgggtacccgtacggtacccgtaccggttacccg

SEQ ID NO: 58248 - DNA, 610 bp, Homo sapiens
  misc_feature: GYAE6OF02F78R4.37.33.C11.1.454.CMB.1.raw
tcagtagtgtagatcacgaccggtgctcgatttagagtgagctcgttgggtttgggggtcagactcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggcagtcggactattagtacctggttggcctggtatcaacagaaaccagggaagcccctaaggtcctagactctatgatcgcctccacgtttggaaacgtccggggtcccaatcgtaaggttcaggcggcagtgtatcgtggacagatcactctacacatcagtacgctgcacgcctgatgtactttagacttaacttattactgtctaagctaacttaagttaacgtagggtaagtacgtttccgggaccggtaaggggaacccgtaggggtttagaaggtaacgtacgaaaaccggtaacgttacgggtacggtaccgttacggtaacctaacccgtaacgtttccgttacggtttaccctttaccgtaccgtttccccgtttaccccccg

SEQ ID NO: 58249 - DNA, 652 bp, Homo sapiens
  misc_feature: GYAE6OF02GQDU0.37.33.C11.1.454.CMB.1.raw
  modified_base (100)..(100): a, c, t, g, unknown or other
  misc_feature (100)..(100): n is a, c, g, or t
  modified_base (457)..(457): a, c, t, g, unknown or other
  misc_feature (457)..(457): n is a, c, g, or t
  modified_base (564)..(564): a, c, t, g, unknown or other
  misc_feature (564)..(564): n is a, c, g, or t
  modified_base (600)..(600): a, c, t, g, unknown or other
  misc_feature (600)..(600): n is a, c, g, or t
tcagtagtgtagatcacgaccggtgctcgatttagagtgagctcgttgggtttgggggtcagactcagtcaggacacagcatggacatgagggtccccgntcagcctccgtggggcctcctgctgctctggctcccgaggagccaaagtgtgacatccagatcgacccagtcctccttccaccctgtctgctatcgtggtaggagacagagtccacctatccacgttcggcccgggccaggtacggacttagttacgtaccgttggtcggcctggtactacaacaagaaaccgagggaacctacccgtaagtccgtagatactagcgtatccgtccttctacgttagggaacggtccgggtaccagtacgtaaggttcgaggcgtacgtagttgtagtacggtagggaactagttaacttcgaactccgtaccacctagtacgacgtacgtccagcncgtccgtagtagttcgttatttacgactttaacgtttagttacgtcgtacacgtactaaggttatacggtgggtaactcggtacggaccggtaggtacgtagggtanaaccgtgtaaccgaaggttcgtggttaccggcgtanacccgttactgtttaccgttcttaaccgttccttacccgttcccgttacccg

SEQ ID NO: 58250 - DNA, 970 bp, Homo sapiens
  misc_feature: GYAE6OF02GSK31.37.33.C11.1.454.CMB.1.raw
tcagtagtgtagatcacgaccggtgctcgatttagagtgagctcgttgggtttgaggtctcagagaagagccttagccctggactccaaggcctttccacttggtgatcgagcactgagcacagagactcaccagtggaagttgggctggagtcgttgggttttccttgttgcttagttttagaggtcgtcagtgtagtaagtgcagtctgggtggtactcggtgggggacgtccgtcggtaccgaggtccggtacgggggtccctggacggtaccttccgtccgtggtccgtaacctaaccgttcggttacggtaacttccgtaaggttttcggtaaggttagttaacggtttgggtttacggggtaagtttcgggggggttttacccgggtacccggtaccggtacgggttaccccgtacggggtaacggggggtaaacggggttccggttaaggggttaaccgggggtttcggggggttaacccggaacccccgtaaagtaaccggttaaccgggtaaggggggtaacgggtttacgggtaaccggggttaaaaaccggttaaacgtacggtttagggtacggtacgttacggtacgggtaccgggtaccgggggacccttaacgtttacccgaaccgttacgtaccccgtaccggtaaacggaaacccgtaacggtaaaaccccgtaaaccgtaaaaacgttcccgttaacggtaaccgtttaacgtaccgttacggtaaacgtaagggttaacccgggacgttaccggtaaacgggtacggtaaaccggttacccggaaacgggaacccgtttacgggtacgttaacggtttacgtttacgtttaaccggtttagggacgttaaccgggttaagtaacgggttttaaggttaacccggtaaactttaaacgggttaaccttacgggtaacgtttacggaacgggtttacggtagtacgtttacgg

SEQ ID NO: 58251 - DNA, 750 bp, Homo sapiens
  misc_feature: GYAE6OF02G9HD8.37.33.C11.1.454.CMB.1.raw
  modified_base (100)..(100): a, c, t, g, unknown or other
  misc_feature (100)..(100): n is a, c, g, or t
  modified_base (386)..(386): a, c, t, g, unknown or other
  misc_feature (386)..(386): n is a, c, g, or t
tcagtagtgtagatcacgaccggtgctcgatttagagtgagctcgttgggtttgggggtcagactcagtcaggacacagcatggacatgagggtccccgntcagctcctgggctcctgctgctctggctcccaggacgccaaatgtgactatccagatcgacccagtctcctccacctgtctagcatctgtaggagtacagagtcactagtcacgttcgccggcctaagtcggtactagttacgtacgtggttcgcgtcgtatacaacgaacgaaacgaacgggaaccaccccgttaaggtcctagatccttagtcgacttccggacctaccgttaacgtttagggaaaccgggtccgggtaaccctagttaccgtaaggttccgnggtaccggtacgtagtaggttatccggtacggtaacgacgttaactcgtaccctactacgtaacctatacgacggtacgcccgttacgaccgttgacccgtttaggaacgtttacgttacgtttacgtaacgttaaacgttttacttacttcggaaccttaacgttaaccgtaagtacggtttaaacgggtacgttaacgggttaccgggttaacccgggacgtaaacggggttacgggtacggtttaaggaaaccgttaactaccggtaaaacggttcggtagggttaaccgcctaaccgggaccttaacggtaacctttcgttacccgtctttaaccgttccccggtttactaaccccccgg

SEQ ID NO: 58252 - DNA, 492 bp, Homo sapiens
  misc_feature: GYAE6OF02FK99H.37.33.C11.1.454.CMB.1.raw
  modified_base (245)..(245): a, c, t, g, unknown or other
  misc_feature (245)..(245): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
  modified_base (447)..(448): a, c, t, g, unknown or other
  misc_feature (447)..(448): n is a, c, g, or t
  modified_base (451)..(453): a, c, t, g, unknown or other
  misc_feature (451)..(453): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (470)..(484): a, c, t, g, unknown or other
  misc_feature (470)..(484): n is a, c, g, or t
  modified_base (486)..(492): a, c, t, g, unknown or other
  misc_feature (486)..(492): n is a, c, g, or t
tcagtagtgtagatcacgaccggtgctcgatttagagtgagctcgttgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacngacttggggccagggaaccctggtcaccgtctcctcacgcctccaaccaagggccccatccgggtcttccccccgtggccgccctgcctccgaggacgccacctcccgngacgcacgngccggtcccgtggggctgccgtgtacgaaggtactaccttccgatctaacnctaactggagcgggctggcgaggcgctatcganngannngtngntccngcatgacnnnnnnnnnnnnnnncnnnnnnn

SEQ ID NO: 58253 - DNA, 635 bp, Homo sapiens
  misc_feature: GYAE6OF02F9L3N.37.33.C11.1.454.CMB.1.raw
  modified_base (101)..(101): a, c, t, g, unknown or other
  misc_feature (101)..(101): n is a, c, g, or t
  modified_base (282)..(282): a, c, t, g, unknown or other
  misc_feature (282)..(282): n is a, c, g, or t
  modified_base (548)..(548): a, c, t, g, unknown or other
  misc_feature (548)..(548): n is a, c, g, or t
tcagtagtgtagatcacgaccggtgctcgatttagagtgagctcgttggggtttgggggtcagactcagtcaggacacagcatggacatgagggtccccgntcagctcctgggctcctgctgctctggctcccaggagccaaatgtgacatccagatgacccagtctccttccacctgtctgcatctgtaggacgacagagtccaccatcacttggcccgggccaggtcggacttattacgtacctggttcggcctggtatcaacacgaaaccgagggaacnccccgtaaggtcctagatctatgatcgcctcctacgtttaggaacggtccggggtacccagtacgtaaggttcaggtccggacgtaggtagttagtcgtaggggactaagtaacgttccaacttcctaccacctactcaacgtacgtccgtagccacgtccgtgtagttgttatttacgacttaactttattacgttacgtctaacgtacttactaagtaggtaggtacgtacggttccgggaccggtacgggtaacgtagggtanaacgtaacgtacgaacggtacgtgggtacgtacgtacgtacccgtacgtagttccgttacgttccttacgtaccttcccgttacccg

SEQ ID NO: 58254 - DNA, 154 bp, Homo sapiens
  misc_feature: GYAE6OF01BC24S.29.61.F06.1.454.CMB.1.raw
  modified_base (153)..(154): a, c, t, g, unknown or other
  misc_feature (153)..(154): n is a, c, g, or t
tcagatagagtactcacgaccggtgctcgatttagctacgctctaagggaaagggacacgactggagattaaacgaactgtggctgcaccatctgtcttcatcttcccaccctcctcatagcgtactctgagcgggctggcaaggcgcatagnn

SEQ ID NO: 58255 - DNA, 153 bp, Homo sapiens
  misc_feature: GYAE6OF02HK62X.29.61.F06.1.454.CMB.1.raw
  modified_base (153)..(153): a, c, t, g, unknown or other
  misc_feature (153)..(153): n is a, c, g, or t
tcagatagagtactcacgaccggtgctcgatttagctacgctctaagggaaagggacacgactggagattaaacgaactgtggctgcaccatctgtcttcatcttcccgccctcctcatagcgtactctgagcgggctggcaaggcgcatagn

SEQ ID NO: 58256 - DNA, 223 bp, Homo sapiens
  misc_feature: GYAE6OF01B3PKH.44.39.D06.1.454.CMB.1.raw
  modified_base (219)..(223): a, c, t, g, unknown or other
  misc_feature (219)..(223): n is a, c, g, or t
tcagacagtatatacacgaccggtgctcgatttagtgacatctcgcagttctttgggggaggaactgctcagttaggacccagacggaaccatggaagccccagcgcagcttctcttcctcctgctactctggctcccaggaactgtggctgcaccatctgtcttcatcttcccgccatctgatatatactgtctgagcgggctggcaaggcgcatagnnnnn

SEQ ID NO: 58257 - DNA, 538 bp, Homo sapiens
  misc_feature: GYAE6OF01COLRJ.44.39.D06.1.454.CMB.1.raw
  modified_base (463)..(463): a, c, t, g, unknown or other
  misc_feature (463)..(463): n is a, c, g, or t
tcagacagtatatacacgaccggtgctcgatttagtgacatctcgcagttctttgggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagctctatcatgtacgcagtggtccgggccgagccccaaagtcctcttttacgacgtcctttcgcgggcttcggcagtccctggccgtttttcggcctccagttctgaccacgcggcctccctgaccatcaccaaactccggccctgaggatgaggctgactacttttgtgtgcatatttcgattcactcaaatatgtcttcggaagtgggacccncgtcagcgtcctgcgtcagcccaaggcccaaaccccactcgtcactctgttccccacctcctctatactactgtc

SEQ ID NO: 58258 - DNA, 391 bp, Homo sapiens
  misc_feature: GYAE6OF01ELRUJ.44.39.D06.1.454.CMB.1.raw
  modified_base (385)..(391): a, c, t, g, unknown or other
  misc_feature (385)..(391): n is a, c, g, or t
tcagacagtatatacacgaccggtgctcgatttagtgacatctcgcagttctttgggatgatgataaacgttacagtccaagtccttctcttaaagacagactcgacatcaccaaggactccgacgagaaccaggttgtcctgacactgaccttcgtggacctcctggacacaggcacatatttctgtgcacacactcgtgtcttggggggctttgactactggggccagggaatcctggtccccgtctcgtcagcctcaccaagggcccatcggtcttcccctggcacctcctccaagagcacctctggggcacagcggccctgggctgcctggtcaaggactacttcctatatactgtctgagcggctggcaaggcgcatagnnnnnnn

SEQ ID NO: 58259 - DNA, 555 bp, Homo sapiens
  misc_feature: GYAE6OF01BKM7N.44.39.D06.1.454.CMB.1.raw
  modified_base (383)..(383): a, c, t, g, unknown or other
  misc_feature (383)..(383): n is a, c, g, or t
tcagacagtatatacacgaccggtgctcgatttagtgacatctcgcagttctttgggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactggaaccaacagtgacgtcggttcgtttgaccgtgtctcctggtaccagcacgaccccagaaaccacgacccccaaaactcaatttatttaatgcggtacaatgttcgcccttccggtctccctgacgcgcttctcgtggtccaagtctggcaacacgcctcccngaccatctctcggctccaggctgaggacgagctgattattactgcagctccgatggacgcacgtatgatttcgcgtttcggcgtacgggacctaagtcgtacgtacccgtccgtacgggttaccgacggaccccgtaaacggccctaccggccccccttgggtccctacccg

SEQ ID NO: 58260 - DNA, 401 bp, Homo sapiens
  misc_feature: GYAE6OF01CO7EN.44.39.D06.1.454.CMB.1.raw
  modified_base (248)..(248): a, c, t, g, unknown or other
  misc_feature (248)..(248): n is a, c, g, or t
  modified_base (394)..(401): a, c, t, g, unknown or other
  misc_feature (394)..(401): n is a, c, g, or t
tcagacagtatatacacgaccggtgctcgatttagtgacatctcgcagttctttgggatgatgataaacgttacagtccaagtccttctcttaaagacagactcgacatcaccaaggactccgacgagaaccaggttgtcctgacactgaccttcgtggacctcctggacacaggcacatatttctgtgcacacactcgtgtcttggggggctttgactactggggccagggaatcctggtccccgtntcgtcagcctccaccaagggcccatcggtcttcccctggccaccctcctccaagagcaccctcgtcggggcacagccggccctgggctgcctggtcaaggactactcctatatactgtctgagcgggctggcaagggcgcagtagnnnnnnnn

SEQ ID NO: 58261 - DNA, 318 bp, Homo sapiens
  misc_feature: GYAE6OF01BUF7K.44.39.D06.1.454.CMB.1.raw
  modified_base (313)..(318): a, c, t, g, unknown or other
  misc_feature (313)..(318): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgtcctgactcagcctgcctccgtgtctgggtcgcctggacagtcggtcaccatctcctgcactggagccagcggtcagcccaaaggccaacccactgtcactctcgttcccacctcctctatatactgtctgagcgggctggcaaggcgcatagnnnnnn

SEQ ID NO: 58262 - DNA, 531 bp, Homo sapiens
  misc_feature: GYAE6OF01CJ6E0.44.39.D06.1.454.CMB.1.raw
  modified_base (522)..(522): a, c, t, g, unknown or other
  misc_feature (522)..(522): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtctttatgtccccaatagtaagaactatttagcctggtaccaacagaaaccgggacagtctacctaaattactcttttatggcatctactcgggagtccggggtcctgaccgattcaggtggcggcgggtctgggacacatttcactctcaccatcagtagcctgcaggctagaagacgtggctagtttaattattgtacaactaattatttaagaactcctaatcactttcggcggtaggaccagagtagagatacgaaacgtactggtaggctgactaccattctgtccttntacttcccg

SEQ ID NO: 58263 - DNA, 543 bp, Homo sapiens
  misc_feature: GYAE6OF01AE5UN.44.39.D06.1.454.CMB.1.raw
  modified_base (236)..(236): a, c, t, g, unknown or other
  misc_feature (236)..(236): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttangtccccaatagtaagaactatttagcctggtaccaacagaaaccgggacagtctacctaaattactcttttattggctatctactcgggagtccggggtccctgaccgattcagtggcggcgggtctgggacacatttcactctcaccatcagtagcctgcacggctgaacgacgtggctagtttattatgtacaactaattattttaagaacttctaatcgtactttcggacggtaggaccaggacgtagatacgtacaaacgaacttggtaggtctacgcacctatctagtcttcgtacttcccg

SEQ ID NO: 58264 - DNA, 604 bp, Homo sapiens
  misc_feature: GYAE6OF01C1VKT.44.39.D06.1.454.CMB.1.raw
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcgggacatcgcgatgagccagtctccagacctccctggctgtgtctcgtgggcgagagggccaccgtcaactgcaactccagccaaagtcgtcttttatcgtacccaatagtaaagaactatttagccttggtaccaactagaaaccgggacagtctacctaaattactctttatggcatctactcgggagtccgggtcctgaccgattcagtggcggcggtctgggacacgatttcactctcactatcagtagcctgcgagctagaacgacgtggcctagtttattattcgtactaactaattattttaagaacttcctaattacgtacgtttacggacggtaacgggtaacccaggtaagtaacggaagaacgttaaccaaaacggtaaccgttaggttacggtccgttacggacctaaacccgtagttacccgttagttacccttacgtacgtttacccccg

SEQ ID NO: 58265 - DNA, 405 bp, Homo sapiens
  misc_feature: GYAE6OF01EIUAJ.44.39.D06.1.454.CMB.1.raw
  modified_base (397)..(405): a, c, t, g, unknown or other
  misc_feature (397)..(405): n is a, c, g, or t
tcagacagtatatacacgaccggtgctcgatttagtgacatctcgcagttctttgggatgatgataaacgttacagtccaagtccttctcttaaagacagactcgacatcaccaaggactccgacgagaaccaggttgtcctgacactgaccttcgtggacctcctggacacaggcacatatttctgtgcacacactcgtgtcgttggggggctttgactactggggccagggaatcctggtccccgtctcgtcagcctccaccaagggcccatcggtccttccccctggccaccctcctccaagagcacctctcgggggcacacgccggccctgggctgcctggtcaacggactacttcctatatactgtctgagcgggctggcaaggcgcatagnnnnnnnnn

SEQ ID NO: 58266 - DNA, 393 bp, Homo sapiens
  misc_feature: GYAE6OF01CR508.44.39.D06.1.454.CMB.1.raw
  modified_base (386)..(393): a, c, t, g, unknown or other
  misc_feature (386)..(393): n is a, c, g, or t
tcagacagtatatacacgaccggtgctcgatttagtgacatctcgcagttctttgggatgatgataaacgttacagtccaagtccttctcttaaagacagactcgacatcaccaaggactccgacgagaaccaggttgtcctgacactgaccttcgtggacctcctggacacaggcacatatttctgtgcacacactcgtgtcttggggggctttgactactggggccagggaatcctggtccccgtctcgtcagcctccaccaagggcccatcggtcttcccctggcacctcctccaagagcacctctggggcacagcggccctgggctgcctggtcaaggctacttcctatatactgtctgagcgggctggcaaggcgcatagnnnnnnnn

SEQ ID NO: 58267 - DNA, 538 bp, Homo sapiens
  misc_feature: GYAE6OF01CDFJM.44.39.D06.1.454.CMB.1.raw
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
  modified_base (499)..(499): a, c, t, g, unknown or other
  misc_feature (499)..(499): n is a, c, g, or t
  modified_base (520)..(520): a, c, t, g, unknown or other
  misc_feature (520)..(520): n is a, c, g, or t
tcagacagtatatacacgaccggtgctcgatttagtgacatctcgcagttctttggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagctctatcatggtacgcagtggtcccgggccgagcccccaaagtcctctttacgacgtcctttcgcggcttcggcagtccctggccgtttttcggcctccagttctcgaccacgcggcctccctgaccatcaccaactccggcctgagatgagctgactacttttgtgtgcatatttcgattcactcaatntgtcttcggagtggacccgngtcagtcgtcctgcgtcacgcccaaggcccaaccccncgtcgtcactctcgttccccncctcctctatctctgtcg

SEQ ID NO: 58268 - DNA, 400 bp, Homo sapiens
  misc_feature: GYAE6OF01EI7YZ.44.39.D06.1.454.CMB.1.raw
  modified_base (388)..(400): a, c, t, g, unknown or other
  misc_feature (388)..(400): n is a, c, g, or t
tcagacagtatatacacgaccggtgctcgatttagtgacatctcgcagttctttgggatgatgataaacgttacagtccaagtccttctcttaaagacagactcgacatcaccaaggactccgacgagaaccaggttgtcctgacactgaccttcgtggacctcctggacacaggcacatatttctgtgcacacactcgtgtcttggggggctttgactactggggccagggaatcctggtccccgtctcgtcagcctccaccaaggcccatcggtcttcccctggcaccctctccaagagcacctctgggggcacgagcggccctgggctgcctggtcaaggctacttctatatactgtctgagcgggctggcaaggcgacatagcnnnnnnnnnnnnn

SEQ ID NO: 58269 - DNA, 577 bp, Homo sapiens
  misc_feature: GYAE6OF01CMR4F.44.39.D06.1.454.CMB.1.raw
  modified_base (564)..(564): a, c, t, g, unknown or other
  misc_feature (564)..(564): n is a, c, g, or t
  modified_base (572)..(573): a, c, t, g, unknown or other
  misc_feature (572)..(573): n is a, c, g, or t
  modified_base (575)..(577): a, c, t, g, unknown or other
  misc_feature (575)..(577): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtccggcaacaccggcctccctgaccaatctctgggctccaggctgaggacgaggctgattattattgttgctcagtattgttcgtcgctatctactttagtgttcttacgggaagtcgggaacctaagggttccgaacccgttccgtaacggttaccacgtaccccgaaaggtcctccgcccccgttcggtccaccttccgttcgttccccgccccttcccttacctacttacttacgttcgttcctggacggtccgggtaccgttcgggaccgtaaacgggccgaccgtacgttaaggnacgtgtcnncnnn

SEQ ID NO: 58270 - DNA, 589 bp, Homo sapiens
  misc_feature: GYAE6OF01CAQH9.44.39.D06.1.454.CMB.1.raw
  modified_base (226)..(226): a, c, t, g, unknown or other
  misc_feature (226)..(226): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctctgtatcaacatcatccaaggtaaacgcccccaaaatcatcatctatgagcctataagacgtcctagtacgggtttctaatcgtcttcactcgcctaccaacggtccggacaaccgaccggtccctacccgtagaacctaactcctcgtcgggcctccgaggctaggaacggacgaggctagtatttagttattgtgctacgagtattgttcgtcgactattactacttattcgttcgttacggaaggttacgggaaccgtaaggttccaaccggttccgtaggtaccacggtaccccgaaacggaccccaaccccgtcgttcgtacccg

SEQ ID NO: 58271 - DNA, 265 bp, Homo sapiens
  misc_feature: GYAE6OF01B3DVE.44.39.D06.1.454.CMB.1.raw
  modified_base (236)..(265): a, c, t, g, unknown or other
  misc_feature (236)..(265): n is a, c, g, or t
tcagacagtatatacacgaccggtgctcgatttagtgacatctcggcgagtttctttgggctccaggctgacgatgaggctgattattactgcagctccgatgggagcacctatgatttgcttttcggcggagggaccagactgaccgtcctaggtcagcccaaggctcgccccctcggtcactctgttcccgccctcctctatatactgtctgagcggctggcaaggcgcatagnnnnnnnnnnnnnnnnnnnnnnnnnnnnnn

SEQ ID NO: 58272 - DNA, 667 bp, Homo sapiens
  misc_feature: GYAE6OF01EY4JA.44.39.D06.1.454.CMB.1.raw
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
tcagacagtatatacacgaccggtgctcgatttagtgacatctcgcagttctttgggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctctgcactggaaccaacngtgacgtcggttcgttttgaccgtgtctcctggtaccagcacgaccccagaaaccacgacccccaaactcattatttangtcggtacaattcgttccgtcccgttcggtcgtccctgacgcgtcttcgtcgtcggtaccaagtcgtggacaacgccggccctcccgtagacctactcctcgtcgggtccctaccgaggtcgtaggaacgggtacggagggtcctagtaacgtttacttaaccgtgccgtacgtcctactaataacgtaacgtaacggtaacgggtaaacctttaacgttttaaccgttaacgttaccgggaccgtacggtaacgggtaacccaaacggttccgtaccggtacccgttaccggtaacggtacccgaacgtacccgtaacggcccgttacccggtccccccgtcggtacccgtacccgg

SEQ ID NO: 58273 - DNA, 951 bp, Homo sapiens
  misc_feature: GYAE6OF01AZQK0.44.39.D06.1.454.CMB.1.raw
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatcctcctgcactggacgccaggtcgtaatattcttagtcttaactttgtctcttggtatcaacatcatccaggtaaacgcccccaaactcatcatcctatcgacgggccttaagtaaaggacggtaccccgtcgtaagggggttttacctaaagttccgtacctttccgaacttccggaccctttacccgaaacgggttaccccggaccgaaaaccgtacccggggtacccccttcccccgtacggtaaccctaaactttcccgttacccgttaacgggggccccttacccggtacggggtaccctttacggggaacgggtaaacccgggaacggggtccgtttaagggtttaaactttttaaacgttttaacggtttttcggtttttacggtcccgtttaacccggtaaaggtttacggttttaccgggtttttaccccgggttacccgggttacttaaaccgttttacccgtaacccgttttttaacggttaccggtttttcccgggttttaacccgggggttaaaaacggggttacccggggggtttaaaacccccggtaaaaacggggggttttcccccccgttaaaaccccgggggtttccccgtttttaaaaccccggggggtaccgttaaaaccccccgggtaaccccccgggttaaaaacccccggggtaaacccccccgttaaaaccccccccccggtaaacggttttccccgggtttaaaccccccccgg

SEQ ID NO: 58274 - DNA, 806 bp, Homo sapiens
  misc_feature: GYAE6OF01CXM8R.44.39.D06.1.454.CMB.1.raw
tcagacagtatatacacgaccggtgctcgatttagtgacatctcgcagttctttgggggggatctcaggaggcagctctctcggaatatctccaccatggcctgggctctgcctcctcctcaccctcctcactcgaggcacaggactccgtgggctcagtctcgccctggctcacgccctccctccgtgtccggtctccgtggacagtcagtccacctattcctcctgcctacgtacggaaaccacaggtcgtacggttcggttcgttttcggaccgttgtcctccgtacgtaccacgacgaccgaaccccaagaaaccaccgaacccccctaaactctaattttacgtttacgtcggtcggtaactaacgttccggttacccgtccccgttccgggttccttcccggtcggacggttcccgttccgtttccgtccgggtttaccgggtaccgttaacggttccgtacgggaacctaacccggtacccggtcccctcccgtacggaacccttagttcccgtcggtccgggcctaccggacgggtacgtacgggaacggtaccgggacggttcgttacggttaactttaacgttaccgtgacctacgtactactaacgttaacgtaaccgggtaaggtaccggttaaaccttacgtttttaacgtacggttccgggaaccgtacgggttaccgggaaaccgtaacggttccggaacccggttacccgttacggtaccggttacccgaacgtaaccccggtacggtccccggttacccggttacccccggtggttacccctaccccgg

SEQ ID NO: 58275 - DNA, 655 bp, Homo sapiens
  misc_feature: GYAE6OF01DKN4V.44.39.D06.1.454.CMB.1.raw
tcagacagtatatacacgaccggtgctcgatttagtgacatctcgcagttctttggggggggtctcaggaggcagcactctcgggacgtctccaccatggcctgggctctactcctcctcagcctcctcactcagggcacagggtcctgggcccagtctgccctgactcagcctgcctccgtgtctgggtcacctggacagtcgatcaccatctcctgcattggaaccagcagtgaactagttggtaggttataactatgtctcctaggtaccaaacaacacccaggaccaaacgacccccaaatcatgacttcatgtaatgtactagtaacgtccggaccctgtagggtttctcggtactctttctcgtgtcctccaagttcgtcggaccaaccggccgtaccctccctacgaacctctcgtccgtcgggcctcgaggtccgtaggacggacgaggtccgtagtaaccgtttatacgtcggacgtcctacttaatttaccgtaacttcgttagacgttacggtttgggttcggtttcggggacgggtacggttaccgtaccgtacccggttaccgtaccggtttcccgtaacggttcccgaaccggaccccgtaacgggtaccttcccccgggtcccccgttcgggttaccccc

SEQ ID NO: 58276 - DNA, 594 bp, Homo sapiens
  misc_feature: GYAE6OF01DHP5Q.44.39.D06.1.454.CMB.1.raw
  modified_base (192)..(192): a, c, t, g, unknown or other
  misc_feature (192)..(192): n is a, c, g, or t
tcagacagtatatacacgaccggtgctcgatttagtgacatctcgcagttctttggggggggtctcaggaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatcctcctgcactggacgccagcggtaattattcttagtctttaactttgtcttcctggtatcaacatcatccaaggtaaaccgacccccaaactcatcattctatgagcctaataagacggcccttacgtaggggtttctaacgtcgtcttcactcgcctaccaacgtccgacaacacggccctacctgaactaactctcgtgggcctcgaggctgacggacgaggctgtatttattattgttgtctcgtagtagttggttccgtgtctacttctactttattcgttcttacgggacgtacggggtaacctaacggggtccaccggttcccgtaggttccaaccggtccccgaaacggccccctaaaccctccgttgtacccc

SEQ ID NO: 58277 - DNA, 790 bp, Homo sapiens
  misc_feature: GYAE6OF01DZ6B9.44.39.D06.1.454.CMB.1.raw
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtcgtgggtactccgtggacagtcgatcaccttctctgcacgtggagccagcagtgactagttggtagttaataacttatcgtctccgtaggtaaccaacaaccacccgaaggaaccaaaccgacccccaaactcgtaatagtacttcataggtatcgtacgtaagttaacgtccggacccgttacggttaaggggtttcctcgggtccgttctttccgtcgttcggtaccttaccgtaacgtcgtacggaaccgtaaaccggtacccggtccccttacccgtacgtaacccgtattacccgtcggttacgggacccttacccggaagggtacccggtttaacgggaaggggaaaccccgggtaagggttacccgttaagttaaaccgtttaacgtttaaccgtcggtaccgtaacgtaccgtaacgtaaaagttaaaacgttaaaaacggaacaaccgtaaaccgttacgttaacgtttaaacgttaaccgggtttaccgggggaacgggttaaacgggaacccgtaaacgggtcccgttaaacgggtaaccccgttaccggttaacgggtacccaacgggtaaccccggtaaggttaccccccggg

SEQ ID NO: 58278 - DNA, 571 bp, Homo sapiens
  misc_feature: GYAE6OF01B4SQQ.44.39.D06.1.454.CMB.1.raw
tcagacagtatatacacgaccggtgctcgatttagtgacatctcgcagttctttgggggacaacaggcaggcagggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttatcgtaccccaatagtaagaactattagcctggtaccaacagaaaccgggacagtctacctaaattactcttttattgggcatctactcgggacgtccggggtccctgaccgattcgagtggcggcgggtcgtggggacacgtatttcactctcaccatcagtacgcctgcgaggctaggaagacggtggctaagtttattattgtaccaataattaattttagaacttcctaattctacgtttcggacgggtacgggaacaggtaagtagagtatacgaaaacgtacgtgtaggcctagacctaaccgtattcttagtcctttcgacttccccg

SEQ ID NO: 58279 - DNA, 636 bp, Homo sapiens
  misc_feature: GYAE6OF01D2U1M.44.39.D06.1.454.CMB.1.raw
  modified_base (362)..(362): a, c, t, g, unknown or other
  misc_feature (362)..(362): n is a, c, g, or t
  modified_base (440)..(440): a, c, t, g, unknown or other
  misc_feature (440)..(440): n is a, c, g, or t
tcagacagtatatacacgaccggtgctcgatttagtgacatctcgcagttctttggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactcggtaccctttaaagtctctatcatggtacgcaggtcggtcccgggccgacgaccccaaagtcctctttacgacgtccgtttcgcgggtcttcggcacgtcccgtggtccgttttcgcctcngttctcgccacgccgcctcctcgaccactcaccaaacctcccggcctggacggatgacggctagtacttacgtttgtntgctattatttcgattcactactaaattacgtcgttcgttacgggaagtcggggacccgtcgtcgacggtcgtccgtgccgtacgacgtaccccgaaccggcccctaaccccctacgttcgtaccctaccttccgttcccggtttacccccctccccgttacccttaccttaacttaccttaccgttcgttaccgg

SEQ ID NO: 58280 - DNA, 677 bp, Homo sapiens
  misc_feature: GYAE6OF01BU4C9.44.39.D06.1.454.CMB.1.raw
  modified_base (245)..(245): a, c, t, g, unknown or other
  misc_feature (245)..(245): n is a, c, g, or t
  modified_base (423)..(423): a, c, t, g, unknown or other
  misc_feature (423)..(423): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctggcgggacatcgcgatgagccagtctccagacctccctggctgtgtctcgtgggcgaggacggccaccgtcaactgacaacctccagacctaaagtcgtacttttancgtacccaattagtaacgtaacttatttacgccgttaggtaaccaacgaacggaaaaccgggactacggtaccttaccttaaaatttaccttacgtttttagtcgggactaattccgtaccggtcgggtacggttcccggggtccctagaccgtattcgaggtcggcggtcgggtcgngggacacgtactttcactctacacatcctagtacgtccgtgacgagcgtagaacgtacggtgacgttagtttattacgttagtaactaactaatttacgtttaacgaccttacttaacgttaccgtacgtttacgggacgggtaacggtaccgtaggtaacgtacgtaacgtaacgtaaccgtaaacgtaacgttggtacggtctacggtaccaccgttaacttacgttacgttaccttacgtccgttaccccg

SEQ ID NO: 58281 - DNA, 529 bp, Homo sapiens
  misc_feature: GYAE6OF01CLRPU.44.39.D06.1.454.CMB.1.raw
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
  modified_base (521)..(521): a, c, t, g, unknown or other
  misc_feature (521)..(521): n is a, c, g, or t
tcagacagtatatacacgaccggtgctcgatttagtgacatctcgcagttctttggggggggtctcaggaggcagcactctcgggacgtctccatcatggcctgggctctactcctcctcagcctcctcactcagggcacagggtcctggggactgtctgccctgactcagcctgcctccgtgtctgggtcgcctggacagtcggtcaccatctcctgcactggagccagcggtaatattcttagtcttaactttgtctcctggtatcaacatcatccaggtaaacgccccaaatcatcatctatgagctataagcgcctgtagggttcaatcgcttcactcgcctcaacgtccgacaaccaccggtcctccctagacaactctcgtcgggcctccgaggctagacggacgaggctagtattattnttgttnctacagtatcgttcgcgntatctattatcgtcgtacggagtcggacgtacggtcaccgtcgtaggtcacgtcccgaacgacccaacccngtcgtacc

SEQ ID NO: 58282 - DNA, 683 bp, Homo sapiens
  misc_feature: GYAE6OF01EUE5Z.44.39.D06.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
tcagacagtatatacacgaccggtgctcgatttagtgacatctcgcagttctttgggggggatctcaggaggcagctctctcggaatatctccaccatggcctgggctctgctcctcctcaccctcctcactcagggcacaggatcctgggctcagtctcgccctggctcagccctccctcgtcgtccgggtctccgtggacngtcagtcaccatcctcctgcacgtacggaaaccaacgngtcgaccggttcggttcgttttcgaccgttgtcctccgtggtaccagcacgaccccaagaaaccaccgaccccaaatctatttattagcgtacgtactacttcgttccgtcccgtttcgtcgtcccgtgacgtctcttcgtcgtcggtacctaagtcgtcggaccaacgtcccggtcccttacccgacgtaccctacgttccgtcggtccgggtacctaccggacgggtccgtagggaaccgggtacggtacgggtaccttaggttaactttaacttacgtcgaccgtagtcctactaataacgtaacgaaggtacggtaacttactttaacgtcgttcggacgaccggtaacggaccaaggtccgaccgtaacccggttcgtacggtaccgaccgtacccgtacggccccgttcccgtcccccggtacgtcccgtaacccg

SEQ ID NO: 58283 - DNA, 486 bp, Homo sapiens
  misc_feature: GYAE6OF01A5TWA.44.39.D06.1.454.CMB.1.raw
  modified_base (454)..(455): a, c, t, g, unknown or other
  misc_feature (454)..(455): n is a, c, g, or t
  modified_base (457)..(459): a, c, t, g, unknown or other
  misc_feature (457)..(459): n is a, c, g, or t
  modified_base (461)..(486): a, c, t, g, unknown or other
  misc_feature (461)..(486): n is a, c, g, or t
tcagacagtatatacacgaccggtgctcgatttagtgacatctcgcagttctttgggatgatgataaacgttacagtccaagtccttctcttaaagacagactcgacatcaccaaggactccgacgagaaccaggttgtcctgacactgaccttcgtggaccctcctggacacgaggcacattatttctgtgcacacactcgtgtcgttggggggtctttgactacgtggggccagggaactcccgtcggtccccgtcgtcgtcacgcctccaccgaacggcccattccggtcccttcccccgtggcccacccttcctaccgaacgacgccaccctcggtcgggggccacgacggcccggcccgtcgggcctcgcccgtaggtacgaaacggtaccttaccttcctaatacgttactgtcgtaggacgcgggctggacaacgggcacagttagnngnnngnnnnnnnnnnnnnnnnnnnnnnnnnn

SEQ ID NO: 58284 - DNA, 710 bp, Homo sapiens
  misc_feature: GYAE6OF01EFAWE.44.39.D06.1.454.CMB.1.raw
  modified_base (252)..(252): a, c, t, g, unknown or other
  misc_feature (252)..(252): n is a, c, g, or t
  modified_base (698)..(698): a, c, t, g, unknown or other
  misc_feature (698)..(698): n is a, c, g, or t
tcagacagtatatacacgaccggtgctcgatttagtgacatctcgcagttctttgggggggggtcacaagaggcagcgctctcgggacgtctccaccatggcctgggctctgctgctcctcactctcctcacccaggacacgagggtcctgggcccagtctgccctgactcacgcctgcctccgtgtcgtgggtcgcctggacacggtcgtcactatcctcctgactacgtggacgccgtaggcggttaatntttcttagttacctttaactttcgtcttcgtgtaactacaactatactactaccgaaggtaaacccaccccctaaatctaactactactcctagtcgacggtactaagtaacgtacggtccttcggtacgggttactaagtccgtctacctacgtcgcctacgtacggtcccggacaaccgaccgtcccctaccgtacgaaccgtaacttccgtacgtcggtaccctcggtacgtcgtaggaacgggtacggtacggtcgttaagtaacttttacgtttagttacggtttcgtacgtacgtaagttacgtttcggtaccgttccgtaactacgttaccttacttagttccggtaacggttacgggtaaacgggtccgggtaaccgtaacggttacccgacccggttacgacggtcccaaccggtacccgaacgacccctaacccgntcccggtaaccc

SEQ ID NO: 58285 - DNA, 453 bp, Homo sapiens
  misc_feature: GYAE6OF01CKR3Y.44.39.D06.1.454.CMB.1.raw
  modified_base (442)..(453): a, c, t, g, unknown or other
  misc_feature (442)..(453): n is a, c, g, or t
tcagacagtatatacacgaccggtgctcgatttagtgacatctcgcagttctttgggatgatgataaacgttacagtccaagtccttctcttaaagacagactcgacatcaccaaggactccgacgagaaccaggttgtcctgacactgaccttcgtggacctcctggacacaggcacattatttctgtgcacacactcgtgtcgttgggggctttgactacgtggggccagggaactccgtggtccccgtctcgtcacgcctccaccgaacgggcccagtccggtcccttcccccgtggcccaccctccctaccaagcgccaccgtcggtcgggggccacgacggcccggcccgtggggcctcggcccgtggtacaacggtaccttaccttcctattactacgtgtctggacgcgggtcgtcggacgaacggtcgcatagnnnnnnnnnnnn

SEQ ID NO: 58286 - DNA, 951 bp, Homo sapiens
  misc_feature: GYAE6OF01ECVI1.44.39.D06.1.454.CMB.1.raw
tcagacagtatatacacgaccggtgctcgatttagtgacatctcgcagttctttggggacaacaggcaggcaggggcagcaagatggtgttgcagacccaggtcttcatttctctgttgctcgtggatctcgtggtgccgtggcgggacagtcgcgatgacgccagtcctaccagacctccgtggctgtcgtctgtgggacgaggacggcctaccgtacaactcgacctaacctccaaggacctaaagttcgtttacttttacgccgtaacccctaaataaggtaaacgtaacttaatttaccgaccgtacggtaaccgaaacgtaacggaaacccggtactaacggttaaccttaacctttaaaatttaccgtttacgttttaacggttacgggaccttactaccgttacggtaccggggtaccgggttccccgggtaccctacggtaccgtacgttacggtacggtcggggtcgggtaccgggttcggtaggggaacctaaccttactttaccgaccttacctcctaaaccgtacttacgtacggttaccgtccgtacgaccgtagggtaccgtaaggttaaacgtttacggttttagtaaccgttttaacgtttttaacggttaccttaacgggttaccgaacggtttaaccgttaaagggtttaaacctttaaacgggtcccggttaacccggttacccggggtttaacccccccttttaccccggggtttaaccccgggaaaacccgggttaaccgggggtaaccccgttaaaccgggttaaaccgggttaaagggttaaaacgggttaaaacccggtttttaaaacgggaaccggtttacggggtaacccggttcccgttaacggtaaccccttaaacccggttaaccgtttaccggtttaacccgtttccgttttaaacccgcccccgtttttaaccccccggg

SEQ ID NO: 58287 - DNA, 648 bp, Homo sapiens
  misc_feature: GYAE6OF01BVOQF.44.39.D06.1.454.CMB.1.raw
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
tcagacagtatatacacgaccggtgctcgatttagtgacatctcgcagttctttggggggggtctcaggaggcagcgctctcgggacgtctccaccatggcctgggctctgctattcctcaccctcctcactcagggcacagggtcctgggcccagtctgccctgactcagcctgcctccgtgtcgtgggtcaccgtggacagtcgatcaccatctcctgcattcggaaccagcagtgacagttggtgttataactatgtctcctggtaccaacaacaccaggacaacgccccaatcatgtatcatgatgtacagtacgtcggccctcgtaggggtttctcggtctctttcgtctcgcctcctaagtcgtaggacaaccgaccggtccccttcccgacgtacccctagttcccgtacgttcgggacccttacccgagggtcctagggaacgggacgcgggtctacgtaagttaccttacgtcgcagtcctaanaacgttaaanaaaaacggtacaactaactacgttagttaaacttacggttaccggggacggtaacgggaacctaaggtaccgtaccgggtacccgttaccgtacggtaccgaacccggaacccggtaacccggtcccgttaccgtacccccccgg

SEQ ID NO: 58288 - DNA, 746 bp, Homo sapiens
  misc_feature: GYAE6OF01A3DAR.44.39.D06.1.454.CMB.1.raw
tcagacagtatatacacgaccggtgctcgatttagtgacatctcgcagttctttggggacaacaggcaggcaggggcagcaagatggtgttgcagaccccaggtcttcattttctctgttgctctggatctctggtgcctggcgggacatcgcgatgagccagtctccagacctccctggactgtgtctcgtgggcgagacggccaccgtcaacgtgaccaactccgagaccgtaagttcgttaccttttagaccgtacccctaaagttaacgtaaacgtaacctttagttacgacccgttaggtaaacccaacgaacggaaacccgggtactaacggttaccctaacctttaaaacgttttaccttaccgtttttacgtacgggtacctaacgttccgtaaccggttccggggaaccgtttccccggggtaccctacggtaacccgtgttaccgacggttcgggaccgggtcggttaccggtcggaacctaacgttactttccgactacctacacccgtatccgacgtacgccgtaggtccgaggtcgtagaacgtacgtaggtacgttagtttaattcttacgtaactaacgtactttaacgttacgtaaccttctaattaccgtacgttacgggacggtaacggacctaggtacgaagtaacgtaacgtaaaccggtaacgaacggttggtacggtactcgtacctaacgtccttcttacgttaccttcttaccgttaccccg

SEQ ID NO: 58289 - DNA, 756 bp, Homo sapiens
  misc_feature: GYAE6OF01D6KZB.44.39.D06.1.454.CMB.1.raw
  modified_base (146)..(146): a, c, t, g, unknown or other
  misc_feature (146)..(146): n is a, c, g, or t
  modified_base (274)..(274): a, c, t, g, unknown or other
  misc_feature (274)..(274): n is a, c, g, or t
tcagacagtatatacacgaccggtgctcgatttagtgacatctcgcagttcgtttggggggggtctcaggaggcagcgctctcgggacgtctccaccatggcctgggctctgcttattcctccaccctcctcactcgagggcacgngggtcctgggcccagtctcgccctgactcacgcctcgcctcgtgtcgtggtcacgtggacagtcgatccacctatcctcctgacacgtaccggaaccagctagtgactagttggttagttataacgtntcgtctcgtacgtaaccaacaccaccgaggaccaaaccgtacccccaaatcaacgtacgtactacgtactagtatcgtaacgtaacggttaaccgtcccggtaccgttacgggtttacgggtttcgtccggttccgttcgtttccgtcggtcggtccttaaccgtaagtccgtacgaccgtaaccgtcccggtccctccgtaacgtaccttcgttccctcgggtcggtcccttacgacggtcgtaacgggacggacggtacgtctacggtaactttcgtcgtacgacgtacgtaactaagtaaacgtaaaacgtaaaagtacccaacgttaaaccgttgtttaaacggttacgttacggggtacccgggaaagggtaacccggtaaacggtacccgtacggtacccgggttaaccgttacccggaacggtacccggtacgaaccccgggttcggttaccccgcccccggtttaacccccggg

SEQ ID NO: 58290 - DNA, 766 bp, Homo sapiens
  misc_feature: GYAE6OF01E1LIS.44.39.D06.1.454.CMB.1.raw
  modified_base (182)..(182): a, c, t, g, unknown or other
  misc_feature (182)..(182): n is a, c, g, or t
tcagacagtatatacacgaccggtgctcgatttagtgacatctcgcagtttctttgggggggggtctcaggaggcagcactctcgggacgtctccaccatggcctgggctctactcctcctcagcctcctcactcagggcacgagggtcctggggactgtctaccctgactcagccgccctnagtgtccgggactcctggtcagtcgtcaccattcttctgttcctccagcgactaattccacttcggtacccttttaaagtctactaatcatcggtacgcaggtcggtcccgggccgaccgaccccctaaagtcccttacttttacgaccgttccgtttaccggccgggtcgttcggcgtacgtcccgttcggtcccggttttttcggcccttccgtagtttcctacgtacccacggtcccggtccccttcccgtcgacccacttaccaaacccgtaaaccgtcccggtaccttaggaacggtagtacggtacgggtcttacgtaactttacgtttttgttcgttacgtacgttaaatttacgtttacggtaacctttacctaaccttaacgttaaacttacttcggtttaaccgtttacgggtaacgggttccggggacccttcggtacgtaccggtccgtttaccgtacgggtccgtaccgaccggtacccgaaaccggccccaaaccccctagttccgtacctaaccttccgttccccttacccctaccccttcctaccttaactacttccgtacgttccgg

SEQ ID NO: 58291 - DNA, 746 bp, Homo sapiens
  misc_feature: GYAE6OF01CEMLS.44.39.D06.1.454.CMB.1.raw
  modified_base (232)..(232): a, c, t, g, unknown or other
  misc_feature (232)..(232): n is a, c, g, or t
  modified_base (525)..(525): a, c, t, g, unknown or other
  misc_feature (525)..(525): n is a, c, g, or t
tcagacagtatatacacgaccggtgctcgatttagtgacatctcgcagttctttgggggggggtctcaggaggcagcactctcgggacgtctccaccatggcctgggctctactcctcctcagcctcctcactcagggcacagggtcctggggactgtctaccctgactcagccgccctcagtggtccgggactcctggtcagtcggtcaccatcttctgttctcagctaanaattccactcggtacctttaaagtctctatctatcgtacgctaggtcggtcccggaccgacgaccccaaagttccttcgtttaccgacgtcctttacggcgggtcttcggctacgtccgttacggtccgtttttccggcctcctacgttcgtacgaccgaccggtccgtccctacccgtcgacccaactacccaacccgtaaaaccgttcccgggacccgttaggacggtaagtacggacgggtctacgtactttaccgtttttagttcgtacgtcgtaacttactttacgtnttacctaactactaaaacttagttcggttacgttacggtaacggtacgggtaccgtcgtaccgacggtcccgttacgtcggtacgtaccgaaccgtaacccgtaacggtaacccctaaaccccgtacgtccggttaacctaacccgttccgtttaccccggtcccccggttaccccttaccgttaacctttacggtaacctttccgttaacggttacccgg

SEQ ID NO: 58292 - DNA, 992 bp, Homo sapiens
  misc_feature: GYAE6OF01ERSO4.44.39.D06.1.454.CMB.1.raw
  modified_base (262)..(262): a, c, t, g, unknown or other
  misc_feature (262)..(262): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtcgcctggcggggactatcgcgatgacgcctagtcctccaagtcctcccgtgctgtgtctcggtgggcgaggcgggacccacgtcaactgactaacctccgacgtacctaaaggtgtttacttttaacnccgttaccccaaaagttacggtaaacgttaactttacgtttacgtacccggttaacggtaacccaaaacggtaaaccgggaaaacccggtactaaccggtttaccctaacctttaaaacgttttaccttttaccggtttttaacggtacggggtaccgttaaccgtttaccggttaacgggtttccccgggggaaaccggttttcccccgggggttaacccgtacggtaaacccggtaagtttccggtaaggggttacccggggtaccggggttaccggggttacgttaccgggggaaaccttaaccttttaaccggttttacccaacccggttttacccgacccgtaaacccggttaacgttacccgggtaaaggttaacccggtccccgttagggaacccggttacgggtaccggttaaagggaaaaccccggttccggggttaagggtaacccctttttaaaggttttttaacccgttttaacggtacccgggtttaaacaaaccgggtttttaaactttttaacccggttttaaaccaacccgttttaccctttaacggttaccccgggtttaacgggttacccggggaagggttaaccgggtaacgttaacgggtaaacggttacgggtaaactggtaaaaccccgtaaaggttccgtaacggttcggaccgttaccgacccgttaacgttcgttacttaccggtactttacgaccgtttccccg

SEQ ID NO: 58293 - DNA, 768 bp, Homo sapiens
  misc_feature: GYAE6OF01A6IXQ.44.39.D06.1.454.CMB.1.raw
tcagacagtatatacacgaccggtgctcgatttagtgacatctcgcagttcgtttggggggggtctcaggaggcagcactctcgggacgtctccaccatggcctgggctctactcctcctcaccctcctcactcgagggcacaggactccgtgggctcagtctcgccctggctcacgccctcccgtccggtcggtccgggtcctccgtaggactacgtcagtccacctactccgtcctcgcctacgtacggaaaccactaggtcgtacggttcggtttacgtttcgaccgtgtcctaccggtcggtacacgaccgaccgacccaaacgaaaccaccgaccccctaaatacctaatttacttacggtacggtaccggttaactacgtttccggttccctcccggtttaccgtcctaccgtgaccgtccgtccttcgacggtcggtctaacgtcgacggtacaccgtacggtccctacctacgaccgtactccgtcggtaccggccgtacgacgttcggtagggacgggtacgtacggtactacttaacgttacttaccgcgtacgtacgtactacgtactaagtaccggtaaggttaacgttaaacctttaccgttaagttccgggtaacgtccgaacgggtaacgtaccgtacggttaccggaccggttacccgtccggtaagttaccccggaacggttaccccgtacgggtcccaccccgggttcccggttacgaccgttcccggttcccggttaccccggttcccc

SEQ ID NO: 58294 - DNA, 885 bp, Homo sapiens
  misc_feature: GYAE6OF01A0VI5.44.39.D06.1.454.CMB.1.raw
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
tcagacagtatatacacgaccggtgctcgatttagtgacatctcgcagttcgtttggggggggtcacaagaggcagcgctctcgggacgtctccaccatggcctgggctctgctgcctcctcactcctcctcacccaggacactagggtcctcgggccccagtcctcgcccgtgactcacgcctcgtccgtccgtgtcgtcgggtcnccgtggacgcggttccggtacaccacgtcctcctcggcacgtcgggacnccgagtacggttaattacttctttacgttctttaactttcgtaccttccgttggtactacaaactacttacctacgtaccgaaacggttaaacccgaaccccctaaaacgtccgtaactacctactttactacgtacgggtaaccgtaccgttaaacggtaacggtaccgtacccgttacgggttaacggggttttcctaaccgttaccggttccttaacaccggtttccgtaaccctaacccggtaacggtacccgggtaaccgaacccggtacccggtaccccgttacccgttaccggaaacccttaacgtttcccgttaaccgggttccggtaccccgttccggtaaacgggtccggttaacggggaaccgggtaaccgggtaacgttcgggtttaaacgttaaggtttttaacctttaggttttaacggtttcgttaccttaacggttaaggttcggttttcggttaccggtttaacctcgttaaaccggttctttaacccgttaggttaccgtttcggtaacggtaaccgggttcggtaaccgggtaccgtacggtacccgttaccgggtacgacccgtaccgggtaaccaacccgtacccgtaaacccctggtccttaacccg

SEQ ID NO: 58295 - DNA, 892 bp, Homo sapiens
  misc_feature: GYAE6OF01BVEYZ.44.39.D06.1.454.CMB.1.raw
  modified_base (212)..(212): a, c, t, g, unknown or other
  misc_feature (212)..(212): n is a, c, g, or t
tcagacagtatatacacgaccggtgctcgatttagtgacatctcgcagttctttggggggggtctcaggaggcagcactctcgggacgtctccaccatggcctgggctctactcctcctcagcctcctcactcagggcacgagggtcctggggactgtctaccctgactcagccgcctcagtggtccggactcgtggtcagtcggtcacgtntcttctgttctaccagcactaactccacgtcgtacctttaaagtcctactactcgtagttcggtaccgcgtaacggtcggtaccccgggcccgaccgacccccgtaaagttcccttaccgttttaccgaccggtttccgtttacgggtccgggttaccttccgggctaccggttcccggttcgggtttccccggtttttaccggacccttccgttacgtttccgtacgggtaacccgtaccggtcccggtccccttaccccgtacgaacccctacgttaaccccgaaacccgttaaaacccgtcccggtacccgtacggaacgggtaacgtcggtaaccgggtccgttaacggtttaacccttttacgtttttacggggtcgtttaagggtacccctttaaaggtttaccgttttccgtaagtttacccttaacgttaacgtaaaacgttcgttttaccggttacggtttaccgggaacgggtttacccgggtaccggttaccttagggtaacccgttaccggttcccgttacggtacccgtaccggttaacccgaacccgggttaaaccgtaacccccggttaacccgtaccgttacgtcccgttaaaccctccgtttaccccctaacccgttacccctttcttacgttaaccgtacctttacggtcccgttaaccggg

SEQ ID NO: 58296 - DNA, 229 bp, Homo sapiens
  misc_feature: GYAE6OF02FFHI6.44.39.D06.1.454.CMB.1.raw
  modified_base (228)..(229): a, c, t, g, unknown or other
  misc_feature (228)..(229): n is a, c, g, or t
tcagacagtatatacacgaccggtgctcgatttagtgacatctcgcagttctttggctccaggctgacgatgaggctgattattactgcagctccgatggagcacctatgatttgctttcggcggaggaccagactgaccgtcctaggtcagcccaaggctcgcccctcggtcactctgttcccacctcctctatatactgtctgagcgggctggcaaggcgcatagnn

SEQ ID NO: 58297 - DNA, 237 bp, Homo sapiens
  misc_feature: GYAE6OF02JZO7K.44.39.D06.1.454.CMB.1.raw
  modified_base (233)..(237): a, c, t, g, unknown or other
  misc_feature (233)..(237): n is a, c, g, or t
tcagacagtatatacacgaccggtgctcgatttagtgacatctcgcagttctttgggctccaggctgacgatgaggctgattattactgcagctccgatggaggcacctatgatttgcttttcggcggagggaccagactgaccgtcctaggtcagcccaaggctgccccctcggtcactctgttcccgccctcctctatatactgtctgagcgggctggcaaggcgcatagnnnnn

SEQ ID NO: 58298 - DNA, 512 bp, Homo sapiens
  misc_feature: GYAE6OF02G1L9O.44.39.D06.1.454.CMB.1.raw
  modified_base (236)..(236): a, c, t, g, unknown or other
  misc_feature (236)..(236): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttangtccccaatagtaagaactatttagcctggtaccaacagaaaccgggacagtctcctaaattactcttttaatgggcatctactcgggagtccgggtccctgaccgattcagtggcgcgggtctgggacacatttcactctcaccatcagtagcctgcaggctgaagacgtggcagttattattgtcaacatatttagaactctatcactttcggcgtacggacagagtagagatacaaacgaactgtaggctgcaccatcctgtcttcattcccg

SEQ ID NO: 58299 - DNA, 234 bp, Homo sapiens
  misc_feature: GYAE6OF02H0UAG.44.39.D06.1.454.CMB.1.raw
  modified_base (232)..(234): a, c, t, g, unknown or other
  misc_feature (232)..(234): n is a, c, g, or t
tcagacagtatatacacgaccggtgctcgatttagtgacatctcgcagttctttgggctccaggctgacgatgaggctgattattactgcagctccgatggaggcacctatgatttgcttttcggcggagggaccagactgaccgtcctaggtcagcccaaggctgccccctcggtcactctgttcccgcctcctctatatactgtctgagcgggctggcaaggcgcatagnnn

SEQ ID NO: 58300 - DNA, 510 bp, Homo sapiens
  misc_feature: GYAE6OF02HAMS7.44.39.D06.1.454.CMB.1.raw
  modified_base (495)..(495): a, c, t, g, unknown or other
  misc_feature (495)..(495): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttatgtccccaatagtaagaactatttagcctggtaccaacagaaaccgggacagtctcctaaattactcttttattgggcatctactcgggagtccggggtcctgaccgattcagtggcggcgggtctgggacacatttcactctcaccatcagtagcctgcaggctgaagcgtggcagtttattattgtcaacaatatttagaactctatcactttcggcgtaggaccagagtagagatcaaacgaactgtggctgcaccntctgtcttcattccg

SEQ ID NO: 58301 - DNA, 530 bp, Homo sapiens
  misc_feature: GYAE6OF02G9QIN.44.39.D06.1.454.CMB.1.raw
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttatcgtccccaatagtaagaactatttagcctggtaccaacagaaaccggacagtctcctaaattactcttttattggcatctactcgggagtccgggtccctgaccgattcagtggcggcgggtctgggacacatttcactctcgaccatcagtacgcctgctaggctgaagcgtggctagtttattattgtacaataatatttagaactcctatctactttcggacgaggaccagtacgtagagtatacgaaacgtaactgtaggcgtgacacctatcttcgtcttcacttcccg

SEQ ID NO: 58302 - DNA, 517 bp, Homo sapiens
  misc_feature: GYAE6OF02JFP2H.44.39.D06.1.454.CMB.1.raw
  modified_base (236)..(236): a, c, t, g, unknown or other
  misc_feature (236)..(236): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttangtccccaatagtaagaactatttagcctggtaccaacagaaaccgggacagtctcctaaattactcttttatgggcatctactcgggagtccggggtccctgaccgattcagtggcggcgggtctggggacacatttcactctcaccatcagtagcctgcaggctgaagacgtggcagtttattattgtacaacaattatttagaactctatcactttcgcgtagggaccagagtagagatacaaacgaactgtggctgcacctatctgtcttcattcccg

SEQ ID NO: 58303 - DNA, 396 bp, Homo sapiens
  misc_feature: GYAE6OF02GW6AS.44.39.D06.1.454.CMB.1.raw
  modified_base (387)..(396): a, c, t, g, unknown or other
  misc_feature (387)..(396): n is a, c, g, or t
tcagacagtatatacacgaccggtgctcgatttagtgacatctcgcagttctttgggatgatgataaacgttacagtccaagtccttctcttaaagacagactcgacatcaccaaggactccgacgagaaccaggttgtcctgacactgaccttcgtggacctcctggacacaggcacatatttctgtgcacacactcgtgtcttggggggctttgactactggggccagggaatcctggtccccgtctcgtcagcctccaccaagggcccatcggtcttcccctggcacccctccccaagagcacctctgggggcacagcggccctgggctgcctggtcaaggctactcctatatactgtctgagcgggctggcaaggcgcatagnnnnnnnnnn

SEQ ID NO: 58304 - DNA, 516 bp, Homo sapiens
  misc_feature: GYAE6OF02IA3QM.44.39.D06.1.454.CMB.1.raw
  modified_base (237)..(237): a, c, t, g, unknown or other
  misc_feature (237)..(237): n is a, c, g, or t
tcagacagtatatacacgaccggtgctcgatttagtgacatctcgcagttctttggggacaacaggcaggcaggggcagcaagatggtgttgcagacccaggtcttcattttctctgttgctctggatctctggtgcctgcggggacatcgcgatgagccagtctccagactccctggctgtgtctctgggcgagagggccaccgtcaactgcaactccagccaaagtgtcttttangtccccaatagtaagaactatttagcctggtaccaacagaaaccgggacagtctcctaaattactcttttattgggcatctactcgggagtccgggtcctgaccgattcagtggcggcgggtctgggacacatttcactctcaccatcagtagcctgcaggctgaagcgtggcagtttattattgtcaacaatattttagaactcctatcactttcggcggagggaccagagtagagatacaaacgaactagtggctgccacactctgtcttcattccc

SEQ ID NO: 58305 - DNA, 222 bp, Homo sapiens
  misc_feature: GYAE6OF02FTBID.44.39.D06.1.454.CMB.1.raw
  modified_base (220)..(222): a, c, t, g, unknown or other
  misc_feature (220)..(222): n is a, c, g, or t
tcagacagtatatacacgaccggtgctcgatttagtgacatctcgcagttctttggggagaggaactgctcagttaggacccagacggaaccatggaagccccagcgcagcttctcttcctcctgctactctggctcccaggaactgtggctgcaccatctgtcttcatcttcccgccatctgatatatactgtctgagcgggctggcaaggcgcatagnnn

SEQ ID NO: 58306 - DNA, 532 bp, Homo sapiens
  misc_feature: GYAE6OF02HF5NW.44.39.D06.1.454.CMB.1.raw
  modified_base (343)..(343): a, c, t, g, unknown or other
  misc_feature (343)..(343): n is a, c, g, or t
  modified_base (377)..(377): a, c, t, g, unknown or other
  misc_feature (377)..(377): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
tcagacagtatatacacgaccggtgctcgatttagtgacatctcgcagttctttgggggggatctcaggaggcagctctctcggaatatctccaccatggcctgggctctgctcctcctcaccctcctcactcagggcacagggtcctgggcccagtctgccctgactcagcctgcctccgtgtctgggtcacctggacagtcgatcaccatctcctgcattggaaccagcagtgacattggtggttataactatgtctcctggtaccaacaacacccaggacaaacgcccccaaatcatgattcatgatgtacagtaatcggccctgtagggtttctggtcncttctctggctcaagtctggacaacgcgcctccngaccatctcgtggctcgaggctgaggacgaggctgacttatactgacagctanaataataaaagaagacaaactntagttatagttaccgggacggaacggaaccaagtccgtacggtacccgttaccgtaggtaccacggacccgaaggtcccg

SEQ ID NO: 58307 - DNA, 514 bp, Homo sapiens
  misc_feature: GYAE6OF02FPZ75.44.39.D06.1.454.CMB.1.raw
  modified_base (236)..(236): a, c, t, g, unknown or other
  misc_feature (236)..(236): n is a, c, g, or t
  modified_base (422)..(422): a, c, t, g, unknown or other
  misc_feature (422)..(422): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttangtccccaatagtaagaactatttagcctggtaccaacagaaaccgggacagtctcctaaattactcttttattggcatctactcgggagtccggggtccctgaccgattcagtggcggcgggtctggggacacgatttcactctcaccatcagtagcctgcaggctgaagacgtggcagtttattnttgtcaacaatatttagaacttctatcactttcggcggaggaccagagtagagatcaaacgaactgtggctgcaccatctntcttcnttccc

SEQ ID NO: 58308 - DNA, 541 bp, Homo sapiens
  misc_feature: GYAE6OF02IRTUE.44.39.D06.1.454.CMB.1.raw
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttatcgtccccaatagtaagaactatttagcctggtaccaacagaaaccggacagtctacctaaattacttcttttattggcatctactcggagtccgggtcctgaccgattcagtggcggcgggtcgtgggacacgtattcactctaccacctatcagtacgcctgcaggctagaagtacgtggactagtttattattgtacaactaattatttagaacttcctatctacgtttcggcgtacggacctagagtagagatacgaaacgactgtacggctacgactacgacttctcgtcttcacttcccg

SEQ ID NO: 58309 - DNA, 679 bp, Homo sapiens
  misc_feature: GYAE6OF02H2PKU.44.39.D06.1.454.CMB.1.raw
  modified_base (341)..(341): a, c, t, g, unknown or other
  misc_feature (341)..(341): n is a, c, g, or t
tcagacagtatatacacgaccggtgctcgatttagtgacatctcgcagttctttggggggggtctcaggaggcagcgctctcgggacgtctccaccatggcctgggctctgctattcctcaccctcctcactcagggcacagggtcctgggcccagtctgccctgactcagcctgcctccgtgtctgggtcactggacagtcgatcaccatcctctgcattggaaccagcagtgactagtttgggtagtttataactatgtctccgtggtaccaacaacacccagacaaacgccccaaactcatcgatcatgatgtcagtactccggcctgaggggtttcncggttcgtctttctcgtggtccttaccgaagttccgtggaccaaaccgtccggaccttcccctagaccctcttccgtacggtcgggtcccttacgacggtcgtacggacgggtacgacgggttctaggtaacttacgttaaccgtggacctaacgtccttacgtaaacttaaagtaaaacggaacgtacctaaacgtacgttaagtttacgttaacgttccggggtaccgggaacggggtaaccctaacggttccgaaccgggttaccccggtaacccgttacgggtaccgaaccgggtacccccgtaagggtccccgttacccgggtacccccccgg

SEQ ID NO: 58310 - DNA, 525 bp, Homo sapiens
  misc_feature: GYAE6OF02H0HG1.44.39.D06.1.454.CMB.1.raw
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggcccacgtcaactgcaactccagccaaagtgtcttttatcgtccccaatagtaagaactatttagcctggtaccaacagaaaccgggacagtctcctaaattactcttttatggcatctactcgggagtccggggtcctgaccgattcagtggcggcgggtctgggacacgatttcacttctcaccatcagtacgctgcaggctagaagacgtggctagtttattattgtcaactaatattttaagaacttcctatctactttcggacgagggacaggaagtagagatcgaaacgaactgtgctcgacacatcctgtcttcattcccg

SEQ ID NO: 58311 - DNA, 553 bp, Homo sapiens
  misc_feature: GYAE6OF02HIGKJ.44.39.D06.1.454.CMB.1.raw
  modified_base (448)..(448): a, c, t, g, unknown or other
  misc_feature (448)..(448): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttatcgtccccaatagtaagaactatttagcctggtaccaacagaaaccgggacagtctacctaaattacttctttattggctatctactcgggagtcccggggtcctgaccgattcgaggtggcgggtcgggtcgtgggacacgtatttcacttctcaccatcgagtacgcctgcgaggctagaagacggtggactagtttattattgtactaanaattatttagtaacttctattctacgttcggcggaaggaccagagtagagactacaaacgtactggtacggtctgaccactactcttgttacttcgtcttacccg

SEQ ID NO: 58312 - DNA, 395 bp, Homo sapiens
  misc_feature: GYAE6OF02IAZMW.44.39.D06.1.454.CMB.1.raw
  modified_base (389)..(395): a, c, t, g, unknown or other
  misc_feature (389)..(395): n is a, c, g, or t
tcagacagtatatacacgaccggtgctcgatttagtgacatctcgcagttctttgggatgatgataaacgttacagtccaagtccttctcttaaagacagactcgacatcaccaaggactccgacgagaaccaggttgtcctgacactgaccttcgtggacctcctggacacaggcacatatttctgtgcacacactcgtgtcttggggggctttgactactggggccagggaatcctggtccccgtctcgtcagcctccaccaagggcccatcggtcttccccctggcaccctcctccaagagcactctgtgggcacagcggccctgggctgcctggtcaaggactacttctatatactgtctgagcgggctgggcaaggcgcatagnnnnnnn

SEQ ID NO: 58313 - DNA, 241 bp, Homo sapiens
  misc_feature: GYAE6OF02IWCTL.44.39.D06.1.454.CMB.1.raw
  modified_base (234)..(241): a, c, t, g, unknown or other
  misc_feature (234)..(241): n is a, c, g, or t
tcagacagtatatacacgaccggtgctcgatttagtgacatctcgcagttctttgggctccaggctgacgatgaggctgattattactgcagctccgatggaggcacctatgatttgcttttcggcggagggaccagactgaccgtcctaggtcagcccaaggctgccccctggtcactctcgttcccaccctcctctatatactgtctgagcgggctgggcaaggcgcatagnnnnnnnn

SEQ ID NO: 58314 - DNA, 546 bp, Homo sapiens
  misc_feature: GYAE6OF02GJSGI.44.39.D06.1.454.CMB.1.raw
  modified_base (528)..(528): a, c, t, g, unknown or other
  misc_feature (528)..(528): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttatcgtccccaatagtaagactattagcctggtaccaacagaaaccgggacagtctactaaattactctttagtggcatctacgtcgggagtccggggtccctgaccgtattcgagtcggtcggcgggtcgtagggacactagtttcactctaccacctatcagtacgcctgcaggctagaagacgtggactagtttattatcgttacaactaattattttacgaacttctatactacgtttcggacggtaggacctaggtaagtagagatacgaacgtatggtgctgactacgntcgtgtcttcgattcccg

SEQ ID NO: 58315 - DNA, 566 bp, Homo sapiens
  misc_feature: GYAE6OF02FR394.44.39.D06.1.454.CMB.1.raw
  modified_base (227)..(227): a, c, t, g, unknown or other
  misc_feature (227)..(227): n is a, c, g, or t
  modified_base (466)..(466): a, c, t, g, unknown or other
  misc_feature (466)..(466): n is a, c, g, or t
  modified_base (508)..(508): a, c, t, g, unknown or other
  misc_feature (508)..(508): n is a, c, g, or t
  modified_base (521)..(521): a, c, t, g, unknown or other
  misc_feature (521)..(521): n is a, c, g, or t
tcagacagtatatacacgaccggtgctcgatttagtgacatctcgcagttctttggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccancgacaattccactggccctttaaagtctctatcatggtacgcagtggtcccgggccgacgcccccaaagtccttcttttacgacgttcctttcgcgggtcttcggctacgtccctggtccgtttttcggcccttccgagttctgtaccacgccggccctcctgaccatcaccaaactccgcctgagatgagctgacttacttttgttgtgtctattatttcgtacttcactacaaattntgttcttcggaagtcggacccgcgtcagcgtctgccgtcacnccacggccacccncgtcgtcactcttcgtcccacccttcctactactactactgtccg

SEQ ID NO: 58316 - DNA, 571 bp, Homo sapiens
  misc_feature: GYAE6OF02IBUSL.44.39.D06.1.454.CMB.1.raw
  modified_base (248)..(248): a, c, t, g, unknown or other
  misc_feature (248)..(248): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
tcagacagtatatacacgaccggtgctcgatttagtgacatctcgcagttctttgggggggggtctcaggaggcagcgctctcgggacgtctccaccatggcctgggctctgctattcctcaccctcctcactcaggacacagggtcctgggcccagtctcgccctgactcagcctgcctccgtgtctggttctcctggacagtcgatcaccatctcctgcactgggtccagcaatgacagttggganatataacttgtctcctggtatcaacaacatacaggacaaaaccgacccccaaaactaccaattactttttagacgttccagtgagcggccgtcaggttntttactaatcgctttcnctggctcaagtctggccacgacggcctccctgtcgatcctcgtcggcctcggtcctggaacggacgaggtctgacttacgttactcgcgctctaacttacgactgttgacgtgttggtggttcgggacgggtaggtacgtccgtacgtcgtaccgttcgtacggttccaccgccgaacggtccgtccgtccccgtcggtcctacccg

SEQ ID NO: 58317 - DNA, 664 bp, Homo sapiens
  misc_feature: GYAE6OF02HU3TV.44.39.D06.1.454.CMB.1.raw
tcagacagtatatacacgaccggtgctcgatttagtgacatctcgcagttctttggggacaacaggcaggcaggggcagcaagatggtgttgcagacccaggtcttcatttctctgttgctctggatctctggtgcctggcggggacatcgcgatgagccagtctccagactccctggctgtgtctcgtgggcgagagggccaccgtcaactgacaacctccagaccaaagtgttctttatcgtaccccaataagtaagaacttattagtacctggtaaccaacgaagaaaccgggacacgtacctacctaaattacttctttattgggctatctacgtcgggacgtcccggggtcctggaccgattccgaggtcgggcggtcgggtcgtgggaacacgtacttcactctcacctatcgtatagccctgcgtagcgtagaacggtacgcggtaccttagtttaatttacgttacgtactaaactaatttacttttaagtaacctttacctaacttaccttaaccggttttccggggtacgggtaaccgggtaaccggtaaggaaacggttaagacgtaagttaccgaaaacggttaacgtaagggtcggtacgtacgacctaacgtaacgttccgttacggttacctttccgtatttacccccg

SEQ ID NO: 58318 - DNA, 723 bp, Homo sapiens
  misc_feature: GYAE6OF02IFEQA.44.39.D06.1.454.CMB.1.raw
  modified_base (194)..(194): a, c, t, g, unknown or other
  misc_feature (194)..(194): n is a, c, g, or t
  modified_base (237)..(237): a, c, t, g, unknown or other
  misc_feature (237)..(237): n is a, c, g, or t
  modified_base (713)..(713): a, c, t, g, unknown or other
  misc_feature (713)..(713): n is a, c, g, or t
tcagacagtatatacacgaccggtgctcgatttagtgacatctcgcagttctttggggacaacaggcaggcaggggcagcaagatggtgttgcagacccaggtcttcatttctctgttgctctggatctctggtgcctgcggggacatcgcgatgacgccagtctccagactcctggctgtgtctgtggcgagngggccaccgtcaactgacaactccagaccaaagttgtctttancgtacccaatacgtaaagaacttattaacgccgttaggtaaccaacgtaacggaaaacccgggacacgttactaacccgttaaaacttttaccgtttctttttaacgttcggggactaacgttactaacggtcggggtaaccggttcccggggttaccccttacggaaccgtaacgtttacgacgggtcggggccgggtaccggggtcgtacggggtaaccaacgttactttaccgacttacctcccgaacctactccgaagttacgtacctacggtccgaaggtaccgtaggaaacgtaccggttcgggaattacgttttaatttacgttagtacccaaagtttaacttaattttaaccgaacttccgtatacgtaccgtttcgggacggacgtaaccgagtaagtagaacgtacaaccgtaaagaacgttggtaacgtcgtagtaaccaccgtacttccgtcgtacctttaccncgttaccccg

SEQ ID NO: 58319 - DNA, 574 bp, Homo sapiens
  misc_feature: GYAE6OF02GH06B.44.39.D06.1.454.CMB.1.raw
  modified_base (231)..(231): a, c, t, g, unknown or other
  misc_feature (231)..(231): n is a, c, g, or t
tcagacagtatatacacgaccggtgctcgatttagtgacatctcgcagttctttgggggggatctcaggaggcagctctctcggaatatctccaccatggcctgggctctgctcctcctcaccctcctcactcagggcacaggatcctgggctcagtctgccctggctcagcctccctcgtgtccgggtctcctggacagtcagtcaccatctcctgcactggaaccaacngtgacgtcggtcgttttgaccgtgtctcctggtaccagcacgaccccagaaaccacgacccccaaatcattattatgcgtcaatcgttccgcccttcggtcgtcccctgacgccgtcttctcgtgggtaccaagtctggacaacgccggtccctccctgacccatcctcgtcggtcctccgaggtctggacggacgaggctgtattacttactgcagtctactatactacgaaggtacgggtaaaccttacgtttaactacgttccggcgacgacggaccaagcgtacgaccgtcgtacggtcacgacccgtacggtcctaccggcccctacggtcctacccg

SEQ ID NO: 58320 - DNA, 241 bp, Homo sapiens
  misc_feature: GYAE6OF02FTYZP.44.39.D06.1.454.CMB.1.raw
  modified_base (221)..(241): a, c, t, g, unknown or other
  misc_feature (221)..(241): n is a, c, g, or t
tcagacagtatatacacgaccggtgctcgatttagtgacatctcgcagttctttggggagaggaactgctcagttaggacccagacggaaccatggaagccccagcgcagcttctcttcctcctgctactctggctcccaggaactgtggctgcaccatctgtcttcatcttcccgccatctgatatatacgtgtctgagcgggctggcaaggcgcatagnnnnnnnnnnnnnnnnnnnnn

SEQ ID NO: 58321 - DNA, 755 bp, Homo sapiens
  misc_feature: GYAE6OF02FZNRO.44.39.D06.1.454.CMB.1.raw
  modified_base (234)..(234): a, c, t, g, unknown or other
  misc_feature (234)..(234): n is a, c, g, or t
  modified_base (392)..(392): a, c, t, g, unknown or other
  misc_feature (392)..(392): n is a, c, g, or t
tcagacagtatatacacgaccggtgctcgatttagtgacatctcgcagttctttgggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactacggaaccaacngtcgacgttcggttcgtttagaccgtgtctcgtggtaccagcacgaccccaagaaccacgaccccctaaatctaagtttaatttatcggtacggtactaagttcgttaccgtccccgtttccggttcgttaccccgtggtacgtccgtaccgttttcncggtttaccgggtacccgtaaagttccgtacgggaccaaaccggtacccggtaccccttcccgtaccgtaccctactccgttccgttcgggtccctccggtacgggtctaggtacgggaccggtaggtctacggttaatttaacgtaccgttcgaacgtcgtcctaacgtaacttaacgtaaccggttaagggttaacggttaaacccttacgttttaaacgttaccgttacccggaccggtaacggaacggggtaacccgtaacgtccggttaaccgtacccggttacccgtaaccggaaccgtaaccggtacccgaacggtacccgtcccggtaaccccccgtcgggttacccttacccgg

SEQ ID NO: 58322 - DNA, 710 bp, Homo sapiens
  misc_feature: GYAE6OF02H8SYF.44.39.D06.1.454.CMB.1.raw
tcagacagtatatacacgaccggtgctcgatttagtgacatctcgcagttctttgggggggggtctcaggaggcagcactctcgggacgtctccaccatggcctgggctctgctcctcctcaccctcctcactcagggcacaggactccgtgggctcagtctgccctggctcacgcctcccgtccgtcgtccgggtctccgtggacagtcacgtccacctattcctcctcgacctacgtacggaaaccaacgtaggtcgtacggttccgggttacgttttcgaccggttcgttcctccgtacggtaccacgtacaccgaaccccgaacgaaaccaccgaccccctaaactctaatttaattagtcgtcgtactattcgtaccgtcccttcggtcaccgttgcgtcgtctcgtcgtgggtacctacgtctacggacaacgtaccgtcccctccgacgtacctacgttccgtaccgtcggtcctaccggacgtcgtaggacggacggtagtcgtagttaacttagttacgtgactcgactagactaaacgtacgtaaaggttaacggtacctttaacgttaacgtacgggtcgtaccggacgtaaccgggacgtaccgtacgtaccggtaacccgtcgttaacgggcctaaccggtacccgaacggttccctacccggtccccgtcgtaacccgtcccgttacgttccccgg

SEQ ID NO: 58323 - DNA, 792 bp, Homo sapiens
  misc_feature: GYAE6OF02JQK37.44.39.D06.1.454.CMB.1.raw
tcagacagtatatacacgaccggtgctcgatttagtgacatctcgcagttctttggggacaacaggcaggcaggggcagcaagatggtgttgcagacccaggtcttcatttctctgttgctctggatctctggtgcctggcgggacatcgcgatgacgccagtctccagactccctgctgtgtctcgtgggcgaggagggaccaccgtacaactcgaccaactccgaacgccgtaaaaggttcgttaccttttatccgtacccaattagtaaacgtaacttattacgtaccttacggtaaccaaacgtaacggaaaccggaactacggtaccttaccttaaaattcctttacgttttacgtacgggccttaattaccgtaccggtacgggtaccggttcccgggtacccgtcgtaaccgtattccgaggttcggacgggttcgggttacgtcgggaacgttaccgtacttacctccgttacctacctaccggtataccgtaacggtaccgtccgtacgaccggtacggaaccgttaggtaaaccggtacggtacggttaaccgttaaggttttaacgtttagtttaacgttaccgtaaaaccttaaaggtttaacttttaccgtaacctttaccttaacgttcctttaaccgggttacgggtaaccggtaacgggtaccgtaaaggtaacggttaaccgtagaacgttaacctaaacgggtacgtaggtccggtaccttacggttaacgaacccgtacgttccgttatttcccgtaagttccctttaacccg

SEQ ID NO: 58324 - DNA, 582 bp, Homo sapiens
  misc_feature: GYAE6OF02FRGAI.44.39.D06.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (538)..(538): a, c, t, g, unknown or other
  misc_feature (538)..(538): n is a, c, g, or t
tcagacagtatatacacgaccggtgctcgatttagtgacatctcgcgagttctttggggacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtnaactgcaactccaacaagtgtcttttangtccccaatagtaagaactatttacgctggtaccaacagaaaccgggacagtctctaaattactctttattggctatctactcgggagttccgggtcctgaccgattcagtggcggtcggtctgggacactactttcacttcgtcacctagtacacgtacgcctgacacggctagaacgacggtcgcgtagtttattattgtacctaaagtaattaagttttacgaaccttccgttatacgtacttttaccgggacggtacgggtaccaaggtagttaagagtactacgtaaacgacgttagnggtacctagtaccacgtatcgtagttcctctacgttcctacccg

SEQ ID NO: 58325 - DNA, 744 bp, Homo sapiens
  misc_feature: GYAE6OF02IOYOF.44.39.D06.1.454.CMB.1.raw
tcagacagtatatacacgaccggtgctcgatttagtgacatctcgcagttctttgggggggggtctcaggaggcagcactctcgggacgtctccaccatggcctgggctctactcctcctcagcctcctcactcagggcacagggtcctggggactgtctaccctgactcacgcccgccctcagttcggtccgggtactccgttggtcctaggtccggtccacctattccttcttcgtttcttccagccgactaacttccacgtcggtaccctttaaagtctctatcagtggtaacgcaggtcggtccccgggccgacgacccccaagtccttctttacgaccgttcctttcgcgggtcttcggcacgtcccgtggtccgtttttcggccttcgtagtttctcgaccacggtccggtccctcctgacccataccacctaaacctccgcgtagacggtatcgggacgtcgttacgtacttttaccgttttgttacggtacgtacgtactttactttcggtaacttccgttaacttaacctaaagtttacgttacgttcgtttacgggtaacggttccggggtaacccgtcggttaccgaccgggtccgttccgtacgtcccgtcgtaaacccggtacccgaaccggacccctaaacccctaccgttacggttacccactttcccgttacccgttacccctaccccgttacttccctttaaagtaccgtttaccgttagtttccgg

SEQ ID NO: 58326 - DNA, 944 bp, Homo sapiens
  misc_feature: GYAE6OF02HM81Q.44.39.D06.1.454.CMB.1.raw
tcagacagtatatacacgaccggtgctcgatttagtgacatctcgcagttctttggggggggatctcaggaggcagctctctcggaatatctccaccatggcctgggctctgctcctcctcaccctcctcactcagggcacgaggactccgtgggcctcagtcgtcgcccgtggctacgacgtccctcccgtccgtcggtccgggtcctccgtggactgtcacgtccaccactcctccgtcgctacgtacggaaaccacgagtcggaccggttcgggtttcggtttcggacccggttcgttccgttccgttacgggtaccacggaccgtaacccgaaacccccgaaaggaaacccgaccccggaaacccccctaaacttaccttaaacgtttttaacgttttaacggtccggtaccggttaactaacggtttccggtttccccggtacccgtttccgggtaccgttcccgtaggtaccgtccgttaccgtttcgtccggttccgggtaacctaacggtccgtacggacctaaaccggtcccgtccccttccgtaccgtaactccgttaccgtccggtacgggtccctaccggtacggtccggttacgggaaccgggacggtcgggtaacttacggttaacgtttaccgttaccgtggtaccgttacgacttaacggtaaacttaacggttaaaacgggtaaccgggttaaccgggttaaacctttaacccgtttttaaacgggtacccggttaccgggtaacccggtaacgggtaacccggggaaacccgtaaccgggttacccggttaaacccggttaaccccgggttaaccggttaacccgggtaacccggtaaccccgggttaaccccgggttaaccgggttcccccggtaaccccccggggtttccccccgttacgggggttaaccccctttaccccggg

SEQ ID NO: 58327 - DNA, 964 bp, Homo sapiens
  misc_feature: GYAE6OF02HZGD2.44.39.D06.1.454.CMB.1.raw
tcagacagtatatacacgaccggtgctcgatttagtgacatctcgcagttctttggggggggtctcaggaggcagcgctctcgggacgtctccaccatggcctgggctctgctgctcctcactctcctcacccgaggacacgacgggtcctcgggcccagtcctcgccctgacctcgacgcctcgcctccggtcgtcgtcgggtccgccgtggaccgtcgttccggtccaccgtatccgtccgttagccctaagttcgggacgacctaacgggtaccggttaactaacgtttacgttacggtttaaccttttaaccgttttaacggttttccgtaacccgtttgggtaactttaacccgaaaccttaacgttaccttaaccgttacccggttaaaacgggtttaaaaaccccgaaacccccccgttaaaacctaccgtaacctaccgttaaacttaccgttaagtaccggaacggttaaccctaaaggttaaaccgggaacccggttacccggttaacccggttaaacgggggtttttaacttaaaccgtcggtttaccctttacctaaccgggtcgttaccccggtaacccgttaaaccgggaccccggtttaccggaaaaccccttaaacccggggtcccccgtttaaccgaacccgggtttaaacctaaaccggttttaccgtcccgggttaccgggtaccccgtttaacccgggaccgtttacggggtaacggtaccgggggttaaacgaccgggtttacgggttaacttacggtttttaaattacgtttcgggttactacggtactacgttaccgtcgtttccggtacctaccgtacttaccggtccttttaaagtccggtttaccgtaacgggtacgggacggttaccgaacggtcctaccgggttactacgggtacaccggaacccggtacccgaaccgtaccctcggtacgtaccc

SEQ ID NO: 58328 - DNA, 831 bp, Homo sapiens
  misc_feature: GYAE6OF02I05VI.44.39.D06.1.454.CMB.1.raw
tcagacagtatatacacgaccggtgctcgatttagtgacatctcgcagttctttgggggggggtctcaggaggcagcactctcgggacgtctccaccatggcctgggctctactcctcctcagcctcctcactcagggcacagggtcctgggactgtctacctgactcagccgcctcagtgtccgggactcctggtcaggtcggtcacctatcttctcgttcttccgagccgactaacttccacgtcggtacccttttaaaagtcctactactcctaagtcggtacgtacgaaggtcgggttccccgggaccgaccggacccccctaaaggttcccttacgttttaccggtacgtttaccctttcggccgggttccgttcggcgtacgtccccgtcgggttcccgtttttccggcccttccgtacgtttcgtccgtacccacggcccggtccctacccgtcggtacccaacttaccgaaccctaaaaccggttcccggacctacggtaacgggtaactacgggacggtacgttacgttaaccgttttaacgttttcgggtttcggtcgttaaacctaatttaccggtttacgttaccttaccgtacgttaactaaaacgtttactttcggttaccgtttaacggggtacgggttacgggtacccggtacgttacggacggttcccgtaaccgttcgccgttaccgaaccggtacccaaaccgggtaccccaaaccccgtccgttcggttacccctaccggtttaccgttacccggttccccgtaaccccctttcgttaccgtaaccttaccgtttaccggtcgtttaccgg

SEQ ID NO: 58329 - DNA, 755 bp, Homo sapiens
  misc_feature: GYAE6OF02JKCNR.44.39.D06.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagacagtatatacacgaccggtgctcgatttagtgacatctcgcagttctttgggggggatctcaggaggcagctctctcggaatatctccaccatggcctgggctctgctcctcctcaccctctcactcaggcacaggatccgtgggctcagtctgccctgctcacgccctccctccgtgtccggtctccgtggacagtcacgtcaccatctccngtcactcgaaccanagtgacgtcgttctttgaccgtgtctccgtgtaccagtcacgacccaagaacaccgaccccaatctaactttattacgtgaccggtactaacttcgttcccgtccccgttaccggtccttcccgtaggtaccgtccggtcctttcctccggttacggtcctaacgttcgtacggaccaaccgtacccgtccgtccctacggacccttactccgttcgtacccggtcctaccggtccggacgttacgggacggtacggcggtacgtacggttaacctttaacgtaccgtacgtccgacgtaccttacgtaacttaacgtaaccgtaaacgggttaccggtaaaccgtttaccttttaacgttaccggtttacccggaacccgttacgggtaacccgggtacgtaaccggttccggttaacccggttacccgttacccgggttaacggttacccgtaacccggtaccggtaacccggttcccgtacccccggtttacccccggttcccggtaacctttcccccgg

SEQ ID NO: 58330 - DNA, 806 bp, Homo sapiens
  misc_feature: GYAE6OF02IHH6A.44.39.D06.1.454.CMB.1.raw
  modified_base (588)..(588): a, c, t, g, unknown or other
  misc_feature (588)..(588): n is a, c, g, or t
tcagacagtatatacacgaccggtgctcgatttagtgacatctcgcagttctttggggacaacaggcaggcaggggcagcaagatggtgttgcagacccaggtcttcattttctctgttgctctggatctctggtgcctgcggggacatcgcgatggagcctagtcctaccacggccttccctggtctgtcgtctcgtgggcgaggagggcccaccggtaccaactcgactaacctaccacgacccaaagttcgttacttttaacgtaccgtaaccctaagttaacggtaaaacgtaaacgttaacgttttaacggtaccgttacgtaaacccaaaccggtaaaccggaaaacccggggaacgtacggtttaccttaaccccttaaaacttttaaccttttacgtttttaggtttacgggttactaacttccgttaacgtaccggggttaacggtccccggggttaccctcggtaaccggtactttcgacggtcggtacggggtcgggttacggacgggtaacttacgaacttttccgaaccttacctccgtaaccgactacgtacgtacgtaccgtagccgtaggtntacggaagtacgggtacacgtttagttacgtttatacgtactaaactaaactttatttaaacgtaccttaccttacgttaccgtaacgtttccgggaaacggtacggttaaccgaagttaaacgtagtaacgtaataaccggaaacgtaacggttacggacggtacctacgtaacgtacctacggtttccttacggtcctttaccgtctttaccccgg

SEQ ID NO: 58331 - DNA, 762 bp, Homo sapiens
  misc_feature: GYAE6OF02HY2G4.44.39.D06.1.454.CMB.1.raw
  modified_base (109)..(109): a, c, t, g, unknown or other
  misc_feature (109)..(109): n is a, c, g, or t
  modified_base (528)..(528): a, c, t, g, unknown or other
  misc_feature (528)..(528): n is a, c, g, or t
  modified_base (545)..(545): a, c, t, g, unknown or other
  misc_feature (545)..(545): n is a, c, g, or t
tcagacagtatatacacgaccggtgctcgatttagtgacatctcgcagttctttgggggggatctcaggaggcagctctctcggaatatctccaccatggcctgggctntgctcctcctcaccctctcactcagggcacaggatccgtggctcacgtctcgccctggctcacgtccctcccgtcgtggtcccgggtctccgtggactacgtcagtccacgatcctcctgactacgtacggaaaccctaagtcggttcgaccggttcggtttacggttttagacccggttgtccttccgtacgtaccacgtccaaccgaaccccgtaagaaccacccgtaccccaaattctaagtttactttacgcggtacggtactaacgttcggttacccgtaccccggtttcgttacgtccgtacggtcggtaccttccgtttacgtcgggttaacggtcccgtaacggtcggttaccgaacgtaaccgcccgtacccgtccgtacgtacctcgttccgtacgtcggtacaccggnggtcgaggacggtacgngtaccgtataagtttaacgtcgtcgtaactacgtactactaagtaactaaacggtacgggtaaacttacgttaaccttacgtttacgtaccgggaagttaccggaacgtaaccgacggtacccggtaacgttccccggtaacgtaccggtaacccgtaccgtaacccgggaccgttacccggtaccccgtaccccgttccgggttacccttacccgg

SEQ ID NO: 58332 - DNA, 839 bp, Homo sapiens
  misc_feature: GYAE6OF02HSMWY.44.39.D06.1.454.CMB.1.raw
  modified_base (675)..(675): a, c, t, g, unknown or other
  misc_feature (675)..(675): n is a, c, g, or t
tcagacagtatatacacgaccggtgctcgatttagtgacatctcgcagttctttggggggggatctcaggaggcagctctctcggaatatctccaccatgcctgggctctgctcctcctcaccctcctcactcagggcacaggactccgtggctcagtctcgcctggctcacgccctccctcggtcggtccggttctccgtcggacgagtcacgtccactatcctcctcgactacgtacgaaaccaacgtaggtcgtaccggttcggttcgttttcggaccggttcgttccgtaccgttacggtaacccagtaccgaaccggaaaccccctaacggaaaaaccctaccccgtaaacccccctaaaagttcccgttaaactttttaacgtttaaccggtacgggtaaccggttaacttaacggtttacggtttccccgttccccggtttaccgggttccgttacccgtgaccgttcgtcccgttttccgtacgttaccggggtacctaacgtttcggtacggtaaccctaaccggaccccgggtaccccgttaccctaccggtacctacgtttacccgtcggtaccgggtaccgtcccggtaggtcggtacgggaacgggtacggtacggttacgtacggttaactttacgttacgcggtaaccgctaccgttaanaaccgttaacgttaacggtaacggttaacgtaacctttaaccgttacggttaccggttacggaccgtaggaacccggtacgaacgtaccgtaccggtacccgtaggtaccgaccggaaccggtaccgtacggcccgttcccggcccgttacggtaccttcccgg

SEQ ID NO: 58333 - DNA, 755 bp, Homo sapiens
  misc_feature: GYAE6OF02F2U89.44.39.D06.1.454.CMB.1.raw
  modified_base (186)..(186): a, c, t, g, unknown or other
  misc_feature (186)..(186): n is a, c, g, or t
  modified_base (222)..(222): a, c, t, g, unknown or other
  misc_feature (222)..(222): n is a, c, g, or t
tcagacagtatatacacgaccggtgctcgatttagtgacatctcgcagttctttggggacaacaggcaggcagggcagcaagatggtgttgcagacccaggtcttcatttctctgttgctctggactctcgtggtcgcctggcggggtacatcgcgatgagccagtctccagtcctcctggctgtntctcgtggcgagacggccacgtcaactgacctaacnccagacctaaagttgttaccttttagccgtaccctaagtaagtaacgtaacttagtttacgaccttacggtaaccaaacgaacgggtaaacccgggactaacggttaccttaaacccgttaaacttttaccgtttacgttttacgtacgggtactaactttaccgtaccggttacggggtaccggttcccggggtcccttacgggtaccgtattaccggtaggtcggggtccggggtccgggtacggtacgggaacctacgtttactttcgtaccgttacgaccgtacctaactcgtaacgttacgtccgtagtcgaacgtacgtggaaacgtcggtcgtacgttagtttattagttacgtaacttaaacgttattaacgtttaacaaccgtttctaaccgttcgttaaccgttcgggtaccgggtaacgtaaccgtaaggtaacgtaagggtcaacgtaaccggaaccggttaagcggttacggtacacgtacccgttagtaccttcggtacttaccgtatacccgttcccg

SEQ ID NO: 58334 - DNA, 649 bp, Homo sapiens
  misc_feature: GYAE6OF02JLRJH.44.39.D06.1.454.CMB.1.raw
  modified_base (489)..(489): a, c, t, g, unknown or other
  misc_feature (489)..(489): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (632)..(632): a, c, t, g, unknown or other
  misc_feature (632)..(632): n is a, c, g, or t
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacgagggtcctgggcccagtctgccctgactcagcctgcctccgtgtctgggtactccgtggacagtcgatctaccttctcctgccactaggcctcagcaggtgagtactactaacttctaatcgtccgtccttccgtcggtccggacctaaacgcccggtccctacccgtagaactactcgtcgttcggcctccacgtccgtacggacggaacggtcggtaaacgttaaaatttctttccgtacgtttccaactaacttactacgtacgttcggttttaggttcgggtttgtacgtttccgggcgggtacgggtaccggtagtaccggtacccggtacgtgggttaaccncggtacccgacggccgttcccgtcccccggtcgtcctaccgttcggtcccgttccccgtcccttactacttactacgttacgtcgttacgcggtccggacggtcgtcgtaccggtagcccgtagacgtacgngtancgngtgngcncgcncnctcgtntn

SEQ ID NO: 58335 - DNA, 751 bp, Homo sapiens
  misc_feature: GYAE6OF02IBPMG.44.39.D06.1.454.CMB.1.raw
tcagacagtatatacacgaccggtgctcgatttagtgacatctcgcagttctttgggggggggtctcaggaggcagcgctctcgggacgtctccaccatggcctgggctctgctattcctcaccctcctcactcagggcacagggtcctgggcccagtctgccctgactcagcctgcctccgtgtctggtcacctggacagtcgactcacctatctcctgctagttggacgccaggacggttaattattcttacgttactttaacttttcgtccttccgtggttactacaactatactactaccgaacggtaaaccgacccccaaactccactactacttactaatacggaccggtactaacgtaacggaccggtaccccgtacgggttaacggggttttactaaacgttccgtactttacctaacgtccgtacccttacccgaaaccggttcccggaacctaacccgtacccggtccccgtaccctacgtaacctaacttaccgtccgtcgggtaccgtaccgtacggtcggtacggacgggacggacggtacgtagttaagtttatttacgtttgttacgtctcgtagtagttcgttcgtcgtactacttacttacttagttcgttcgttacggtacgggtacgggtacggtaaccggtaccgtaccggttaccgttaccggtaccgtaccggacccggaaggtaaccccccccccccccccccccctaacgtacccgtaccgtacccg

SEQ ID NO: 58336 - DNA, 638 bp, Homo sapiens
  misc_feature: GYAE6OF02GQOJD.44.39.D06.1.454.CMB.1.raw
  modified_base (158)..(158): a, c, t, g, unknown or other
  misc_feature (158)..(158): n is a, c, g, or t
  modified_base (571)..(571): a, c, t, g, unknown or other
  misc_feature (571)..(571): n is a, c, g, or t
  modified_base (590)..(590): a, c, t, g, unknown or other
  misc_feature (590)..(590): n is a, c, g, or t
  modified_base (608)..(608): a, c, t, g, unknown or other
  misc_feature (608)..(608): n is a, c, g, or t
  modified_base (614)..(616): a, c, t, g, unknown or other
  misc_feature (614)..(616): n is a, c, g, or t
  modified_base (619)..(623): a, c, t, g, unknown or other
  misc_feature (619)..(623): n is a, c, g, or t
  modified_base (625)..(626): a, c, t, g, unknown or other
  misc_feature (625)..(626): n is a, c, g, or t
  modified_base (630)..(630): a, c, t, g, unknown or other
  misc_feature (630)..(630): n is a, c, g, or t
  modified_base (632)..(634): a, c, t, g, unknown or other
  misc_feature (632)..(634): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
tcagacagtatatacacgaccggtgctcgatttagtgacatctcgcagttctttgggatgatgataaacgttacagtccaagtccttagtcttaaaagcagactcgacatcaccaaggactccgacgagaaccaggttgtcctgacactgaccttcgngacctcgtagacacgaggcacgtatatttcgtgtgaccactacactcgtgttcgttcgggggctttgtactacgttgggaccgaggactccgtcggtccccgtgttcgtacgcgtcctaccgaccgaaccgggccctaagttccggtcccttcccccgtacggtaccgtaccccctaccgtacccaagtaccgtacccgtaacctccgggtcgggggaacctccgtaaccgggtcccggtccggtcggggtccctaccgggccgttacggtacgaaacggttcctaccgtttctaacgttctaacgttcgtacggtaggtacgggtccggtacggtacgaccggtaaacggccgtaacggttccggagagggtccctaaggtcacggttcaagccgtttaaagcacggctaancgtcgagcttagcacttgntacgtgctgacccgtgcntcagcnnnacnnnnncnncgcncnnncntn

SEQ ID NO: 58337 - DNA, 536 bp, Homo sapiens
  misc_feature: GYAE6OF01C0LFC.18.19.B08.1.454.CMB.1.raw
  modified_base (509)..(509): a, c, t, g, unknown or other
  misc_feature (509)..(509): n is a, c, g, or t
  modified_base (523)..(523): a, c, t, g, unknown or other
  misc_feature (523)..(523): n is a, c, g, or t
  modified_base (530)..(530): a, c, t, g, unknown or other
  misc_feature (530)..(530): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggagtgataataagcgctacagcccatctctgaagagcaggctcaccatcaccaaggacacctccaaaaaccaggtgtccttacaatgaccaacatggaccctgtagacacaggcacatattactgtgcacacaggcgtgatacttatagtgaatacgtcgggggctttgactacgtggggccaggggaccctggtcaccgtctcctcagccctcaccgaacgggcccagtccggtccttcccccnggcccacccctccncccaagngtaccc

SEQ ID NO: 58338 - DNA, 587 bp, Homo sapiens
  misc_feature: GYAE6OF01AZ12F.18.19.B08.1.454.CMB.1.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacaaagaccctcacgctgacctgcaccttctctgggttctcactcagcactagtggagtgggtgtgggctggatccgtcagcccccaggaaaggccctggagtggcttgcactcatttattggagtgataataagcgctacagcccatctctgaagngcaggcctcaccatcaccaaggacacctaccaaaaaccnggtgtcctaacaatgaccaacatcggaccctgtagacacaggcacatattactgtgcacacaggcgtgattacttatagtagaattacgtcgggggtctttggacttacgtcggggccaggggaaccctgggtccaccgtctcctcacgtccctcccgaaccgaacggggcccctaagttcccgggttccctttacccccccgtggcccctacccccttcccttaaccccaaaggtccgcctaccccgg

SEQ ID NO: 58339 - DNA, 561 bp, Homo sapiens
  misc_feature: GYAE6OF01BJWWD.18.19.B08.1.454.CMB.1.raw
  modified_base (337)..(337): a, c, t, g, unknown or other
  misc_feature (337)..(337): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggagtgataataagcgctacagcccatctctgagagcaggctcaccatcaccaaggaccacctaccaaaaaccnggtcggtaccttacaatgaaccaacatcggaccctgtacacacaggcacatatactgtgcacacaggcgtgatacttatagtgaatcgtcggggtcttgacgtacgtggggccaggggtaccctggtcaccgtctcctcacgccctaccgaccgacgggcccagttcccgggtccttccccccgtggtccccacccccgttccttacccgaacggtcgtacccg

SEQ ID NO: 58340 - DNA, 638 bp, Homo sapiens
  misc_feature: GYAE6OF01ANEYU.18.19.B08.1.454.CMB.1.raw
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggatccgtcacgcccccaggaaacggccctggagtggcttgcactcatttattggagtgataataagcgctacagcccatctctgaagagcaggctcaccatccaaccaaggaccaccctaccaaaaaccgaggtcggtacctaacaatacgaaccaatactcggacctagtacacacacgacacatattactgtcacacacgagcgtagaacttacttatagtagtaacgttacggtcggggttacgtttcgaaccgtacggtacggggtaccgaaccggggtacccgttcgggtaccgtaacccgttcctacccgtccgaccgtccccacccgaaacccggtaccgggcccctaacgttcccggttaccccttcccccgtcggtacccctacccccgtaccctacccgaacggccgtaccccgg

SEQ ID NO: 58341 - DNA, 739 bp, Homo sapiens
  misc_feature: GYAE6OF01A930L.18.19.B08.1.454.CMB.1.raw
  modified_base (367)..(367): a, c, t, g, unknown or other
  misc_feature (367)..(367): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacacgaccctcacgctgacctgcaccttctctgggttctcactcagcactagtggagtgggtgtgggctggactccgtcacgcccccgaaggaaacggcccgtggagtcgggcttgcactctatttagtggagtgaataataacgcgactacacgccctatctctagaagacgcacggctcaccataccaaccgaaacggaccaaccctaaccgaaaaaccgnggttacggtaccttaacgaatacgaaccaacgacgtacggaccctagtaacgaccacgacggacaacattaacttacgtagacgaccaacgacgaggtcgtaacgaattaacgttagtaacgttaacgtaaagtaccgggttacggggttcgtttaacgaaccggttaaccgggcgggggtaacccctaacgggggtaaccccgttcgggttacccgtaacccggttccctcccgttacacccggtacccttaccccgaaccccggaaaccgggtccccttaaaccgggtccccggtttccccttaccccccgggtaccggtaccccgtacccccgttacccgtaacccgtaaccgggacccgtaacccccg

SEQ ID NO: 58342 - DNA, 533 bp, Homo sapiens
  misc_feature: GYAE6OF01DTABH.18.19.B08.1.454.CMB.1.raw
  modified_base (388)..(388): a, c, t, g, unknown or other
  misc_feature (388)..(388): n is a, c, g, or t
  modified_base (468)..(468): a, c, t, g, unknown or other
  misc_feature (468)..(468): n is a, c, g, or t
  modified_base (507)..(507): a, c, t, g, unknown or other
  misc_feature (507)..(507): n is a, c, g, or t
tcagtacgagtatgcacgaccggtgctcgatttagtgagtcagtaagggtctgtgtgggtttcaccagcgtaggaccagactccttcatgggtccttgtcccagatcaccttgaaggagtctggtcctacgctggtgaaacccacacagaccctcacgctgacctgcaccttctctgggttctcactcagcactagtggagtgggtgtgggctggatccgtcacgcccccaggaaaggccctggagtggcttgcactcatttattggagtgataataagcgctacagccatctctgaagagcaggctcacatcacaagacactaccaaaacagtgtctacatagaccaacatcgacctgtagacacagcacatattactgtgcacacnggcgtgatacttatagtagaagtacgtcggggtctttgacgtacgtcggggcgacgggtaccctggtcaccgtctcctcncgccctccacccgacggcccagtcccggtccttccccgnggccctacccctccaccagcgtaccc

SEQ ID NO: 58343 - DNA, 554 bp, Homo sapiens
  misc_feature: GYAE6OF01A63I1.18.19.B08.1.454.CMB.1.raw
  modified_base (335)..(335): a, c, t, g, unknown or other
  misc_feature (335)..(335): n is a, c, g, or t
  modified_base (390)..(390): a, c, t, g, unknown or other
  misc_feature (390)..(390): n is a, c, g, or t
  modified_base (529)..(529): a, c, t, g, unknown or other
  misc_feature (529)..(529): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggagtgataataagcgctacagcccatctctgaagagcaggctcaccatcacaaggacacctaccaaaaacnggtggtaccttacaatgaccaacatggaccctgtacgacacaggcacatattacngtgcacacaggctgaatactatagtcgaatacgtcgggggctttggactacgtggggccaggggtaaccctgggtcaccgtcgtcctcgacgtcctccaaccgaagggcccccagtccgggtccttccccctgggcccncccctggacccttcccgaggtaccc

SEQ ID NO: 58344 - DNA, 574 bp, Homo sapiens
  misc_feature: GYAE6OF01EMO7C.18.19.B08.1.454.CMB.1.raw
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctggttctcactcagcactagtggagtgggtgtgggctggatccgtcacgcccccaggaaggccctggagtggcttgcactcatttattggagtgataataagcgctacagcccatctctgaagngcaggctcacatcacaagacacctaccaaaacngtgtactacaatgacaacatcgacctgtacacacgacgacacatattactgtgcacacagcgtagatacttatagtagtaagtacgtcggggtcgttagacgtacgtagggaccgtacgggtaaccgtcggtaccaccgtctcccgtcgacgcccgtaccacccggaacgggaccctacgtcccggttcccgttccccccgtcggtaccccaccccttccccgtaccgaaccgcggtaccccg

SEQ ID NO: 58345 - DNA, 854 bp, Homo sapiens
  misc_feature: GYAE6OF01EE6NX.18.19.B08.1.454.CMB.1.raw
  modified_base (277)..(277): a, c, t, g, unknown or other
  misc_feature (277)..(277): n is a, c, g, or t
  modified_base (344)..(344): a, c, t, g, unknown or other
  misc_feature (344)..(344): n is a, c, g, or t
tcagtacgagtatgcacgaccggtgctcgatttagtgagtcagtaagggtctgtgtgggtttcaccagcgtaggaccagactccttcatgggtcttgtccagatcaccttgaaggagtctggtcctacgcgtggtacgaaacccacacacgaccctcacgctacgacctcgacctccttcttcgtgggttctcactcacgctacgtaggtggaggtggggtggtgggcgtggtactccggtcaccgacccccggaaagggtaaccggcccgtagggnggtcgtccgttacggactacgtcttaattttcgttaggaagtgtaaataagtaggaccactacgacnccatcgtagtacgaagacgactacgcctacaacctctaaccgaaccgaacgactaaccccgtaaaccgaaaaaccgtcggttaccggtaactaacgtaacgtacgaaacctaaccaacgtccggaaccgttaacgtaacgaaccaacggtacggacctaactaactttaccgttacgtaacgtacggtacgaactaccgggacgggtaacgtacgttaaacttaacgtttaagtacgttaagggtaaccgtttaaccggggtaccggggtttacgtttaccgtaacggttaccgggggttaaccgggacccggttaaccgggtaacccgtttaccgggccggttacccgttccccgtttaccgaaccgtccccggtcccctaaacccggttaacccgggaacccgggtaacccgtacccggtttccccggttaccccttaccccccggggtcgttaccccccctaaccctttaccccggacccgtaaaccgggtacccgttacccccggg

SEQ ID NO: 58346 - DNA, 664 bp, Homo sapiens
  misc_feature: GYAE6OF01AX2TG.18.19.B08.1.454.CMB.1.raw
  modified_base (196)..(196): a, c, t, g, unknown or other
  misc_feature (196)..(196): n is a, c, g, or t
  modified_base (633)..(633): a, c, t, g, unknown or other
  misc_feature (633)..(633): n is a, c, g, or t
tcagtacgagtatgcacgaccggtgctcgatttagtgagtcagtaagggtcgtgtgtgggtttctaccagcgtaggaccagactccttcatgggtcttgtcccagatcaccttgaaggagtctggtcctacgctgtgaacccacacagaccctcacgctgacctgcaccttctcgtggttctcactcagcactagnggagtgggtgtgggctgggactccggtcacgccccccaggaaacggtcccgtggacgtggcgttgactctctatttattggagtgacgtaataaagcgtctaacacgcccctatctcgttaggaaagtgacgaacggctcccaacactcaacccgaacggtaccaacccgtaaccaaaaaccgaaggttcgtacccttaacgaaacgtacgaaccgaactaacgtcggaccctgtaacgacacgaggtcaacagttattacgtgtacgacactaacgacgtcgtaagtactacgtaatacgtagaactcggtacggggtaggtttacacgtccgtacggccggacggtacccggtgttaccgaccgtaccttccggaactccggtactccccgaacgtcccggaacgccgtcccggttacccttaccccgcccgttnaacccccggttcccactacgccgttaccccg

SEQ ID NO: 58347 - DNA, 717 bp, Homo sapiens
  misc_feature: GYAE6OF01C6C2H.18.19.B08.1.454.CMB.1.raw
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtgggagtgggtgtgggcgtggactccgtcacgcccccgaagggaaacggcccgtggagtggcttgcactctatttaagttggagtgaataataacgcgctacgacgacccatctcgtagaagagcgaggctaccaccactaccaaccgaacggaaccaccctaaaccgaaaaaccgtggtacggttaccttaacgaactaacgaaccaactaacgtaccggacccgtagacgtaacaaccggaggaccaactacttaactttcgtacgtcgaccaacgacgtacgggtacgtaacgtaattaactttagtaagtaacgtaacgttccgggggttacggggtacggttttacgtaacggttaccggtcggggacccgtaacggggttacccgtcggtaccgtacccgtcgttccctacgacctcccgtaccgacccggaaccgggccctacggttccccgtttaccccgtccccggtcgtacccccgttacccctaccgaacccaacgggtccgtaaccccgg

SEQ ID NO: 58348 - DNA, 752 bp, Homo sapiens
  misc_feature: GYAE6OF02G4QTC.18.19.B08.1.454.CMB.1.raw
  modified_base (221)..(221): a, c, t, g, unknown or other
  misc_feature (221)..(221): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggatccgtnacgcccccaggaacgccctggacgtggcttgcactcatttatggagtgataataagcgtctacagccccaatctcctgaagtacgcaggcctacgacccattcccaaccgtaacggacctacccgttaccgtaaaaaaccgcgggttacggtaccctttaacgaaacttcggaaacctaacgtacgttacgggtaaccctggttaaccgacctaccgtacgggacctacgtacgttaactttaccgtagttacggacctacgtaccgtacgggtaccgttacggtaacttacgttaagttaacggttcggtaaacgttaccggttacgggggtaccttttacggaaccgttaccgttacgggggacccttacggggaaaccccgttgggtacccttaaccggttccgttacccgttacgtaccggtccctaccgtaacccggaacgggtcccctaaggttcccggttacccgtttacccccgtagggtaccctaccccggttccctacccgtaacggtaccgttaccccgg

SEQ ID NO: 58349 - DNA, 557 bp, Homo sapiens
  misc_feature: GYAE6OF02I7OFI.18.19.B08.1.454.CMB.1.raw
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggagtgataataagcgctacagcccatctctgaagagcaggctcaccatcacaagacacctacaaaaccagtgtctacatgaccaacatcggacctgtagacacaggcacatattactgtgcacacaggcgtagatacttatagtagaatacgtcggggtcgttttgacgttacgtcggggaccgacgggaacccgttggtcctaccggtccctccgtcacgccctaccaccgaacgggcccagtcccggttccttcccccgtcggcccacccttcccaccctacggctacccg

SEQ ID NO: 58350 - DNA, 540 bp, Homo sapiens
  misc_feature: GYAE6OF02GZT86.18.19.B08.1.454.CMB.1.raw
  modified_base (335)..(335): a, c, t, g, unknown or other
  misc_feature (335)..(335): n is a, c, g, or t
  modified_base (390)..(390): a, c, t, g, unknown or other
  misc_feature (390)..(390): n is a, c, g, or t
  modified_base (535)..(535): a, c, t, g, unknown or other
  misc_feature (535)..(535): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggagtgataataagcgctacagcccatctctgaagagcaggctcaccatcaccaagacacctaccaaaaccnggtcgtaccttacaatgaccaacatcggacctgagacacaggcacatatactgtnacacacaggctagatacttatagtagaatacgtcggggtactttgactacgtggggccgagggaaccctggtccaccggtctcctcacgccctccgaccgaacgggcccagtccgttccttccccgtgcccaccctccctcacgngaccc

SEQ ID NO: 58351 - DNA, 707 bp, Homo sapiens
  misc_feature: GYAE6OF02J0QJ7.18.19.B08.1.454.CMB.1.raw
  modified_base (279)..(279): a, c, t, g, unknown or other
  misc_feature (279)..(279): n is a, c, g, or t
  modified_base (350)..(350): a, c, t, g, unknown or other
  misc_feature (350)..(350): n is a, c, g, or t
  modified_base (442)..(442): a, c, t, g, unknown or other
  misc_feature (442)..(442): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
tcagtacgagtatgcacgaccggtgctcgatttagtgagtcagtaagggtcgtgtgtgggtttcgaccagcgtaggaccagactccttcatgggtcttgtcccagatcaccttgaaggagtctggtcctacgctggtgaaacccacacacgaccctcacgctcgacctgcaccttctcctgggttctcactcagcactagtggagtgggtgtgggctgggactccggtcacgcccccaagggtaaacggccccgtagggagttcggctttggctacctntatttatggtagtgtataactaagcggtactacgaacgcccatctactaggacgagctaggctccgaccanccaccaacggaccaacctacccaaaaaccgacggttacggtaccttaccaaatcgaacctaacacttcggaccctagtaacgactaaaccgngacactatacttacgtcgtgtaccacgtacaaggtccgtanaacgttactaataggttanaaacgttacggtcgggggttagttaccgtaacgtaccggttaggggacccgaacgggtaacccggtcggtacctacccggtccttccgtacccaccgttcccttacccgtaacccggaccggtacctacggttccccggttacccgtcccccgttaccgggtacccctacccccttcccggttaacccgaccgtacccggtaccc

SEQ ID NO: 58352 - DNA, 652 bp, Homo sapiens
  misc_feature: GYAE6OF02JA9QL.18.19.B08.1.454.CMB.1.raw
  modified_base (188)..(188): a, c, t, g, unknown or other
  misc_feature (188)..(188): n is a, c, g, or t
  modified_base (417)..(417): a, c, t, g, unknown or other
  misc_feature (417)..(417): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcngcactagtggagtgggtgtgggctggatccgtcacgcccccaggaaacggccctggagtggcttgcacactatttttcgattgacgaaaaatcctacaacacatctctgaagaccagagtcaccatctccaaggacacctaccaaagccaggtgtccttacatgatcaacctcgaccctgcggacacacgcacatatttctgtgacgtacggttttcttactataaatntacgcagtcctcggtcggcctaagtttcgaccttccggacggggcctaggggaaccccttgggtaccctaccggttcttcccgtacgaccgttccttacccaaccggtaccgggtacccctaacgttcccccgggtttaccctttacccccccggtcggggtacccccgttccccgttaccggtccccgttaccccggaacggggtaccctacccgtaccccggttaaccccggg

SEQ ID NO: 58353 - DNA, 822 bp, Homo sapiens
  misc_feature: GYAE6OF02IAQVA.18.19.B08.1.454.CMB.1.raw
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggatccgtcacgcccccaggaaacggcccgtggagtcggcttgccgactctattttattggagtgataagtaagcgctacacgcccattctactgaagagcgaggcctacaccactaccaaccgtaaacggaacctaaccctaaccgaaaaaacccgtagggttaccgggttaccttaaaccgtaaacttacggaaccctaaaccgtaacgttacggaaccccgttaggtaaacgaaacccgaacggaacggtaccaaccgtaacgttaagtttaaaccgttcggtaccggaccaaaccgtaacggtaacgggtcgttacgtaagtttaccgttaaagttaacggttagtaaacgttaccgggttaccgggggggtacgtttttacggaaccggttacgggttaccggggaacccggtaccgggggtaaccccgttcggggttaaccctacccgggttcttacccgttaccgaccgttacccctaccccgtaccgggtaaacccgggtacccgtaccggttaccccggtttaccccggttcccccccgtaccggggtacccccttaacccccgtccccgtttaaccccgaacggtacccgttaaccccgg

SEQ ID NO: 58354 - DNA, 881 bp, Homo sapiens
  misc_feature: GYAE6OF02IV18D.18.19.B08.1.454.CMB.1.raw
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacacgaccctcacgctgacctgctaccttctctggttctcactcacgcactagtggagtgggtgtgggctggtactccgtcgacgacccccgaggaaacgccctaggagtcggcttgcactctatttagtggagtgtaataataagccgtctaacgacgtacccagttcctctacggaaagtcggacgtacggaccttcaaccgtaactaccgaaccgaaacggtaacctaacccgtaaaccccgaaaaaaccgtcggttaccggttaccctttaaaccgtaaacgtaaccgtaaacctaaaccgtaaacggttaccggtaaacccttacggtaaaccgtaacccgaaaccgacggaccgtaaacctagtttaaccgttaaacgttggtacgaccgtaaccgacgtaacgggttcgtaacggtaacttaaccttaagttacgggtaacgtaaacgttccgggttaaccgggggttaccttttaacggtaaccgttacccggggtcgggtaacccgtaaacggggggtaaccccctttagggtaaccccctaacccggggttcctaaccccgttacggaacccgtaccccggtttacccaaaccccgggttaaacgggtaccccccgttaaaccgggttccccggtttaccccccgtttccccgggttaaacccccggtccgttaacccccccgttaccgtttaacccccgggaaacgttaccccggttaacccccgg

SEQ ID NO: 58355 - DNA, 634 bp, Homo sapiens
  misc_feature: GYAE6OF02JHH8U.18.19.B08.1.454.CMB.1.raw
  modified_base (319)..(319): a, c, t, g, unknown or other
  misc_feature (319)..(319): n is a, c, g, or t
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (445)..(445): a, c, t, g, unknown or other
  misc_feature (445)..(445): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaaccacacagaccctcacgctgacctgcaccttctctgggttctcactcagccactagtggagtgggtcgttgggctggactccggtcacgtcccccgaaggaaaggcccctggacgtggcttggcactcatttagttggagtgataataagcgctacgagcccatctctgaagagcaggcncgcatcaaccgaagacacctaccaaaacncggtagtctacaactcgaaccacanacgaccgtgtaacgcacgacggcaacgaatagttactgacgtcaacgaccgaggcgttagacttaacgttanggtagtaacgtacgttcggggttacgttacggactaaccggtcggggaccgtaggggtaaccctgggtacctaccgggtccctccgacgtaccgacccgtaccgacccggaacggtcccaacggtttccgtaccccgttccccggtacggtccctaccccgttaccctaccgaacgttacccgacccgg

SEQ ID NO: 58356 - DNA, 647 bp, Homo sapiens
  misc_feature: GYAE6OF02G5R67.18.19.B08.1.454.CMB.1.raw
  modified_base (388)..(388): a, c, t, g, unknown or other
  misc_feature (388)..(388): n is a, c, g, or t
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggactccgtcacgcccccgaagggaaacggccctggagtggcttgcactctatttagtggagtgaataaataagcgactacacgccatctctagaagacgcacggctccaccactaccaccaacggaccaacctaaccaaaaaccgtacggtacgtaccttaacaactcaaccaanacgtacgacctagacgacacgacggacaactattactactgtacacctaacacgaggtcgtagtattaaccttagtaacgtagtaacgttaccgggttcggggttactttaggtaacgtaccgggtacgggtaccgtacgggacccgttcggtacctacccgtctccgactaccgtcccgtaccaccggaccggacccgttaccgtcccgttccccgtccccgtcgcccctacccgtacctaccggtagcccgtacccg

SEQ ID NO: 58357 - DNA, 679 bp, Homo sapiens
  misc_feature: GYAE6OF02JUGG3.18.19.B08.1.454.CMB.1.raw
  modified_base (85)..(85): a, c, t, g, unknown or other
  misc_feature (85)..(85): n is a, c, g, or t
  modified_base (169)..(169): a, c, t, g, unknown or other
  misc_feature (169)..(169): n is a, c, g, or t
  modified_base (296)..(296): a, c, t, g, unknown or other
  misc_feature (296)..(296): n is a, c, g, or t
  modified_base (502)..(502): a, c, t, g, unknown or other
  misc_feature (502)..(502): n is a, c, g, or t
  modified_base (617)..(617): a, c, t, g, unknown or other
  misc_feature (617)..(617): n is a, c, g, or t
  modified_base (629)..(629): a, c, t, g, unknown or other
  misc_feature (629)..(629): n is a, c, g, or t
  modified_base (662)..(662): a, c, t, g, unknown or other
  misc_feature (662)..(662): n is a, c, g, or t
tcagtacgagtatgcacgaccggtgctcgatttagtgagtcagtaagggtcgtgtgtgggtttcgtaccagcgtaggaccagacnccttccatgggtcttgtcccacgatcaccttgaaggagtctgtcctacgctgtgaaccacacagaccctcacgctgacctgacnccttctctggttctcactcagcactagtggagtgggtgtgggcgtggagtccgtcacgcccccaggaacggcccgtggacggtggcgttggcacctactactttagttggtaggtgtataagttaanacgtctaccaacggcccaactcgtcctagaaggagtacgaggactccaaccactaccaaccgaacggtacctaaccgaccaaaaacccgtcggtacggtactaaccgtaactacggaacccaacacgtacggacctacggtacacgtaaccgagacgactataattactagtcgactacacgtagcgtatcgtaattataacgtanaacgtaccggttaggggtccgtttaagaccgttgaaccgggtccgaacgggtaccgtcggtaccaccgttccgtacccgtagtcccgaccctaccgacccgaacccggtacccgngttcccccggtnttacccccgtccgtaccgtacccccgttacccncctacgacgtaaccccg

SEQ ID NO: 58358 - DNA, 860 bp, Homo sapiens
  misc_feature: GYAE6OF02FHGOZ.18.19.B08.1.454.CMB.1.raw
tcagtacgagtatgcacgaccggtgctcgatttagtgagtcagtaagggtctgtgtgggtttcaccagcgtaggaccagactccttcatgggtcttgtcccagatcaccttgaaggagtctggtcctacgctggtacgaaacccacgaacacgaccctcacgctcgacctgccaccttctcttggttctcactcagcaactagtggagtgggtggtgggcgtggtactccgtcctaccgccccgaggaaacgggtcccgtaggacgtggtcgttcgccgtactacgtaacttttagttaggtaagtgtaataaagtaaacgcggtaactacgaccgaccctatctacgtacgtaagacgcgacggcctaccaacacgtaaccgaacccgtaaacgaaccctaacccttaaacccgaaaaaaccgtcgggttaaccgttaccttaaaccgtaacgtaaccgtaaccaaaaccgtcgtaacccgggtaaccctacgtaaacggaaccgaacgtaacgaccgtaactaacgttaacttaccgtacggtcaccgtaaccgtaacgaacgggtacgttaccggtaactaacgttttaacgagttaacggtaacgttaaccgggtcggggttaccgttttaacggaaccgttaccgggttaccgggggaccccgtaaacgggggtacccggttacggtacccggtaaacccgttccggttaaccgccgtaacccgtttaccccaacccgggtaacccgttaacccgggaaccccgttaccggttaccccgggttccccttaccccccggtacggtaacccccttaaccccgtcccttaaccggaacccgtttaccggtaacccccg

SEQ ID NO: 58359 - DNA, 551 bp, Homo sapiens
  misc_feature: GYAE6OF01D5BNE.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcacgtgggagcagctccaacagtcggggcacgttatgatgtacactggtaccagcaccttccgaggagcacgcccccaacctcctcctctctggtaaccaccaatccggccctcgacggggtccctgaccgtattctctggcctcggaacgttcgtcggccacctcacgtccctcccgtggcccatccactcggccctccgaggtcctggaggatggacggtcttaggtactttagttacctcgaccctagttcctagtcgaccagccacgtcctagtaactcgtctttagttcgttacgttacggaacgttcgggaaccgtaacggg

SEQ ID NO: 58360 - DNA, 561 bp, Homo sapiens
  misc_feature: GYAE6OF01B4J0P.53.85.H08.1.454.CMB.1.raw
  modified_base (233)..(233): a, c, t, g, unknown or other
  misc_feature (233)..(233): n is a, c, g, or t
  modified_base (291)..(291): a, c, t, g, unknown or other
  misc_feature (291)..(291): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacatcggggcacgttatgatgtacactggtaccagccaccttccaggacncacgcccccaactcctcctctctggtaacaccaactcggcccctcgacggggtccctgaccgattctcgtggcctcgaagtctcggccacctcacgtccctccccgtcggccctactcctacctcgggtcccctccgaacgggcttagggacggagtcggacggcttagtactttaattaccttgccctagtccctagtcgaacacggacgacgcccgttagaactcgtagtttactgttccgttacggacgtcggggtaccctaacggg

SEQ ID NO: 58361 - DNA, 610 bp, Homo sapiens
  misc_feature: GYAE6OF01BB2QA.53.85.H08.1.454.CMB.1.raw
  modified_base (310)..(310): a, c, t, g, unknown or other
  misc_feature (310)..(310): n is a, c, g, or t
  modified_base (520)..(520): a, c, t, g, unknown or other
  misc_feature (520)..(520): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagaggtcaccatctcctgcacgtgggacgcacgcctaccaacgacgtccggggcacggttatgatcgtacacgtcggtaccacgtcctacccttaccgaggacnccaccgcccccctaacctccctccctctccgtacggtaaccaaccaacgtccggccctcgacgggtcccctacgaccgtacttcctcgtcggacctcggtaacgttcgtacggcctaccctcgacgtccctcccgtcggacctacgtccacgtcgtccctccgaggtcctaggacggtacgtcggacggtcttagtaactttacgttacncgtaccctacgttacctagtacgaccgagtccacgtcctaggtaactcgtacttattcggtaccgttaaggaccgtgggaacccgtacgg

SEQ ID NO: 58362 - DNA, 629 bp, Homo sapiens
  misc_feature: GYAE6OF01AET56.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggagcagctccaacagtcggggcacgttatgatgtacactggtaccagcaccttccaggacgcacgccccccaacctcctcctctctacggtaaaccaccaactccggccctcgaccggggtccctggaaccgtatttcctcgtcggcctacggaacgttccgtcggaccacccttcacggtccccttccccgtagggccctaacgttccaaccgttcgggtcccctacccgaacgggtccgttagggaacggtacgttaggaacggtccgttaggtaactttacgttaccgttcgacccgtacgttccgtaagtcgaaccgtacgaccgtacgtccctagtaattccgtactttaacgtcggttaccgttacgggaaccgttgggaaccctaaacggg

SEQ ID NO: 58363 - DNA, 534 bp, Homo sapiens
  misc_feature: GYAE6OF01ADB1Z.53.85.H08.1.454.CMB.1.raw
  modified_base (292)..(292): a, c, t, g, unknown or other
  misc_feature (292)..(292): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtcaccatctcctgcactgggagcagctccaacagtcggggcacgttatgatgtacactggtaccagcaccttccaggacncacgccccaacctcctcctctctgtaacaccaactccggccctcgacggggtccctcgaccgtattcctctcggctcgaagtctggccacctcacgccctcccgtggcccatcactcggccctccgaggctggagatgacgtctagtatttacttacgtcgtaccagtccctaatcgacacgacacgtcctagacttcgtacttacgtcgttaccgttacggaacgtcgggaacctaacggg

SEQ ID NO: 58364 - DNA, 726 bp, Homo sapiens
  misc_feature: GYAE6OF01CG6EZ.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcacgttatgatgtacactggtaccagccaccttccgaggacgcacgcccccaacctcctcctctctcggtaaccaccaatccggcccctcgacgggggttcccctcggaaccgtactttcctccgttcggccttcggaacggttccgtacgggccctaacccgttccgaccggtccccttcccccgtgggcccctaacttcccgaaccgttcgggccccttacccgacgggtccctacgggaacgggtactcgggacggtccgttaggtaacttttaacgtttacccgtcgtaccccgtaacgggtttaccccttaaggttaccggaacccgtaacgggtacccgtaaccgggtacccgtttaacgggtaaaacgtttccggttacccgtttttaaacggttacccgggtttacccggtttaacccggggtaaaacccgggtttcggggggtaaaccccgttaaaaccccggggg

SEQ ID NO: 58365 - DNA, 600 bp, Homo sapiens
  misc_feature: GYAE6OF01EB8H3.53.85.H08.1.454.CMB.1.raw
  modified_base (263)..(263): a, c, t, g, unknown or other
  misc_feature (263)..(263): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagcccgcctcagtgtcgtcggggccccagggcagaggtcaccatctcctgcacgtgggagcagctaccaacagtcggggctacgttangatcgtacacgtggtaccagcctaccttccgaggacgccaccgacccccctaactccctacctctctacggtaaccaccaagtccggccctcgacggggtccctaggaccgtattcctcgtcggctacggagttccgtcggcctaccctcgacgtccctcccgtgccctactccacgttccggcctaccgaggtctggacggagttgggaacgtctaggttaactttacgttaccgtcgacccgtagttacctagtcgaaccgtgaccgacggtcccttaggaattcgtactttacgttcggtacgttaccgggaacgttcggggaacctaaccggg

SEQ ID NO: 58366 - DNA, 668 bp, Homo sapiens
  misc_feature: GYAE6OF01BBGRO.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtcaccatcctcctgcacgtgggagcagcctaccaacagtcggggctacgttatgatgtacacgtggtaccagcctaccttccgaggacgccaccgcccccaacctcctcctctctacgtaaccaccaactcccggccctcgacggggtcccctacggacccgtacttcctcgtcggcctacggtaacgttccgtacgggaccctaccctccgaccgtccccgttccccgtacggccctaactcccgtaaccgtccggtccccgtccgacgggtcgtacgggaaggtacgtcgggacggtccgttaggttaacttttacgttaccgtcgtaccctacgttccctaacgtaccgaaccacggtaccgacgttacccgtaggtaacgttcgttacctttacggttaccggtttacgtaaccgggtaaccggttcggggtaaacccgttaaacccggg

SEQ ID NO: 58367 - DNA, 591 bp, Homo sapiens
  misc_feature: GYAE6OF01DJSOI.53.85.H08.1.454.CMB.1.raw
  modified_base (235)..(235): a, c, t, g, unknown or other
  misc_feature (235)..(235): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtggggancagctccaacagtcggggcacgttatgatgtacacgtggtaccagccaccttccgaggacgccaccgaccccccaacctcctcctcctctacggtaaccaccaactccggcccctcgacgggggtccctcggacccgtattcctcgtcggccttacggaacgttccgtacggacccaccctccgacgtccccttcccgtcggacccactccaccgtcggcccctccgaggccttggacggagtcggaacggtctagtactttagttaccgtcgtacctacgttcctagtcgactaggcctaggtcctagtactcgtctttagtcgttacgttacggaacgtcgggaaccgtaacgg

SEQ ID NO: 58368 - DNA, 615 bp, Homo sapiens
  misc_feature: GYAE6OF01BGBHR.53.85.H08.1.454.CMB.1.raw
  modified_base (247)..(247): a, c, t, g, unknown or other
  misc_feature (247)..(247): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagagggtcaccatctcctgcacgtgggagcagctccaacngtcgggcacgttatgatgtacactggtaccagcaccttcgaggagcacgcccccaactcctcctctctcggaacaccaatccggccctcgacggggtccctgacccgtattcctcgtggcctacggtaacgttccgtcgggcctacccgtcgacgtccccttccccgtcggccctaactccaccgttcggcccctccgaggtcctcggacgggtactgggacggtcttagtaacttttaacgttaccgtcgtacccgtacggttcccttagtcgaacctacggaccgtacgtcccttaggaacttcggtacctttagttccggttaccgttaaccgggaaccggttcggggtaacccttaaaccgggg

SEQ ID NO: 58369 - DNA, 731 bp, Homo sapiens
  misc_feature: GYAE6OF01DHF7N.53.85.H08.1.454.CMB.1.raw
  modified_base (242)..(242): a, c, t, g, unknown or other
  misc_feature (242)..(242): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgccgccctcagtcgtcgtcggggccccagggcagacgggtcaccactctcctgcacgtggggacncacgcctaccaacgtacggtccggggactacgttatgtactgtacacgtcggtaccagtcctaacctcgaggacgccaccgtaccccctaacctccctacctctacgtacggtaaccaccgtacgtcccggaccctcggaccgggtcctacgtaccgtacttcgtcgcggtctacgacgtctacggcctaccgtcgacccgtcccgttccccgtacggtaccctactcccgtaaccgtccggtacccctaccggtagggtaccgttacggggacggtacggtacgggtacggtacccgttttaacggtacttttaacgtttcccgacccgttaacccgtacgtttaacccgtaacgttccggaaaccgttccggtaaccgcccggtttacccgtaaaggtacccgtttaccgtttaacggttttacgttacccgggttaacggttaccggggtaaaacccgggtcgggttaaaccccggttaacccggg

SEQ ID NO: 58370 - DNA, 725 bp, Homo sapiens
  misc_feature: GYAE6OF01CBJMW.53.85.H08.1.454.CMB.1.raw
  modified_base (185)..(185): a, c, t, g, unknown or other
  misc_feature (185)..(185): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgccgcctnagtgtccgtcggggccccagggtcaggagggttccaccattcctcctgcacgtggganccacgcctacaacnggtcgggctaacgttnagatcgtaccacgtacggtaccagcctaccgttcgaaggccnccgaccgccccctaactccgtacctcgtaccgtacggtaacctaccgtaacgtccggtacccgtggtacccggggttccctaacggacccgtttaacgtccgtaccgtcggtaccttacgggtaactccggttacggacccttaccgtaccgtaacccgtcccccgttcggtacggtaccctaacgttacccgtaccgttaccgggtcccctaccgggtacggtaccgttaggaacgggttaacgtcgggtaaccggttacttcggttaaacgtttccgttaacggttaccgtccctaacggtttcaaccgttcggaacctacggtacgtaaccgtccgttagtaaccgttgtacccgtttacgtacggtttacccgtaagggacccgttaacgggccgttaaacccggg

SEQ ID NO: 58371 - DNA, 683 bp, Homo sapiens
  misc_feature: GYAE6OF01BV5N4.53.85.H08.1.454.CMB.1.raw
  modified_base (187)..(187): a, c, t, g, unknown or other
  misc_feature (187)..(187): n is a, c, g, or t
  modified_base (245)..(245): a, c, t, g, unknown or other
  misc_feature (245)..(245): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgagggtcctgggcccagtctgtgctgacgcacgccgccctnagtgtcgtcggggccccgagggccaaggacgggtcacctatcctctgacacgtgggancacgcctaccaacgagtcggggactaacgttatgatcgtaacacgtacggtaaccacgacctaccttcgaaggacacaccgaccccctaacctcctcctctactacgtaaaccacaacgtccgccctacggacgggtccctacggtaccgtacttcgtcgcggtaccgtacgtaacgtcgtacggaccctacccgtcgaccgtccctaccccgtgaaccctacgtccgaccgtccgtacccgtaccgaacggtcgtacggaaggtaacgtcggaacggttcttaaggttaactttacgttaaccgtacgtacccgtaagttaccctaagtacgacgtaacgtccgtaacggtaccttaggtaacgttcgtttaactttacggttcggttaacccggtttaaacgggtaaccgtaacccggggaaccgttaaacccggg

SEQ ID NO: 58372 - DNA, 633 bp, Homo sapiens
  misc_feature: GYAE6OF01CKMJU.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgccgccctcagtgtctcggggccccagggcagaggtcaccatctcctgcacgtgggagcagcctccaacgagtcggggcacgttatgatgtacacgtcggtaccagcctaccttccgaggacgccaccgcccccctaacctccctcctctcgtacggtaaccacctaacgtccggtcccgtcgtacgggtccctcgaccgtacttcctcgtcggtccgtacgaacgtcgtcggtcctaccctccgacgtcccctccccgtcggaccctactccgtaccgtccggtcccgtacccgtacggtcgtacgggacggtagtacggacggtacgttcgtaatttacttaccgttcgacccgtacgttacctagtacgtaccgacgaccgtacgtaccgttagtacgtacgttactttacgttcgttacgttacggtaaccgtcgggtaacccgtaaccggg

SEQ ID NO: 58373 - DNA, 784 bp, Homo sapiens
  misc_feature: GYAE6OF01DN3DZ.53.85.H08.1.454.CMB.1.raw
  modified_base (238)..(238): a, c, t, g, unknown or other
  misc_feature (238)..(238): n is a, c, g, or t
  modified_base (275)..(275): a, c, t, g, unknown or other
  misc_feature (275)..(275): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtcaccatcctcctgcacgtgggancagcctaccaacgacgtccgggggactaacggtttancggtaatcgtaaccacgtacgggtaacccaggtcctaaccgttccgaagggacgccaacccgacccccctaaccttccctaccgtcttccgtacggtaaaccaccgaacgtcccggaccctacggaccggggttcccctacggaaccgttactttccgtcgtcgggtccttacgggtaacgttcccgtacgggaccctaacccgttccgaaccggtcccccttccccggtacggaccctacgttcccgaacccggttccggaccccctaccggtaacgggtcccgttaagggaacggtacgttcgggaacggtcctttagttaactttaacgtttaccgtacggtacccgttacgttaccttaacggtacggaaacccgttaggacccgttaaccggtacctttaaacgggtaactttcccggttaacttttaaacgggtttccggtttaacccggtttaaccccggggtaaacggttccgggggtaaaaccccgtttaaaccccgggg

SEQ ID NO: 58374 - DNA, 873 bp, Homo sapiens
  misc_feature: GYAE6OF01DGRXQ.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgagggtcctgggcccagtctgtgctgacgcacgccgccctgagtcgtccgtccggggaccccagggcaggacggtccacctatcctccgtgacctacgtggggacgcacgtcctaccgaaacgtacggtccggggtactaacggtttagacgtacgttacgtaacctaacggttacggtaacccacggtaccctaacccgttaccggaacgggaccgacccaaccccggtaaccccccctaacccgtttccccttacccgttaccgttaccgttaaccggttaaaacccaaaccccgtaaccggttccccgggtaccccgttacccgggttaacccggggttaccccttaaccgggtaaccccgtttacgttttacccgtccggttacggtacccgtttaaccggtaacggttcccgtacgggtacccctacccgttaccgtacccgtcccccgttacccgtacccggtaccctaacgttcccgaacccggttcccggtacccgtacccggtacgggtaccgttaacgggtacggtacgtagggtaccgtacgttacgttaaccgtttaccgttaaccgtaccgttacccgtaaccgttaccgttaaccggaccaaccgtacggtaccgtaaccggttaccgtaacgttaccgttacggtttaccgtttacgttcccggttaacggttaacccgggtaacggtacccgggtaaccgttaaccccggg

SEQ ID NO: 58375 - DNA, 654 bp, Homo sapiens
  misc_feature: GYAE6OF01CYWOW.53.85.H08.1.454.CMB.1.raw
  modified_base (242)..(242): a, c, t, g, unknown or other
  misc_feature (242)..(242): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccaggggcaggacggtccaccatcctcctgcacgtggggancacgcctaccaacgacgtccggggactaacggttatgatcgtacacgtcggtaccagcctaccttccgaaggacgccaccgacccccaacctcctcctcctcgtacgtaaccactaacgtccggccctcgacggggtcccctgaccgtacttcctcgtcggcctacggaacgttccgtacggccctaccgtaccgaccgtcccctcccgtcggaccctactcccgtaccgtcgggcccctccgacggtcgtaggacggtactgggaacgtcgttaggttaacttacgttacgtcgtacccgtacgttcctaacgtcgaacctaggacccgtacgtaccgttagtaacgttcggtttacttagttccggtttaacgttaccgggaacgttaccggggtaaccctaaaccgggg

SEQ ID NO: 58376 - DNA, 657 bp, Homo sapiens
  misc_feature: GYAE6OF01EOM0A.53.85.H08.1.454.CMB.1.raw
  modified_base (241)..(241): a, c, t, g, unknown or other
  misc_feature (241)..(241): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgcccgccctcagtcgtcgtcggggccccagggcagacgggtcaccatcctcctgcacgtgggancagctaccaacagtccggggactacgttatgatcgtacacgtcggtaccagcctaccgttaccgaggacgccaccgaccccctaaccttccctcccttcctcgtacggaacctaaccgaacgtcccggccctcggtaaccggggtcccctacgtaacccgtatttccgtcgtcggacctacggtaacgttcgtcggcctacccgtcacgtccctcccgtcgacctactcccacgtccggtccctccgaggctacggaggatggacgtcgtagtactttacgttaccgtcgaccgtacgtccgtaagttcgaccgaacggcctacggtaccctaaggtaacgttccgttacgttttacgttacggtttacccggtttaccgggtaaaccggttaccggggtaaccggtaaacccggg

SEQ ID NO: 58377 - DNA, 664 bp, Homo sapiens
  misc_feature: GYAE6OF01C1DFQ.53.85.H08.1.454.CMB.1.raw
  modified_base (263)..(263): a, c, t, g, unknown or other
  misc_feature (263)..(263): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcaggacgggtcaccatctcctgcacgtggggagcagctccaacagtcggggcacgttangatgtacactggtaccagcaccttccgaggacgcacgaccccctaactccctcctctctaggtaaccacaacgtccgccctcgtacggggtcccctaggacccgtattcctcgtcgggtacctacggaacgttccgtacgggaccctaccccgttaccgtaaccggtccccgttcccccgttcgggacccctaacgttacccaccgttccgggtccccctttacccggagggtccgtttacggaagggtacttcgggaacgggttccttagggttaactttacgttacctcggtacccgtaccgttacccttaagtacgactacggtaccgacggtccttaggtaacgtcgttacttagttcgttacgttaccggtaagtacggggtaaccgtaaaccggg

SEQ ID NO: 58378 - DNA, 662 bp, Homo sapiens
  misc_feature: GYAE6OF01DCJ8F.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcagacgggtcaccatcctcctgccacgtggggacgcgagcctaccaacacggtcggggacctacgttatgtatcgtacacgtcggtaccacgtcctaccgttcgaggacgaccaccgtacccccacctccctcctctcgtacggtaaccaacctaacgtccggacccgtcgtaccgggtccctacgaccgtacttccgtcgtggtcctacgacgtcgtcgcctacctcgaccgtccctcccgtcgtacccactccaccgtccggtccctaccgacggtccgtagggacgtacgtcggaacgtcgtagttaactttaccgttaaccgtcggtacctacgttacccgtagtaccggtaccgtacggtaccgtacgtaccgttagtaacgttcggttaccttgttacccggttaccgttaacgggtaaccgttaccggggtaaaccttaacccgggg

SEQ ID NO: 58379 - DNA, 813 bp, Homo sapiens
  misc_feature: GYAE6OF01C9BSW.53.85.H08.1.454.CMB.1.raw
  modified_base (229)..(229): a, c, t, g, unknown or other
  misc_feature (229)..(229): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgacgggtcctcgggcccagtctgtgctgacgcacgcccgccctgagtcgtccgtcggggccccagggcaggaggtccaaccgntcctccgtgcgacgtgggacacgacgtcctaccgaaacgtacggtccggggtaccttaacggtttagtacgtacgttacggtaaccgtaccggttacgggtaacccaacggtcccctaacccgtttaccggaacgggaccgaccccgaaccccgtacccccccctaacccgttcccccttccccttaccgttaccgtaaaccggttaaaccaacccgtaaccggtccccggtaccccgtaccggtaccggggttcccctacggtacccgttacgtttccgtaccggtacggtaccgttaaccggtaccgttccggtaccggtacccctacccggtaccgtacccgtcccccgttccccgtaccggtaccctaaccgttccgtacccggttcccggtaccccgtacccggtaacgggtccgttaacgggacggtacgttcgggtacgtacgtttacgttaaacgtttacgtaccgtacgtaccgttacgttaccgtaagtcgaccgtacgaccgtaccgtacttaggtacgttcgtagtttacgtcgttaccggtacggtaaccggcgggtaacccttaaccggg

SEQ ID NO: 58380 - DNA, 847 bp, Homo sapiens
  misc_feature: GYAE6OF01D1I8M.53.85.H08.1.454.CMB.1.raw
  modified_base (244)..(244): a, c, t, g, unknown or other
  misc_feature (244)..(244): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgagggtcctcgggcccagtctgtgctgacgcacgcccgccctcagtcgtcgtcggggccccagggcaggaggtcaccatcctccgtgctacgtgggancgagcctaccaaacgacgtccggggactacgttatagatcgtaaccacgtacggtaccacggcctaccgttaccgaggtacgccacccgtacccccctaaccttcccgtacctccgttaccgtacggtaacccaaccgtaacgtcccggacccctaccgggtaccggggtcccctacggtacccgtactttcccgtccggttcggtaccttacggtaacgttccgtacgggaccctacccgtaccgaaccgtccccttaccccggtgggaacccctagttaccccgaacggttcccggtacccctacccggtacgggtaccgttaacgggaacggtaacggtttaccgggaacggttaccctttaagggttaaactttttaaccgttaacccggtccggttaaccccgtaacgggttttaacccgtaacgttaaccgggtaaccccgtaacgggtacccgtaaaccgggttaccccgttaagggtaaacccgttttaccgggttaacctttttaaacgggttcccgggttttaaaccccgggttttaaacccgggggaaacccgggtttaaccgggggttacccccgttaaaaaccccggggg

SEQ ID NO: 58381 - DNA, 622 bp, Homo sapiens
  misc_feature: GYAE6OF01AUX3G.53.85.H08.1.454.CMB.1.raw
  modified_base (187)..(187): a, c, t, g, unknown or other
  misc_feature (187)..(187): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgcccgccctnaggtgtccgtcggggccccaggggcaggnggtccaccatcctccngcacgtgggancagcctaccaacngtccgggnacgttntgatgtacncgtacggtaccagcctaccttcaggganccaccgccccaccgtcctcctctccgtacgtaaccacacgtcccggcctcggtacgggtccccacgaccgtactttcctcgtcggtccgtaacgacgttccgcgacctaccctacgccgtccctcccgtcgcaccgtccacgttccggactccgacggtcgtggacgtaggacggtacgcgttagtatttacgtacgttcaccgtacttacgtattacgacgtacgtacgcggtacttaggtaacgttaccgtcttttacggtacccgttaccggttaagggtaacccgttaccggggtaaaccgtaaccccggg

SEQ ID NO: 58382 - DNA, 647 bp, Homo sapiens
  misc_feature: GYAE6OF01EC1QE.53.85.H08.1.454.CMB.1.raw
  modified_base (239)..(239): a, c, t, g, unknown or other
  misc_feature (239)..(239): n is a, c, g, or t
  modified_base (305)..(305): a, c, t, g, unknown or other
  misc_feature (305)..(305): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcagagggtccaccatctcctgcacgtgggancagcctaccaacagtcggggcacgttatgatgtacacgtcggtaaccagcctaccgttcgaggacnccaccgcccccaaccttccctcctcctcgtacggtaaccacctaacgtccggccctcgacggggtcccctgaccgtattcctcgtcggcctacgtaacgtcgtcggccacctcgacgtcccctcccgtcggaccctatccgacgttcggacccctcggacggtcctgggaacgtgtcggacggtctagttactttagttaccgtcgaccttacgttccgtaagtacgaccgagtaccggtaccgttacccgtaggtaacttcggttacctttaacggtttccgggtttaacccggttaaccgggtaaacccggttaccggggtaaacccggttaaacccggg

SEQ ID NO: 58383 - DNA, 874 bp, Homo sapiens
  misc_feature: GYAE6OF01CVWRK.53.85.H08.1.454.CMB.1.raw
  modified_base (80)..(80): a, c, t, g, unknown or other
  misc_feature (80)..(80): n is a, c, g, or t
  modified_base (810)..(810): a, c, t, g, unknown or other
  misc_feature (810)..(810): n is a, c, g, or t
tcagcgcgtatacacacgaccggtgctcgatttagtatcactcagtcgcggggtctgcttcagctgtgggcacaagaggnaccgcactcaggacaatctccagcatggcctggtctcctctcctcctcactctcctcgctcactgcacgacgggtcctcgggccctagtctgtcgctcgaccgcacgcccgccctcgaggtcgtccggtccggggccccgagggccagggtacgggtccacctatccctccgtgcctacggtacggggacgcgtaacgcctaacccgaacgtaccgggttcccgggggtaccttaaccggttttaagtacggttaattaccggtaaccgtacggttaccggggttaaaccccacggtaccccttaaccccgttaccggaaacggggtaccgacccgtaccccgtaaccccccctaacccgttccccgttaccccttcggttaccgttaaccggtaaaccctaacccgtaaccggttccccgggttaccccggtacgggtacccggggttacccccgttacggtaacccggtttaccgtttccgtaccggttaccggggtaccttaaccgggtaaccggttccggtacccggtaccccgttaccccgttacccggtaccccgtccccgtttaccccggttaccccggtacctacccgttaccccgttaccggtacccgggtccccgttaacccggacgggttaccggtacggggtaacgtccggttacgggtacgtaccgttttagttaactttacgttacgtccggtaaccttcgtacgttacagaccgngtaacgacggtcacgtagttcgtactttgtcggttactacggtaacggaccggtacccgtacgg

SEQ ID NO: 58384 - DNA, 739 bp, Homo sapiens
  misc_feature: GYAE6OF01CIJ34.53.85.H08.1.454.CMB.1.raw
  modified_base (243)..(243): a, c, t, g, unknown or other
  misc_feature (243)..(243): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgcccgcctcagtgtcgtcggggccccagggcaggacgggtccaccatcctcctgcacgtggggacncgacgcctaccaaacgacggtcggggacctacgtttagtagtacgttcgtaacacgttacggtaaccacgtacctaccgttccgaagggtaccaccgaacccgtacccccctaaccttccctccttaccgttaccgtaacggttaaaccaacctaacggttcccggaccccgttaccggtaaccggggtccctaccggtaaccgttacttccgtcgtacggtacctacggtaacgtccgtcggaccctacccgtaccgtaccgcccgttccccgtacggtacctacgtacccgtaccgtccggtaccctacccggaggtaccgtacggaacggttacgtaggtaaccggtcgttaggttaaacctttacgttaccgtacgtaccttacgttacctaacgtcggaaccgtacgaccgtacgtacgttaacggtacttcgttaacgttacgttccggttaacgttacccgggaaacggtacgggtaaccctaaccggg

SEQ ID NO: 58385 - DNA, 796 bp, Homo sapiens
  misc_feature: GYAE6OF01CJEOO.53.85.H08.1.454.CMB.1.raw
  modified_base (189)..(189): a, c, t, g, unknown or other
  misc_feature (189)..(189): n is a, c, g, or t
  modified_base (289)..(289): a, c, t, g, unknown or other
  misc_feature (289)..(289): n is a, c, g, or t
  modified_base (742)..(742): a, c, t, g, unknown or other
  misc_feature (742)..(742): n is a, c, g, or t
tcagcgcgtatacacacgaccggtgctcgatttagtatcactcagtcgcggggtctgcttcagctggtgggcacaagaggcagcactcaggacaatctccagcatggcctggtctcctctcctcctcactcctcctcgctcactcgcacgcgggtccgtcgggccctagtctgtcgcgtacggccgacnccgtcccgaccctagtggtcggttccggaccgggggacccgaggggaccgaacgggtaccggtaccaaccgtcttaccgtccgcgaacgcggtggggacnccgtacgaccctaaccgaaacggtaccgggtcggggtaaccttaacggtttagtaacgtacgttaaccgtaacgtaaccgggttaccggaaacctcgtaacccgtacccggttaacggaccgggtacccaacccggtaaccccctaaccccctacccgttccgttcccctacgtaaccgaaccggttaaacccaaaccggtaccggtccccggtccgtaaccggtaccgggtacccaacggtaaccctttcgtccgtcggtacggtaaccgtacgggtcgttaccgccgtaccaccgttaccgaccgtcccgtaccgacgtacctaccgacttccgggtaccgtaccctacggggtagtaccgaagggacgtacgggtacgtacgggtacttaacggttaaacttacgcgtaaccgacctacggtactaggacctggacacggactcggtaancgttccgtatttcggacccgttaacggtacggacggtacggtaacggtacccgg

SEQ ID NO: 58386 - DNA, 740 bp, Homo sapiens
  misc_feature: GYAE6OF01C14N4.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgacgggtcctggcccagtctgtcgctgacgcacgcccgcctgtagtcgtccggtcggggcccgagggcaggacggtccaccgtacttcctcgtcgccgacggtgggaactcacgtcctaccaacgtcggtccgggtacctaagttagcgtaagtacgtacctacggtaccggtaaccacgtccctaaccgtaccggagggaccacccgaccccgtaacccccctaaccttccctttaccgtaccgttaaccggttaacgtaaacccaccgtaaaccggtccccggtaaccccgttccgggtaacccggggttacccctaccggtaaccgttacctttccggtacccggttacggtacccgttaacggtacgtttcccggtaacggtaccctaccgtaccgtcccgtccccgtccgtacgccctactccgcgtaccgtcctcgacgtcgaaggtgtacgcggtagtcgttacgtactttacgacttcgacccgttagtcctaggtacctacgacgtccggtacgtattacgtacgttcgttacgttacgttaccggttaaccggtggtaaacccggtcgggtaaacgtacccggg

SEQ ID NO: 58387 - DNA, 731 bp, Homo sapiens
  misc_feature: GYAE6OF01DXB1I.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggaggtcaccatcctctgcacgtggggagcacggcctaccaacacgtccggggactacggttatgatagtacgtacgtacggtacccagccctaccgttaccgagggacgtaccaccgacccccctaacccttccctacccgttccttccgtaacggtaaaccaaccgaacgtcccgggaccctcggtaccgggtccctaccggaccgtacttccgtcgtcggccgtacgtaacgttcgtaccggtcctacccgtaccgaccgtcccccgttccccgtaccggaccctacgtacccgtaccgtcccggaccccttacccggacgggtccgtagggtaacggtagttacggaccggtacgttagtaacttttacgttaccgttcgtacccgtacgttacctaacgttaccgaccgtacgaccgtaaccggtacccgttaaggtaaccttggttaccctttacggtttacggttacccggtttaccgggaaaccgggttccggggtaacccgttaaaccccgggg

SEQ ID NO: 58388 - DNA, 789 bp, Homo sapiens
  misc_feature: GYAE6OF01AOUD8.53.85.H08.1.454.CMB.1.raw
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
tcagcgcgtatacacacgaccggtgctcgatttagtatcactcagtcgcgggtctgcttcagctgtggcacaagaggcagcactcaggacaatctcagcatggcctggtctcctctcctcctcactctcctcgctcactgcacagggtcctgggcccagtctgtcgctgacgcagccgcctcagtgtcgtgggccccagggccagacggtcacctatcctcctgccacgtgggancagctccgaacngtcgggcacgttangatgtacacgtggtaccagctacctcgaggtacnccgtaccgccccctaacttcccgtcctcgttacgtacggtaaccaccgtaacgtcccggtaccctacggtaccggggtccctaggaccgtactttccgtacgttcggaccttacgggaacttccggtacggtacccctaaccccgttaccgaccggttcccccgttcccccggttacggggaccccttaaacggtttccccgaaacccggtttcccggggtaccccttacccggtaaacggggtcccgtttaacggggacgggttaaacctcggggttaaccggtaccggtttacgtaaaacgtttttaaccgtttacccgggtacgtaccccggtaacgtttaccccgttaggtacccgtaaacccgttacgggtacgtaacccggtttacccgaaggttaacgtttcccggtttacttttaaaccgggttcggtttaacccgtttaaccgggtaaacccggttaccgggggttaaacccgttaaacccgggg

SEQ ID NO: 58389 - DNA, 705 bp, Homo sapiens
  misc_feature: GYAE6OF01DA0YJ.53.85.H08.1.454.CMB.1.raw
  modified_base (527)..(527): a, c, t, g, unknown or other
  misc_feature (527)..(527): n is a, c, g, or t
tcagcgcgtatacacacgaccggtgctcgatttagtatcactcagtcgcggggtctgcttcagctgtgggcacaagagcagcactcaggacaatctccagcatggcctggtctcctctcctcctcactctcctcgctcactgcacgacgggtcctgggcccagtctgtgctggacgcacgcccgccctcgagtcgtccgtcggggccccagggcaggacggtccaccactcctaccgtgacacgtagggagaccacgcctaccgaacgtacggtccggggacctacgtttagtacgtactacgtaaccgtacggtacggtaacccacggtccctaccgttccggaacggacgaccgacccgaccccctaaccttccctccctcgtaccgtacggtaaaccaccgtaacgtcccggaccctacggtacccggggtaccctacggaccgtacttccgtacgtcggtactacggtaacgttccgacgtaccctaccgtaccgtaccgtccccgtacccgcggtacctacncccgtaccgtccgccccgtacgacggtacgtaggaacgtagtacgggtacgtacgttaacgttaatttacgtaccgtcgtacctacgtactagaccgagtacgaccgtacgtacgtagttacgtaccgttacgttacgttcggttaaccggtacggaaccggtgggtaacctaaccgg

SEQ ID NO: 58390 - DNA, 668 bp, Homo sapiens
  misc_feature: GYAE6OF01BD60D.53.85.H08.1.454.CMB.1.raw
  modified_base (239)..(239): a, c, t, g, unknown or other
  misc_feature (239)..(239): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcagagggtcaccatcctcctgcacgtgggacncagctccaacagtcggggctacgttatgatgtacacgtcggtaccagcaccttccgaggacgcaccgcccccaacctcctcctctcgtacgtaacaccaacgtccgccctcgacggggtcccctaggaccgtactttcctacgtcggtcctacggtaacgttccgtacggtcctaaccctcgaccgtcccgtccccgtacgggccctacgtacccgtacccgttcggaccccgtcccgtaacgggtccgttacgggaacgggtacgttacgggacgggtacttaggttaaactttactttaaccggtccgtaccgttacgttacctagtacgaccgtaagtccgtaacggtcctaagtaaccgttgtaccgtttacgttcggttacccggttaccgggtaaaccgttcggggaacccgttaaacccggg

SEQ ID NO: 58391 - DNA, 660 bp, Homo sapiens
  misc_feature: GYAE6OF01CKVGQ.53.85.H08.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgcctcaggtcgtccgtcggggccccagggcaggagggtccaccatcctcctgcacgtgggancacgctccaacngtcggggactacggttatgatgtaccacgtcggtaaccagccaacccgttccgaggacgaccaccgaccccctaacctccctcctctcgtacgtaaccacctaacgtcccggccctacggtacggggtcccctacgaccgtacttccgtcgtcggtcctacggtaacgttccgtcggaccctaacccgtccgaccgtcccctcccgtccggtaccctacgttacccgtcgttcccggtacccgtacccgtcggtaccgtagggacggtagtcggacggtccttaggttaactttacgttaccaccgtcgtacgtacctagacgtaacgcgacgacgtaccctaggtaactcgtaacgtttacgtcggttacgttaacggtaaccggtacggggtaaccctaaccggg

SEQ ID NO: 58392 - DNA, 667 bp, Homo sapiens
  misc_feature: GYAE6OF01EBFGP.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggccctgtctgtgctgacgcacgcccgcctcagtgtccgtccggggccccagggcaggtacggtccaccctagtccttccgtagaccgacggtcggggacgcgacgcctaccaaccgtacgtccggggactacgttactgtatcgtactacgtcgtaccacgacctaccgtcgacggcgcaccgacccctacctcctctcgtctacgtacaccacgtccgacctcgtacggtcctcgtaccgtctctacggtcgtaccgtacgtacgtcgtacgaccctaccgtcgtacccgtcccgttccccgtacggtaccctacgtaccgtacgtccccggtacccgtcgtaaccggtcggtagacggtgacggtcgtacgttcgttaattaccgttacgaccgtactaccgtacgttacgacgtacacggtaccgtacgttcgtaggtacccttcggttacgttacgtttaccggtacggttaaccgggttacgtaacccgggtacgttaaccccggg

SEQ ID NO: 58393 - DNA, 717 bp, Homo sapiens
  misc_feature: GYAE6OF01EINDS.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgagggtcctgggcccagtctgtgctgacgcacgcccgccctcgagtgtccgtcggggccccgagggcaggacgggtccaccatcctcctgccacgtgggacgcacgcctaccgaacgtacgtccggggactacgttagtgtactacgtaaccacgtacggtaccgacgtccgtacccgttccgaggtacgcccacccgacccccctaaccttccctcccttctaccgtacgtaaccaccgtaacgtccggaccctacggaccgggttcccctacggtaccgtactttccgtcgtcggacttacggtaacgttccgtacggacccttacccgtccgtacccggtccccttcccgtaccggcctacgtacccgtaccgttccggacccctccggacggttcgtaacggacggttgtacgggaccgtacgttacgttaacgttttaccgttaccgtccggtaccttaccgtaccttacgacggaccgtacgtacccggacgtccgtagttacgttcgtacgtttacgttcggttacccggtaaccggacgggttaccgggacccgttaacccgg

SEQ ID NO: 58394 - DNA, 870 bp, Homo sapiens
  misc_feature: GYAE6OF01C7RWJ.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgccgccctcagtcgtcgtcggggccccagggcaggacgggtcaccatcctcctgcacgtgggagcagctccaacacgtccggggctaacgttatagtatcggtacctacgttacggtaacccacggtcctaacccgtttaccgagggaccggaccaacccggacccccccaaaccccttccccttccctaccgttaccgttacggtaaaccaaccctaaacgtccccggtaccccgtaccggaccgggggttacccctaccggtacccgttaaccgtttccgttacccggttcgggtacccgttaaccggtaaaccgggtttccgtaccggggtacccctaacccccgttaccggtaacccgttacccccccgttccccccggttaccgggtaccccttaacgttcccccgtaacccggttccgggtacccccttaccccggacgggtacccgtttaacgggacgggtaacgttcggggaaaccgggtccgtttaacgggtttacttttaaccgtttaccgttaccggtaaccccttacggtttaacccgttaaccgtaccggtaacccggtaacgtcccggtaacggttaccccggttaaggtaacctttaccggttaccgttttacgtaccggtttcccggtttaaacggggtaaacccgttcccgggggtaaacccgttaaaccccgggg

SEQ ID NO: 58395 - DNA, 842 bp, Homo sapiens
  misc_feature: GYAE6OF01CT0QW.53.85.H08.1.454.CMB.1.raw
  modified_base (679)..(679): a, c, t, g, unknown or other
  misc_feature (679)..(679): n is a, c, g, or t
  modified_base (786)..(786): a, c, t, g, unknown or other
  misc_feature (786)..(786): n is a, c, g, or t
tcagcgcgtatacacacgaccggtgctcgatttagtatcactcagtcgcggggtctgcttcagctgtgggcacaagaggcagcactcaggacaatctccagcatggcctggtcctcctctcctcctcactcctcctcgctcactcgcacgacgggtcctcgggccctagtctgtgcgtacgacgcgaccgcccgccctcgagtcggttccggaccggggtccccgagggcgaggtaccgggtccacctactcctccgcgacctacgtggagaccgtacgaccgtacctacccgaaacggtacgggtcccgggggtaacctaacggtttaagtaggtacgttacgttaaccgtaccggttaccggtaaccaccggttacccgttaacccgtaccggaacggtaccgaccccgtaacccccgtacccccctaacccgttccccttaccctttaccgttaacgttaaaccccgggtaaccctaaacccggtaacccggttccccgggtacccccggttacccggggttaacccggggttaccccgtaccggttcccgttaccgttttccgtacggtaccggtaccgtacggttaacgtcccggtcggtacccctacccgttacggaccccttccccgtccgtaccgaccctacctcccggtacgttaccccgccgtaccggnggtccgtagggaacgggttgaacggtcgttacgttacgtttaactttcgttaccaccgttacctaccggttactgacgtacggacccgtcgttaacgcttaagggtnttacgtttacggttcgttacctttacgggaacccggtggttacccccggtaaacgg

SEQ ID NO: 58396 - DNA, 748 bp, Homo sapiens
  misc_feature: GYAE6OF01ASWPI.53.85.H08.1.454.CMB.1.raw
  modified_base (177)..(177): a, c, t, g, unknown or other
  misc_feature (177)..(177): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctacactcgcacgtaggtcctcggcccagtctgtgctgacncgacgccgcctcgagtcgtcgtaccggggcccaagggcgaggacgggtccaccgtacttccgtccgtgaccgttacgaggacggacgtaccacggtacctaccgaaaacgtcgggtccggggtacctaaccgttaggtataccgttacggttaccctacgtaccgggtaaccctaacggcccgtaaacccgttccggacggaccggacccgtaaccccggtaaccccccttaaccgttccccgttccttacggttaaccggttaaccgaaaccccgaccgtaaccgggtccccgtccggtacccgggttaacccgggtccctacggtaccgtacgtttcccgttcgccggttaccgaccggttacgtcggtaccgtacctaccggtaccgtcccgtacccgtacccgtcgtacctacgtccgtacctccggaaccttcgacggtacgtgacggttaacgcgggtaacttacgacgttactttcgtacgtaccgacttcgtactcgacgcgttacgacctaggtactacgtctagtaccgttgttaccgttacgacgggtacgtacgtaccg

SEQ ID NO: 58397 - DNA, 784 bp, Homo sapiens
  misc_feature: GYAE6OF01ARX8M.53.85.H08.1.454.CMB.1.raw
  modified_base (190)..(190): a, c, t, g, unknown or other
  misc_feature (190)..(190): n is a, c, g, or t
tcagcgcgtatacacacgaccggtgctcgatttagtatcactcagtcgcggggtctgcttcagctgtgggcacaagaggcagcactcagacaatctccagcatggcctggtctcctctcctcctcactctcctcgctcactgcacgacgggtccgtcgggcccagtctgtgctgacgcacgccgccctgngtcgtccgtcggggccccgagggcgaggacggtccaccgtactcctccgtcgcgtaacgtggggacgcgtacgacctaccgaacgtcggtacggggacctacggttgtcgacgttacgtaccgtacggtaccggtaaccacgccctaaccgttccgaacggaccgacccaccccgtacccctacccgtttcccttaccgttaccgtaccgttaaccggtaacccaccgtaccgtcccgtacccgtcggtaccgggtccctacgtacgtccttcgcgtcgtacttacggtacgtcgtacgacctacgtaccgccgtcctccgcgcctacgtccgtccgtaccggcctaccgacggtcgtacggacgttcggacgtacggttacgttaaaccgtttaacgtttaacccggttccgttaccggaacccgttaccgttaccccggtaagtacccgggaaccttaccccgggaaacgttcccgtaaccggttttaacggtaaacccgtttccggttttaaaccccgttaggtttaccccgggttaaccgttaaaccgggggtttaccggttaaacccggggaaacccccggtttaccgg

SEQ ID NO: 58398 - DNA, 804 bp, Homo sapiens
  misc_feature: GYAE6OF01EOO1P.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactcgcacgacgggtcctgggccagtctgtgctgacgcacgcccgccctgagtcgtccggtcggggaccccgaggggaccgacggacggtccaacctacgtcccttccgtcgaccgtacggtaggggacgaccaacggtccttaacccgaacggtaccgggttaccggggaccttaacggtttaagtacgtagttaccggttaacctaccggttaccggtaaacccgtaccggtacccttaaccccggttaccggaacgggaacccgacccggaacccccgtaaaccccccccttaacccctttcccgttaccccgttaccgttacccgtaaccggtaaaacccctaacccgtaaccggtccccggtaccccgttaccggggtacccgggtttcccctaaccgggttaccctatttcccggtacgttcggaccgtacgttaccgtccgtcgtaccctacccgtcgtaccgtccccgttcgtacccgactacgtccgtaccgtacgtcccgtacgtcggtctacgggacgtgtacggtcgtacgtacttacgtttacgtacccgtgtacctaccgttacgtatacgtaaccgactacggtaccgtacgtagtaccttcgttacttgttccggttacgtaacggaccggtacggacccgtaaccggg

SEQ ID NO: 58399 - DNA, 761 bp, Homo sapiens
  misc_feature: GYAE6OF01D3P7E.53.85.H08.1.454.CMB.1.raw
  modified_base (174)..(174): a, c, t, g, unknown or other
  misc_feature (174)..(174): n is a, c, g, or t
  modified_base (714)..(714): a, c, t, g, unknown or other
  misc_feature (714)..(714): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgcgggtcctacgggcccagtctgtgctnacgccacgccccgtcctacgagttcgtccggtcggggaccccagggcagggacggtaccaacctactccttccgtagacctacggtggggacgcgacgtccgtaccgaactacggtaccggggtacctaacgttagtcggtaacgttcggtaccttaaccgtacggtaacccgtacggtacccttaacccgttacccgaaagggaccgaccaaccccggtaccccccctaaaccccttccccttacccttccgttacgtaacccggtaaaccctacccgtaaacccgttacccgggtcccgtaccggtacccgggtttaccccgtacggtaacccgttacgttccgtcgttacggaccgtacgtacgtaccgtccgtccgaaccctccgtaccctcccttcccgtaccgacctactaccgtaccgtccggtcccgtaccgacgtccggtaggacgtagtacggcggtacttacggttaactttacgtaccgtctacccggtacttaccgtaacgttgacgtaacgactccggtctaagtnacgttctagttcgttacgtacgggtaacgtccggaacgttaacccgg

SEQ ID NO: 58400 - DNA, 703 bp, Homo sapiens
  misc_feature: GYAE6OF01AW84A.53.85.H08.1.454.CMB.1.raw
  modified_base (248)..(248): a, c, t, g, unknown or other
  misc_feature (248)..(248): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgcccgccctcaggtgtccgtcgggggccccaggggccaggacgggtcaccatcctcctgcacgtggggacncagcctaccaacagtccggggactacgttatagatcgtacacgtacggtaaccacgcctaccttccgaaggacgaccaccgacccccctaaccgttccctaccctccgtacgtacggtaaccaaccgtaacgtcccggccccgtacggtaaccggggttccctacggtacccgttacgtttcctcgtcggtacctacggtaacgtcgtacggccctacccgtacgaccgtcccctcccgccgtacctacgttccgaccgtccggtccctaccgacggtaccgtagggacgtaggtacggacggttactagttaactttacgttacccgtacgtacctacgttaccgtaacgtacgtaccgaacgtaccgtaccgtacgttaacggtacgttcgttactttacggtacgtttaccggttaaccgggtacggtaaccggggtaaccgtaaacccggg

SEQ ID NO: 58401 - DNA, 763 bp, Homo sapiens
  misc_feature: GYAE6OF01BYI5I.53.85.H08.1.454.CMB.1.raw
  modified_base (115)..(115): a, c, t, g, unknown or other
  misc_feature (115)..(115): n is a, c, g, or t
  modified_base (243)..(243): a, c, t, g, unknown or other
  misc_feature (243)..(243): n is a, c, g, or t
tcagcgcgtatacacacgaccggtgctcgatttagtatcactcagtcgcggggtctgcttcagctgtgggcacaagaggcagcactcaggacaatctcagcatggctgtctcctntcctcctcactctccgtcgctcactcgacacgacgggtcctcgggccctagtctgtgctagcgcacgcccgtacctgagtcgtcgcggggcccaggcaggtggtacactatcctcgtgcacgtgggancgagacctaccgaactacggtaccgggactaacgtttagagtacgtacgtacgtacgtacggtaaccacggtacctaaccgttacccgaagggtaccaccggtaacccctacccccttaaaccgttcccttacgttaccgtacggttaaccggtaaaccaacggttaaaccgttccggaccccgttaggtacccgggttaccctaggacccgtttactccgtaacggtcgttaacgtaacgtaccgttccgtaccggtcctaaccgtcgtaacccggtcccgttacccgtacgggaccctaactcccgtacggttacccggacccgtaacgaccggtaccggtacgggtaaggtacgtacgggtaaccgtagttaacgtaacgtttaccgtaacgttaaccgaacccgtacggtaccctttaaggaaccgtacgtaaccgggttcaacgggtacccttaaggtactacgttaacgttcgtaccggtacgtaaacggtccggtacgggtaacccgtaacgg

SEQ ID NO: 58402 - DNA, 864 bp, Homo sapiens
  misc_feature: GYAE6OF01CK2KR.53.85.H08.1.454.CMB.1.raw
  modified_base (162)..(162): a, c, t, g, unknown or other
  misc_feature (162)..(162): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
tcagcgcgtatacacacgaccggtgctcgatttagtatcactcagtcgcgggtctgcttcagctgtgggcacaagaggcagcactcaggacaatctccagcatggcctggtctcctctcctcctcactctcctcgctcactgcacgacggtcctcgggcccngtctgtgctgacgcacgccgcctcgagtcgcgtcgggcccagggcaggcggtcaccncttccncctgcacgtgggacncgacgcctaccaaacgtacggtccggggaccttaacggttagtcggtaagttccggtaaccgaaccggttaccggttaaccccgaacgtcccgttaaccccgttaccggaacggtaccgtacccgaacccccgtaacccccccttaaaccccgttcccctttaccccgaccgttttacccgtaaaccgggtaaaacccctaacccgtaaccggttccccggaccccggttacccggggtaaccgggtacccccgttacgaacccgtttcgtttacccgtacggttccggtacgtacgggtaccgtacggtaccgacccgtacccgttacccggacccgtccccgtccccggtaaccgtccctaaacggtcccgtacggtacccggacccctacggtaccggttacgtacggaagtccgtaacgggtccgtacggtttacgttaaccgtttaccgttacccggtaccgttacccgtacgttacccgtcggttagaaccccgttagacccgggttaaccgtacgttaacggttaccgtttacggttaacgttttaacggtttaccggtttaaaccgttaacccggggttaacccgtaaaccggggttacccgggttaaaccccggg

SEQ ID NO: 58403 - DNA, 737 bp, Homo sapiens
  misc_feature: GYAE6OF01B2H29.53.85.H08.1.454.CMB.1.raw
  modified_base (263)..(263): a, c, t, g, unknown or other
  misc_feature (263)..(263): n is a, c, g, or t
  modified_base (301)..(301): a, c, t, g, unknown or other
  misc_feature (301)..(301): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgccacgacggggtcctcgggcccctagttctggtcgctgaccgcgacgcccgtccctgagtcgtccggtccggggccccagggcaggacggtccaccgattcctcgtgccacggtggggcnctagccctaccgaaagtcgggcgggtactaggtttagngtacttagtacctcggtacggtacccgagtacccttacccgtcggaacggtaccacccgtaacccccgacccccttaccttccccttcgtaccgttacgtaacgaaacccaccgtacggtccccggtaccgtaccgggtaccgggtaccccttggtaacccttacgtttcccggtacggtccgtaccgttacggacgttcccgtcgacccctaaccgtcgacccttcccgtcccgtccggaactccggtaccgtcgtccgccgtaacgcgtacggtaacgaggcgtggccgttatcggttaactttcggtacgtccgtaaccgtactacgtacttaaccggactcgggaaaccgttcgtaccgttaagtccgttcgtttaccgtaccgtttaacggtcccgttaaaggtcccggaaccgggtaccgtaaccccggg

SEQ ID NO: 58404 - DNA, 796 bp, Homo sapiens
  misc_feature: GYAE6OF01BKT85.53.85.H08.1.454.CMB.1.raw
  modified_base (174)..(174): a, c, t, g, unknown or other
  misc_feature (174)..(174): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgaggtcctgggcccagtctgtgctgacncacgcccgtccctgagtcgtcggcgggccccagggcaggacggtcaccgtactccgtccgagcacgtgggacgtcgacgcctaccaacgtaggtccggggacttaacggttataggtacttacgtaccaccggttacgtaccgacgtacccgttaccgttaccgaaggtccggacccaaccccgtacccccctaaccgtccccgttacctccgttacgtaaccgtaaaccaaccgtacgtcccggcctaccgggtaccggtcccgtacggaccgttcttaccgtcgtacggttccgtaacgtacgtacggtcgtacctaccgtccgtacccgtcccgttccgccggtacctacgtacccgtacccgtttccggtacccctccgtacgggttccgtaagggtacgacggtttaacgggcgggttaccttaaccggttaacgtttttacccgtaacccgttacggtacccggttaacggttacccctttaagggtacccgtaaaccggaacggtaccctacggtaacgggttaaggttacccttagggtttaaccttcgggtttaaccgttacccgggttaaacccggaaccggggttaacccggaaaccccggtttacccggg

SEQ ID NO: 58405 - DNA, 798 bp, Homo sapiens
  misc_feature: GYAE6OF01AYAGW.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgtacgggtccgtcggccctagttccgtggttcgcgtcggaccgccgacgcccgtcctcgtacggtcggtccggtccggggaccccggaggggcgaacgggtacgggtacctaaccgtacttcctccgtcggaccgtacgggtacgggacgcgacgcctaccgtaacgtacgggtccgggacgtagttagtacgtagtacgtacgtacgtcggtaaccacggtaccgtaacccgttcggacgggaccgacccgtaccccgtaccccctaacccgttccctaccgttaccgtacgtaccgaaaccaacccgtaccgtcccggtccgtaccggtaccggtcctacggtaccgttacttccgtcgtcggtaccgtacgtacgtccgtcggaccctacgtccgtacccgtcccgtaccgactccgtacgtaaccgccgttaccgcccgacggtacgacggtcggacgttacgacggtcgtaacttacgttaccgttaacgtcgtacctaccggttacgttctaaaccggcgtaccgaccgtaaccgggtacgttaacggttaacgttcggttcccgtttaaaaggtttccccggtacggggtttaaccgtttaaaccgggaaaccgggttaaccgggtaaccccgggtttaacccgg

SEQ ID NO: 58406 - DNA, 762 bp, Homo sapiens
  misc_feature: GYAE6OF01AYN2B.53.85.H08.1.454.CMB.1.raw
  modified_base (188)..(188): a, c, t, g, unknown or other
  misc_feature (188)..(188): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgagggtcctgggcccagtctgtgctgacgcagcccgcccttnagtctcgtcggggccccagggcaggaggtcaccgatcctcctgccacgtgggagcaagcctaccaaacaggtccggggactacgttagtagacgttagtacctacgtcggtaaccagacctaacccttcgacggtacgccgaaccgccccccctaaaccttcccctaccttaccttaccgtaacgggttaaacccaaccgtaaaccgttcccgggacccccctttacgggaacccggggggtttcccctaacgggtaacccgtacgtttaccgtccgttacggaccgttacgggtaaaccgttccgtacggtaccctaacccgtactacccgtaccccttccccgtacggaccctaacgtcccacggttcccgacccgtacgtacgggacctagggtaacgacggttcgggaacgtaccgttacgttaactttacgttaaccgtcggtaaccctaacgttaccgttaacgtacgtacccgaggtaccgaaccggttcccgttaagaaacttcggtaacctttacggtaccggtttaccgttaaccgggaacggttcgggaaacccgttaacggg

SEQ ID NO: 58407 - DNA, 765 bp, Homo sapiens
  misc_feature: GYAE6OF01C8PHD.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtcctcctctcctcctcactctcctcgctcactgccacgacgggtcctgggccctagtctgtcgctcgacgcacgcccgccctgagtcggtccgtcggggccccgagggtcgaggtacgggtccacctctcctccgtgccgtacgtgggacacgacggaccttaccgaaacgtacgggtccgggtacttaaccggttagtaggacgttcgtaaaccgtaccggttacggtaccgaacgtacccgtaccttaccggaagggaccgtacccgaccccggtaccccctaaacccgttccctacccttaccgttccggtaaacgtaccaaccgtaaaccgtcccggtccccgtacggtacccgggttacccgtacggaccgttacgttccgttccggcggttaccgtacggtacggttaccgcgtacctccgtaccgtacccgtccgtaccccgtacgtccctacgtccgtacgtcccgtctacccgtcggtcggtacgtacgggacgtacggtcgtacgttacgttaacgttccgttaccgtacgtacccgtacgttacgtacgtaccgacgacgacggtacctaggttacgtgttacgtacgttttacgtacctttacgggtaaccggttaccgttaccggaccggttaaacccggg

SEQ ID NO: 58408 - DNA, 694 bp, Homo sapiens
  misc_feature: GYAE6OF01C1BQL.53.85.H08.1.454.CMB.1.raw
  modified_base (122)..(122): a, c, t, g, unknown or other
  misc_feature (122)..(122): n is a, c, g, or t
  modified_base (151)..(151): a, c, t, g, unknown or other
  misc_feature (151)..(151): n is a, c, g, or t
  modified_base (160)..(160): a, c, t, g, unknown or other
  misc_feature (160)..(160): n is a, c, g, or t
  modified_base (163)..(163): a, c, t, g, unknown or other
  misc_feature (163)..(163): n is a, c, g, or t
  modified_base (171)..(171): a, c, t, g, unknown or other
  misc_feature (171)..(171): n is a, c, g, or t
  modified_base (213)..(213): a, c, t, g, unknown or other
  misc_feature (213)..(213): n is a, c, g, or t
tcagcgcgtatacacacgaccggtgctcgatttagtatcactcagtcgcggggtctgcttcagctgtgggcacaagaggcagcactcagacaatctcagcatggcctggtctcctctcctcncactctcctcgctcactgcacgaggtccnggccagtcngtncgtagacncacgccgtcctgagtcgcgtcgggcccaggcaggacgtcacntctctgcaggtggacgacacgtaccacgaacgtagcgggactacgtatacgtacgtacgactacgtacggtaccgactacgtaccttacggacgacgccaacccaccccgtaacctccttaccgtactacgttaaccgaacctaaccgttaaccggcccgtaccgtacggtaacccggggtccctaacgggtacccttaagttcccgtacggtcggtaaccgttacgaaccggtttcgaccgtccctaacgtaccgtaccgtcccgtacgtaccggacctaacgtaccggacgttccggacctaccggaacggtccgtaaggttaaccggaagttacggaaccgggttacctaggttaaccgtttaaccgtaccggtcggtaacccgttacgtaacttacggaacgttaccgacggtacggtactagggtacgagttacgtcgttaagttcgtaacgtacggaccgtaggtacgtaaccgg

SEQ ID NO: 58409 - DNA, 786 bp, Homo sapiens
  misc_feature: GYAE6OF01BVOGX.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatcggcctggtctcctctcctcctcactctcctcgctcactgcacgacgggtcctcggcctagtctgtcgctcgacgcacgcccgcctcgacgtcgtcgtccgggcccgagggcaggacggtccacctctcctccgtcgacacgtggacgccacgcctaccaacgtacggtccggggactacgttatggtacttacgtacacgtacggtaccacgtccgtacctacggacggtacgaccgtacccgaccccctaacccttccccgttaccgtaccgttaccgttaaccggttaaaccacccgttaaccgtcccggtacccgtaccggtaccggggttccctaccggtaccgtaacgtttccgtccggtacggttaccgtacggtaacgttcccggtacggtaaccctacccggtcctaccgtccccgtaccccgtcggtaccctaacgtccgttacccgtaccggtccctaccgggtaaccgtcgtacgggtaacggtagtacgggacgtacgttaacgttaacgttaccgttacgtaccgtaccggttacgtacccgtacgtacgtaccgtacgaccggttacgtaccggttacgtaacgttaccgttacttttaaccggttacggtttaaccccggtttacgggaaacccgggtttaacgggtaacccggtttaaccccggg

SEQ ID NO: 58410 - DNA, 670 bp, Homo sapiens
  misc_feature: GYAE6OF01BJWV0.53.85.H08.1.454.CMB.1.raw
  modified_base (242)..(242): a, c, t, g, unknown or other
  misc_feature (242)..(242): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcaggacgggtcacctatcctcctgcacgtgggacncagcctaccaacacgtcgggctacgttatgatgtacacgtggaccagcctacctcgaggcgccaccgcccccaacctcctcctctccgtacggtaaccaccaacgtcccggaccctcggacggggtcccctcgaccgtctttccgtcgtcggcctacgaacgttccgtacggaccctaccctccgaccgtccccttccccgtcggtccctacgtccgaccgtccggcccctaccgacgggtcctagggaacggtcgtacggacggtcgtacgttacgttttaaccgttaccgtccgtacccgttacgttacccgttaagtcgtaaccgacgtaccgtacgtccgttaaggtaaccgttcgttaactttacggttaccggtttacccgttaacgggtaaccggttaaccgggaacccgttaaacccggg

SEQ ID NO: 58411 - DNA, 559 bp, Homo sapiens
  misc_feature: GYAE6OF02HJ9KP.53.85.H08.1.454.CMB.1.raw
  modified_base (435)..(435): a, c, t, g, unknown or other
  misc_feature (435)..(435): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggagcagctccaacagtcggggcacgttatgatgtacactggtaccagccaccttccgaggagcacgcccccaactcctcctctctagtaacaccaatccggccctcgacgggtccctgaccgattctctggcctcgaacgtctggctaccctcacgccctcccgtcggccatccacgtcggcccttccgacggtctggaacggntcggacggtctagtactttattaccgtcgaccctacgttacctagtcgaactcgccaacggtcctagaacttcgtacgtttacgtcggttaccgttaccgggaacttccggggaacctaacggg

SEQ ID NO: 58412 - DNA, 594 bp, Homo sapiens
  misc_feature: GYAE6OF02HYGVR.53.85.H08.1.454.CMB.1.raw
  modified_base (239)..(239): a, c, t, g, unknown or other
  misc_feature (239)..(239): n is a, c, g, or t
  modified_base (298)..(298): a, c, t, g, unknown or other
  misc_feature (298)..(298): n is a, c, g, or t
  modified_base (370)..(370): a, c, t, g, unknown or other
  misc_feature (370)..(370): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggagggtcaccatcctcctgcacgtgggancagctccaacagtcgggcacgttatgatgtacactggtaccagccaccttccgaggacnccaccgcccccaacctccctcctctcgtacgtaaccaccaactccggccctcgacggggtccctgacccgtnttcctcgtcggtctacgaacgttcgtcggacctacctccgacgtccctcccgtggaccctatcccgtacgtcggccctaccgagtccgtagaggtattgggacgtcgtagtactttacgtacgtcgcctacgtcccttagtccgacacggtaccgacgtaccgtagtaacgttcgtactttagtcggttaccgttaaccgggaacgttcgggaaccctaacggg

SEQ ID NO: 58413 - DNA, 552 bp, Homo sapiens
  misc_feature: GYAE6OF02FZ8HA.53.85.H08.1.454.CMB.1.raw
  modified_base (233)..(233): a, c, t, g, unknown or other
  misc_feature (233)..(233): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagcctccaacagtcggggcacgttatgatgtacactggtaccagccaccttccgaggacgcacgccccccaacctccctcctctctacggtaaccaccaatccggccctcgacggggtccctgaccgtattcctctcggctacgaagtctggcacctcacgccctcccgtcggccctatccacgttcggccctccgagggtcctggacggtatggaggtcttagtaatttacgtactcgccagttcctatcgacacgacacgtcctagaacgttgtacctttagttcgtccgttacgggaactacgggacctaacggg

SEQ ID NO: 58414 - DNA, 680 bp, Homo sapiens
  misc_feature: GYAE6OF02JTTN9.53.85.H08.1.454.CMB.1.raw
  modified_base (323)..(323): a, c, t, g, unknown or other
  misc_feature (323)..(323): n is a, c, g, or t
tcagcgcgtatacacacgaccggtgctcgatttagtatcactcagtcgcgggggtctacttcagctgtgggcgacaagaggcagcactcaggacaatctccagcatggcctggtctcctctcctcctcactctcctcgctcactgcacagggtcctcgggcccagtctgtgctgacgcagccgccctcagtgtcgtcggggccccagggcaggagggtccaccatcctcctcgcacgtgggacgctagcctaccaacgacgtcggggctaacgttatcggattggtaccacgtacggtaccacggtactacctccgagggacnccaccgaccccctacgtcctctactcgtacgaacaccacgtccgacctgacgggtccctaggacgtacttcctcgtacggctcgtaacgtcgtcggacctaccgtctacgcccgttccgacgtcctacgtacctccgtaccggtcccgtacgaggtaccgtaggtcgggtaactcggtacggtcttaccggtaattttaccgtaacggttccgaccgtttaacgacctttacgggagtacccgtagaacggttcccgtaccggttaaagtaggttccccgtttaaagttccggtttaccgggtttaccggttaaacgggtaaccccggtttaggggtaccccgttaacgggttcccc

SEQ ID NO: 58415 - DNA, 552 bp, Homo sapiens
  misc_feature: GYAE6OF02HP6AY.53.85.H08.1.454.CMB.1.raw
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (399)..(399): a, c, t, g, unknown or other
  misc_feature (399)..(399): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctgggccccagggcagnggtcaccatctcctgcactgggancagctaccaacagtcgggctacgttangatcgtacactggtacccagccaccttccaggacgcacgccccccaaccttcctcctctctacgtaaccaccaacgtccggccctcgacgggtcccngaccgtattcnctgctcgaagtctgccacctcacgtccctcccnggccactccactcggccctcgaggtcctggacgtatcgaggcttgtaattattacgctacccgagttcctagtcgacctagaccgtacgtcctaggaacttcgtactttacgttcggttaccgtttacgggaaccgttcgggaacctaaccgg

SEQ ID NO: 58416 - DNA, 649 bp, Homo sapiens
  misc_feature: GYAE6OF02JNXME.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacaggtcctgggcccagtctgtgctgacgcagccgccctcagtgtcgtcggggcccgacgggcacgggtacggtacgaccacgtctcctcgtcgacgtcggacgcgacgactaccgacgacgtacggacgtacgtagtagtagtacgtacgtacgtacggtaccgtacgaccgtaccgtaccgacggacgaccgaccgacccctaccctacctcctcctacgtacgtaaccgtaccgtacgtaccgtaccgtacggtaccggtaccgtacgtaccgtacgtacgtcgtcgtacgtacgtacgtacgtacgtacgtaccgtacgtaccgtccgtccgtcgtacctacgtacgtacgtccgtccgtacgacgtacgtacgacgtacgtacgacgtacgtacgtacgttacgttacgtcgtacgtacgtacgtacgtacgacgtacgacgtacgtacgtacgtacgtacgtacgttacgtacgttacggtacggtacggtacggtacg

SEQ ID NO: 58417 - DNA, 528 bp, Homo sapiens
  misc_feature: GYAE6OF02GD6XT.53.85.H08.1.454.CMB.1.raw
  modified_base (450)..(450): a, c, t, g, unknown or other
  misc_feature (450)..(450): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagcctccaacagtcggggcacgttatgatgtacactggtaccagcaccttccaggagcacgcccccaacctcctcctctctaggtaaccaccaatccggccctcgacggggtccctgaccgattcctctggctcgaacgtctggccacctcacgcccttcccgtggccatccacgtcggccctcgaggctgagtatgaggtctagaatttactacngcctagtcctagtcgacagcgagtcctagaattcgtactttagtcgttccgttacggacgttcgggaaccctaacggg

SEQ ID NO: 58418 - DNA, 497 bp, Homo sapiens
  misc_feature: GYAE6OF02FQZM9.53.85.H08.1.454.CMB.1.raw
  modified_base (234)..(234): a, c, t, g, unknown or other
  misc_feature (234)..(234): n is a, c, g, or t
  modified_base (412)..(412): a, c, t, g, unknown or other
  misc_feature (412)..(412): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggcccccagggcagagggtcaccatctcctgcactgggancagctccaacatcggggcacgttatgatgtacactggtaccagcaccttccaggagcacgcccccaaacctcctcctctctggtaacaccaatcggccctcaggggtccctgaccgattctctggctcgaagtctggcacctcagccctccctgccatcactcggcctccgaggctgnggtactggacggctgagttacttacgtgcctagtccctatcgacagcagcctagatgacttatggtctacggactggacctacgg

SEQ ID NO: 58419 - DNA, 716 bp, Homo sapiens
  misc_feature: GYAE6OF02I241Q.53.85.H08.1.454.CMB.1.raw
  modified_base (207)..(207): a, c, t, g, unknown or other
  misc_feature (207)..(207): n is a, c, g, or t
tcagcgcgtatacacacgaccggtgctcgatttagtatcactcagtcgcggggtcgtgcttcagctgtgggcacaagaggcagcactcaggacaatctccagcatggcctgtctcctctcctcctcactctcctcgctcactgcacaggtcctgggcccagtctgtgctgacgcagccgcctcagtgtcgtcgggcccagggcaggngggtccaccgatcctcctgcacgtgggacgcacgcctcccaaacgacgtccgggggactaacggtttatggtaagttcgtaacctaccgtcgggttaaccccagtacccgtacccttaccggaggacgacccgtaacccggacccccccctaaacttcccccgttacccttcctccgttaaacggtaacccaaccctaacggtcccggtacccctcggtaaccgggggttccccctaggaaccccgttagttttcccgtacgttcgggaccctttaccggtaagttcccgtaggacccctaccgtccacggtcccctaccgtcggccaccgtcaacgttccgcctacccgagtccctaggacggtatcgggaacgccgttaggtaactttacgttacgtccggacctagttcccaagtgaccgtagacccggtaatcccgttaggaaccttagtaccgtttacgtacggttcccgttaacgggtaaccgttacgggtaacccgtaacgg

SEQ ID NO: 58420 - DNA, 670 bp, Homo sapiens
  misc_feature: GYAE6OF02H5LUC.53.85.H08.1.454.CMB.1.raw
  modified_base (238)..(238): a, c, t, g, unknown or other
  misc_feature (238)..(238): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcaggacgggtcacatcctctgcacgtgggancagcctaccaaacgtacggtccggggcctaacggtttatggacttacgtaacctacgtcggtaaccagtccctaaccgttcgaggacgccaccgccccaaccgtcctcctctcgtacgtaacaccagtccgcccngtacgggtccctagaccgtnttctcgtcggctacgtacgtctcggccacccgtacgaccgtccctccgtcgaccctacgtcgtaacgtccggtcccttaccggaggtccttagggaacgggtagtcggacggtaccttacgttaaactttacgttaccgtcgtaacccgttacgtaccttaagtaccgaccgtacgacccggtcgttaacccgttagtaaaccttttcggtacttttacggttcggttacccggtttaaccgggaaacggttacccggggaaccgtttaaacccggg

SEQ ID NO: 58421 - DNA, 541 bp, Homo sapiens
  misc_feature: GYAE6OF02FM2DK.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcaggagggtcaccatctcctgcactgggagcagctccaacatcggggcacgttatgatgtacactggtaccagcaccttccaggagcacgcccccaactccctcctctctggtaaccaccaatccggccctcgacggggtcccctgaccgtattctctcggctcgaagtctggcacctcacgtccctcccgtcgcccactccactcggccctccgaggcctagacggtatcggagggtcttagtaatttacttacgtcgaccctacgttacctatcggacaggcctacgcctagaattcgacttagtcgttcgttacggtacgtcgggacctaacgg

SEQ ID NO: 58422 - DNA, 610 bp, Homo sapiens
  misc_feature: GYAE6OF02GJNPU.53.85.H08.1.454.CMB.1.raw
  modified_base (299)..(299): a, c, t, g, unknown or other
  misc_feature (299)..(299): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacaggtcctgggcccagtctgtgctgacgcagcccgccctcagtgtcgtcggggccccagggccaggacgggtcaccatcctcctgcacgtgggagcagctccaacagtcggggctacgttatgatgtacactggtaccagccaccttcaggacncacgaccccaacctcctcctctctacgtaacaccaatccggccctcgacggggtcccctgaccgtattcgtctcggcctacgaacgtctacggccaccttcgacgtccctacccgtcggtacccactcccgtaacgttccggtccccttccggaacgggtccgtagggacggtacgtcggaacggtcttagtaactttacgttaccgtcgaccctacggttaccctagtccgacaggcctacgaccgttagattacggtctttagttccggttaccgttaaccgggtaacgtacgggaacccttaaccggg

SEQ ID NO: 58423 - DNA, 682 bp, Homo sapiens
  misc_feature: GYAE6OF02IT8PT.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtcgtcgtcggggccccagggcaggacgggtccaccatcctcctgcacgtggggacgcagctaccaacgacgtcggggactacgttatgatgtactacgtggtaccagcctaccttccgaggacgccaccgaccccctaacccttccctccttctccgtacggtaaccacctaacgtcccggccctaccggaccggggttccctacggtaccgtactttccgtcgttacggaccgtacggtaacgttccgtacggccctacccgtcgaccgtccctccccgtcggaccctactacccgaccgttccggtaccctacccgacgggtcgtacggacggtacgtcgggacggtacttagttaactttacgttacgccgtaccgtacgttaccgtaagtaccgacgacggtacgtaccggtaccgttagtaacgttccggttactttacgttccggttaccggttaccgggtaacggttaccggggaaccgttaaccggg

SEQ ID NO: 58424 - DNA, 778 bp, Homo sapiens
  misc_feature: GYAE6OF02HBHRH.53.85.H08.1.454.CMB.1.raw
  modified_base (238)..(238): a, c, t, g, unknown or other
  misc_feature (238)..(238): n is a, c, g, or t
  modified_base (263)..(263): a, c, t, g, unknown or other
  misc_feature (263)..(263): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagcccgccctcagtgtctcggggccccagggcagacgggtcaccatcctcctgcacgtgggancagctccaacagtcgggcacgttangatcgtacacgtcggtaaccagtcctacccgttaccgaagggacgcccaaccgaccccccaaacccttccccttccctccgttaccgtacggtaaacccaacccgaaacgttcccggacccccttacggtaccggggttccccctacggaacccgttatttcccgtcggtcgggtacccgttacggaacgtttcccgtcgggtaccctaaccccgttaccgtacccggtcccccttaccccggttcgggaacccctacgttacccggaacccggttcccgggtacccccttaccccggaacgggtaccctaggggtaaaccgggtaggtttccgggaaacgggtttccttaacgggttaacctttttacgttaacccgtcgtacccgttaacgttcccgttaagtccgtaaccgacggaccgtaacccgtccgttaaggaacgttccgtacgttttaaccgttcgttacccggtttaaccggggaaccgttacggggtaaccccttaacccgggg

SEQ ID NO: 58425 - DNA, 633 bp, Homo sapiens
  misc_feature: GYAE6OF02I1UTJ.53.85.H08.1.454.CMB.1.raw
  modified_base (552)..(552): a, c, t, g, unknown or other
  misc_feature (552)..(552): n is a, c, g, or t
tcagcgcgtatacacacgaccggtgctcgatttagtatcactcagtcgcggggtctgcttcagctgtgggcacaagaggcagcactcaggacaatctccagcatggcctggtccctctctcctcactctcctcgctcactgcacagggtcctcggcccagtctgtgctgacgcagccgccctcagtgtcgtcgggccccgagggcaggacgggtcaccatcctcctgcacgtgggacgcagcctaccaacacgtcgggggactacggttaagtcggatcggtacacgttacggtaccacgcctaccttccgagggacgccgaccgaccccctaacctccctcctcctcgtacggtaaccaaccaacgtcccgcccgtacggaccgggttccctacgaccgtacttccttcgtcggtccgtacgacgtcgtaggccctaccgtcaccgtccctcccgtacgcctactccgacgtccggtccctacgacggtcgttacggaacgtgtacggagtccttagtaactttacttacgtacgacccgtagtccttaanacggactacggactcgtcctagacgttattcgtttagttcgttaccggttacggtacggtacgggtaccgtacgtacccgg

SEQ ID NO: 58426 - DNA, 644 bp, Homo sapiens
  misc_feature: GYAE6OF02G0F9O.53.85.H08.1.454.CMB.1.raw
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctaagtgctgacgcagcccgccctcagtgtcgtggggccccagggcagagggtcaccatctcctgcacgtggagcagcctccaacagtcgggcacgttatgatcgtacactcggtaccagtccaccttccgaggacgccacgccccctaaccgtccctcctccttctacggtaaccacctaacgtccggccctcggaccgggtccctcggtaccgtacttcctacgtcggctacgtaacgttcgtaggccctaccgtcaccgtcccttacccgcgtccctatccctacgtccgggaccctccgtacggtccgtaggacggtacgtcggacggtctaggtactttaacttaccgtcgtacctacgttacctagtacgacgacgtaccgtacggtacccttagggatttaccggttacttttacggttacggtttacccgttaaccggggtaaccggttaccggggtaacccttaacccgggg

SEQ ID NO: 58427 - DNA, 832 bp, Homo sapiens
  misc_feature: GYAE6OF02IFKEF.53.85.H08.1.454.CMB.1.raw
  modified_base (187)..(187): a, c, t, g, unknown or other
  misc_feature (187)..(187): n is a, c, g, or t
  modified_base (242)..(242): a, c, t, g, unknown or other
  misc_feature (242)..(242): n is a, c, g, or t
  modified_base (321)..(321): a, c, t, g, unknown or other
  misc_feature (321)..(321): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgagggtcctgggcccagtctgtgctgacgcacgccgccctnagtgtcgtcggggccccagggcaggacggtcaccactcctcctgcacgtgggacncacgcctaccaacgacggtcgggactacgttatgtatagtacctagtacggtaccagtactattccgttaccgaggacnccaacccgaccccctaaccgttccctacctcgtaccgtaacggtaacccaaccgtaacgtcccggacccgtaccggtaccgggttcccctacggtacccgttacttccgttacggtccggtacctacggtaacgttccgtcggtaccctaacccgttccgacccgtaccccgttcccgtccggaccctaacgttcccgtaaccggttcccggtacccctaccgggtacgggtacccgttacggggaaacgggtcgttaacgggtaccgggtcgtttaaacggtttaaccgttttaaccgttaaccgttacccggtaacccgggtttaacccggttttaacccgttaacggttaaccggtaaccccggtaacgggtccccttaaacgggttacccggtttaaacgggtaaccgttttacccgggtttaaccgttttacgggttttaacccgggttttaacccgggtttaaccgggggtaaccccggggttaacccgggtaaaaccccccggg

SEQ ID NO: 58428 - DNA, 687 bp, Homo sapiens
  misc_feature: GYAE6OF02JZ937.53.85.H08.1.454.CMB.1.raw
  modified_base (148)..(148): a, c, t, g, unknown or other
  misc_feature (148)..(148): n is a, c, g, or t
  modified_base (178)..(178): a, c, t, g, unknown or other
  misc_feature (178)..(178): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgcctcactgcacncgggtcctgggcccagtctgtgctgacgcncgccgcctcagtcgtcgtcggggcccagggcaggacgggtcaccattctcctgcacgtgggacgcgacgcctaccaacgacggtccggggactacggttattacggatacggtactacgtacggtaccgacgtccaccgttaccgaaggacgacccgaccctacccccctaaccgtccccttcctcttaccggtaccggtaaacccacgtaacgtcccggtaccctcggtaaccgggtccctaccgtaccgtacttccgtcgtacggtacctacgtaacgtccggtacgcccgaacttccgaccgtacccgtcccgtacgtaccctacgtaccgtaccgtccggtccctacggtacgcgttaacgggcgtagttcggacgtcgtagttaacttaccgttacgtacgtccgacgttaccgtagtccgacgcgtacctccgggtacttaggtaacgttcgtacgttacggttccgtaccgttacgggaaccggtacgtacccggtaaccgg

SEQ ID NO: 58429 - DNA, 573 bp, Homo sapiens
  misc_feature: GYAE6OF02FMU8K.53.85.H08.1.454.CMB.1.raw
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (354)..(354): a, c, t, g, unknown or other
  misc_feature (354)..(354): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtccaccatctcctgcacgtgggancagcctaccaacagtccggggcacgttatgatgtacacgtggtaccagcctaccttcgagacncacgcccccaacctcctcctctctcgtaaccaccatccgccctcgacgggtcccnggacctattctctggctcggtaagtcctggccacccgtcgacgtcccctcccgtcgacctatccacgtcggccctccggaggtccngaggtanggtacgtnttcgtaatttacttaccgcaccttacggttccttaagacgacgtacgacgtaacgcctaggtacttccgttgttacgttcggttccgttaacgggaccggttcgggaacccggtacgg

SEQ ID NO: 58430 - DNA, 719 bp, Homo sapiens
  misc_feature: GYAE6OF02G8CU5.53.85.H08.1.454.CMB.1.raw
  modified_base (242)..(242): a, c, t, g, unknown or other
  misc_feature (242)..(242): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgcccgccctcagtcgtcgtcggggccccagggcaggacgggtcaccatcctcctgcacgtgggancagcctaccaacacgtcggggctacgttatgatgtacacgtcggtaccagcctaccgttaccgaggacgccaccgaccccccaacctccctacctcctacgtacggtaaccaacctaacgtcccggaccctcggaccggggttcccctacggtacccgtactttccgtcgtcgggtccgttacggtaacgttccgtacggaccctaccgtccgaccgtccccttcccggtacggaccctaacgttcccgacccgttccggtcccctaccggacggtccgttacgggaacggtacgttacgggaccggttaccttaggttaacttttaccgttaccgtacggtacccttaacggttcccgttaagtaccgtaccgacggtacccgaacggtacccttaaggtaaccgttcgttaccgttttacgttaccggtttaccggttaacccggtaacggttaccggggtaacccgttaacggg

SEQ ID NO: 58431 - DNA, 834 bp, Homo sapiens
  misc_feature: GYAE6OF02GI9P5.53.85.H08.1.454.CMB.1.raw
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcagccgccctcagtcgtcgtcggggccccagggcaggaggtcaccgatctcctgccacgtgggancagcctccaacagtcggggcacggttangatcgtacacgttggtaccaggcctacccttccgagggacgccaacccggacccccctaaacccttccccgttaccctccgttaccgtacggtaaacccaacccgtaaacgttcccgggacccccttacgggtacccgggggtttccccctacggtaacccgtactttcccttccggttcgggtacccgtacgggtaacgttccgtacgggtcccctacccgttaccgaccggtccccctccccggttacgggaccccttaacgtaccccgtaaccgggttcccggtaccccgttaccccgggaacgggttcccgttaacgggggtaaacgggtacggttaccggggtaaccgggttaccgtttaacgggtttaactttttaaacgtttccggtaccgttaacccgtacggtttacccttaggttaaccggacccgtaacggtcccggaaaccggttacccgttaaggttaaaccgttcggttaacccgttttacgttccgggttttaacccggtttaacccgggtaaccgggttacccgggggtaaacccgtttaaacccccgggg

SEQ ID NO: 58432 - DNA, 689 bp, Homo sapiens
  misc_feature: GYAE6OF02IVQ77.53.85.H08.1.454.CMB.1.raw
  modified_base (126)..(126): a, c, t, g, unknown or other
  misc_feature (126)..(126): n is a, c, g, or t
  modified_base (294)..(294): a, c, t, g, unknown or other
  misc_feature (294)..(294): n is a, c, g, or t
  modified_base (550)..(550): a, c, t, g, unknown or other
  misc_feature (550)..(550): n is a, c, g, or t
tcagcgcgtatacacacgaccggtgctcgatttagtatcactcagtcgcgggtctgcttcagctgtgggcacaagaggcagcactcaggacaatctccagcatggcctggtctcctctcctcctcnctctcctcgctcactcgcacgaggtcctggcccagtcctgtcgactcgcggcacgcccgcctgaagtcgttccgcggggacccaggggccaaggcggtcacctagtcctacgtcgcgacggttgggacgacacgcctaccgaacgtacggccggggtactacggttancgtaagtcgtaacgtacgttcgaaccgagaccctaccgttacgacggtacgcccaccggtaaccccctaccgtccctaccgtccgtacgtacggtaaccaaccctaacgtccggtcccgtacggtaccggggtccctaacggtaccgtactttccgcccgttacggtaccgtaacggttacgttcgaccggacccttaaccgtccgaccgttacccctcgttaccggacctacgtcctaccgtccggtcctaccgngtccggtacgtaggtaccgtgacccgtgtttagtaccgtttaacttcgtacgacccgttagtaccgtagttacacttacggcacgttccgagtacacggttcttaacgttcgtaacgtaccgacgtacgggactacccg

SEQ ID NO: 58433 - DNA, 667 bp, Homo sapiens
  misc_feature: GYAE6OF02ID4WN.53.85.H08.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (506)..(506): a, c, t, g, unknown or other
  misc_feature (506)..(506): n is a, c, g, or t
  modified_base (530)..(530): a, c, t, g, unknown or other
  misc_feature (530)..(530): n is a, c, g, or t
  modified_base (550)..(550): a, c, t, g, unknown or other
  misc_feature (550)..(550): n is a, c, g, or t
  modified_base (561)..(561): a, c, t, g, unknown or other
  misc_feature (561)..(561): n is a, c, g, or t
  modified_base (621)..(621): a, c, t, g, unknown or other
  misc_feature (621)..(621): n is a, c, g, or t
  modified_base (629)..(629): a, c, t, g, unknown or other
  misc_feature (629)..(629): n is a, c, g, or t
tcagcgcgtatacacacgaccggtgctcgatttagtatcactcagtcgcggggtctgcttcagctgtgggcacaagaggcagcactcaggacaatctccagcatcggcctggtctcctctcctcctcactctcctcgctcactcgcacgagggtcctgggcccagtctgtgctgacgcgacgcccgcctcngtcgtcgtccggggcccagggcagggnggtccaacctattcctcctgctacgngggacgcacgcctaccgaactacggtccggggacctaacgtttaagcggtacttacggttaactaccggttcggtaacccgacggtaccctaaacccgttcggacggaccgaccgaccccgtacccccaaccttcccttcctacgtaccgttaaccggtaaaaccacccgtaacgttcccggacccttacggggaccgggtcccgtacggtaccttacgtttcgtacgttcgggtcctacggtaacgtcgtacgccctaccncgccgtccccgtcgacgaccctanccgaccgttacgccctacgnggtcagggaangtagtacggatacgtatttaccagttcgccctagtacttagcacgcggtacactgtacgngttacctntttaccgcgttcggttacgcggttaccggattaaccgg

SEQ ID NO: 58434 - DNA, 806 bp, Homo sapiens
  misc_feature: GYAE6OF02G6OA5.53.85.H08.1.454.CMB.1.raw
  modified_base (262)..(262): a, c, t, g, unknown or other
  misc_feature (262)..(262): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgagggtcctgggcccagtctgtgctgacgcacgcccgccctcagttcgtccggtccggggccccagggcacggacgggttccaacctacttcctccgtgaccgtacggtagggacncgaacgtcctacccgaagtaccggtccgggggtaccttaacggtttagtacggtaagttaccggtaaccttaaccggtaccgggtaaccccgtacggtaccccgttaacccggttacccggaagggtacccgtcccgaaccccgtaccccccgtaaaccctttccccgtacccttaccgttacggtaaccggtaaaccctaacccgtaaacggtccccgggttaaccccgttcgggtacccggggttcccctaacgggtacccgtttacttcccgttaccggtacggttaccggttaccgtaacgttccggtacggtaccctaccgttccgaccgttccccgtaccgtcgtaccctacgtaccgtcccgtacgtcccgtacgacggtcgtacggtacggtacgtcggtacgtcgttagttacttacgttccgtactaccgttgtaccgttagacgccgaggaccgtacgtacgtagtacgttcgttaactttcggttacgttaccggttaaccggttaacgggtacccggtccgttaaaccggg

SEQ ID NO: 58435 - DNA, 807 bp, Homo sapiens
  misc_feature: GYAE6OF02FXMHG.53.85.H08.1.454.CMB.1.raw
  modified_base (134)..(134): a, c, t, g, unknown or other
  misc_feature (134)..(134): n is a, c, g, or t
  modified_base (259)..(259): a, c, t, g, unknown or other
  misc_feature (259)..(259): n is a, c, g, or t
tcagcgcgtatacacacgaccggtgctcgatttagtatcactcagtcgcggggtctgcttcagctgtgggcacaagaggcagcactcaggacaatctccagcatggcctgtctcctctcctctcactctcctcnctcactgcacgacgggtccgtcgggcccagtctgtgctgacgcacgcccgccctcgagtcgtcggtccggggaccccgagggcaggtacgggtccacctatcctccgtgccgtacggtcgggacncgacgtcctaccgaacgtacggtccggggtacttaacggtttagtacggtacgttacgtaaccgtacggtacggtaaccgacggtaccctacccggttaccggaacgggaccgacccgaacccccgtaccccccgtaacccttccccgttacccgttccgtttaccgtaaccggtaaaccctaacccgtaaccggttcccggtacccgtacgggtaccgggttccgtacggtaccgtaccgttacgttcgtccggttacggtaccgtacggtacgtcgtacgtaccgtaccgtaccgtaccgtcccgtccgtaccgtaccgtaccgtaccgtaccgttccgtaccgtaggtaccccccccccccccccccccccggtaggtacggtacggtacggtacggtacggttacgttacgtttacgtttacgttaccgtaccgtaccgttaccgttacgtacgtacgtacgtacgtacgtaccgtacgtaacgttacgttacgttacgttacggttaccggttaccggttaccggtaccggtacggtaaccgg

SEQ ID NO: 58436 - DNA, 742 bp, Homo sapiens
  misc_feature: GYAE6OF02H1XVZ.53.85.H08.1.454.CMB.1.raw
  modified_base (303)..(303): a, c, t, g, unknown or other
  misc_feature (303)..(303): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgagggtcctgggcccaggtctgtgctgacgcacgcccgcccgtcaggtcgtccgtcgggggaccccagggccaggtacgggtccaaccactcctccgtcgcacgtgggagcaacgtctaccaaacgcgtcggggtactacgtatcgactacggtacncgtacggaccacgcctaaccgttccgaggacgccgaacccacccccgtaacctcctaccgtcctaccgtaacggtaaaccaccgtaacgtccgtaccccgtacggtacgggtcccctagtaccgtactttcctcgtaacggctacgggtaaagttccgtaggacccaccgttaccgtcgtaccccgttacccgtcggtaacccacgttcccgaaccgttccggtacccttaccggtaacggcccgtttagggaacggtacggttacggaaccgggttccttaagttaacttttaaacgttacccgttaacggcctttaaacgttaccgaagttacccgacgtaacggtcccgtaaacggttacccgtagttaaccttcggtactttaacgtttcggttaaccgttaccgggtaacgtacccgggttaacgtaaacccgg

SEQ ID NO: 58437 - DNA, 715 bp, Homo sapiens
  misc_feature: GYAE6OF02FOPR9.53.85.H08.1.454.CMB.1.raw
  modified_base (502)..(502): a, c, t, g, unknown or other
  misc_feature (502)..(502): n is a, c, g, or t
tcagcgcgtatacacacgaccggtgctcgatttagtatcactcagtcggcggggtctgcttcagctgtgggcacaagaggcagcactcaggacaatctccagcatggcctggtctcctctcctcctcactctcctcgctcactgcacacgggtcctcgggcccagtctgtgctgacgcacgccgccctcgagttgtcgtcggggccccgagggcaggacgggttccaaccacttacctcctgaccacgtagggacgcacgacctaccaacgtacgtccggggactaccggttatgtacttgtaacctacgtcggtaaccacgccttacccttaccggaaggtacgaccgaccgacccccctaaccttcccctcctaccgtctacggtaaccaaccgtaacgtcccggccctacggtacggggtccctacgtaccgtactttctacgtcggccgtacgtactccgtcgcctacccgtcgcgtccctccgtacgtcctactccnccgtcggccctacccggacggtactacgggtacggtacgtcggtacggtacgttacggtaatttaacttaccggtacgtacccttaaccggtttacttacggtactaccggtacgacggttaaccgtaccgtaaggttaaccgttcggtttacgttcgttacggtttacccggtttaacggggtaacgttacccgggttaccggtaaacccgg

SEQ ID NO: 58438 - DNA, 800 bp, Homo sapiens
  misc_feature: GYAE6OF02FM4J5.53.85.H08.1.454.CMB.1.raw
  modified_base (249)..(249): a, c, t, g, unknown or other
  misc_feature (249)..(249): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctgggcccagtctgtgctgacgcacgcccgccctcagtcgtccgtcggggccccagggcaggacgggtccaccagtcctcctgaccacgtggggacnccgaacgtcctaccaaacgtacgtccgggggtacctaaccggtttagtagtacgtacgttaaccaccggttacggtaaccccgacggtaccctaacccgtttcccgaacggggtaccgaccgtaaccccggtaccccccctaaaacccgtttccccttacccgtttaccgtaccgtttaacgggttaaaaccccaacccggtaaaccgttccccgggtaccccgtaccgggtaaccggggttccccgtaacgtacccggttaactttccgttacggtacggttaccgtaccggtaacgttccgtacgggtacctacccgttcgaaccgtccccgtcccgtcgggtaccctactccgacccgtaccggtccctaccgacggtcgtacgggaggtcgtacggtcggtacgtcgttaacgtttacgtacccgttacgtaccttacgtaccgttaccgtacggacctagacccgtacgtaccggttaacgtaacgttcgttacgttacggttacgttaccggtacccggtaacggttaccggaccgttaacccgg

SEQ ID NO: 58439 - DNA, 675 bp, Homo sapiens
  misc_feature: GYAE6OF02FGLB3.53.85.H08.1.454.CMB.1.raw
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (322)..(322): a, c, t, g, unknown or other
  misc_feature (322)..(322): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacagggtcctcgggcccagctgtgctgacgcacgcccgccctcagtcgtcgtcggggccccagggcaggacggtcaccntctcctgcacgtgggancagcctaccaacgtaggtccggggactaacggttatgtagtacgtaccacgttcggtaccacgcctacccgttaccaggacnccgaccgccccctaaccttcctcctctcgtacgtaaccaccgtaactccgggccctacggtaccgggtccctacgtaccgttattcccgtcgtccggtccgtacgtacgtccgtcgggaccctacgtcgccccgtaccccgttcccgacggaccctaagtcccaacggttcccggtacccctacggaccgggtcgtagggtaacgggtattacggggtacgtcgtttaacgttaacgtttttacctcggtaccaccgttacgttaccctgtaccgactaccggacgtccgtacgacgttaacgttgtaccctttagtccggttacgttacggaaccgtacggtacccgtacgg

SEQ ID NO: 58440 - DNA, 769 bp, Homo sapiens
  misc_feature: GYAE6OF02HNJUB.53.85.H08.1.454.CMB.1.raw
  modified_base (234)..(234): a, c, t, g, unknown or other
  misc_feature (234)..(234): n is a, c, g, or t
tcagcgcgtatacacacgaccggtgctcgatttagtatcactcagtcgcggggtctgcttcagctgtgggcacaagaggcagcactcaggacaatctccagcatggcctggtctcctctcctcctcactctcctcgctcactgcacgaggtcctgggcccagtctgtgctgacgcacgccgtccctcgagtcgtcgtcgggaccccgagggcgaggacggtcacctactcctcngcgacgtgggacgcgacgtcctaccgaacgtacggtccggggactacgttagagtacgtacgtacgtacgtacggtaactacgacctaccgttacgacgacgccgaccgacccccaaccgtcccttacctacctacgtacgtaaaccaaccgtaacgtcccgtaccgtaccggtaccgggtacccgtacgtaccgtacgttaccgtccgttacggtaccgttaacggtaaccgtttaccgggtaccgaccccgttacccgtaccgtaaccccgtccccgttacccgttacgggtaccctaacgttacccggttacccgtccggaccccgttacccgggtacggtcggtaacgggacggtacggttcgggtaacgtcgttaacgttaagtttaaccgtttagtacccgggtaactaccgtaaccgttacctaacggaccgtaacggaccgtaacgggtacctaagggtaaccgttcgtaactttcggttaccggttaccggtaaccggtaaccggtaacggtaaccgttaaccggg

SEQ ID NO: 58441 - DNA, 504 bp, Homo sapiens
  misc_feature: GYAE6OF01B6KG1.26.78.H01.1.454.CMB.1.raw
  modified_base (203)..(203): a, c, t, g, unknown or other
  misc_feature (203)..(203): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcaggaccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtatttgctactttattactgtcagcagcgtagcaactggcctctctactttcggcggagggaccgagggtggagagtcgagacgaacgtggtggctgcaccatcgtgttc

SEQ ID NO: 58442 - DNA, 511 bp, Homo sapiens
  misc_feature: GYAE6OF01BZSPA.26.78.H01.1.454.CMB.1.raw
  modified_base (503)..(503): a, c, t, g, unknown or other
  misc_feature (503)..(503): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcgtccaccagggccactggttcccagccaggttcagtggcagtgcgtctgcgacagagttcactctcaccatcaacagcctgcagtctagaagtattttgctagtttattacttgtcagctagtatcatgactcggccgctccaccttcggaccgaacgggacacgacgttggaagtagtaaacgatggtgctgcacatctntcttctac

SEQ ID NO: 58443 - DNA, 568 bp, Homo sapiens
  misc_feature: GYAE6OF01BWH6A.26.78.H01.1.454.CMB.1.raw
  modified_base (204)..(204): a, c, t, g, unknown or other
  misc_feature (204)..(204): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaaanagccaccctctcctgcagggccagtcagagtgttggctagctacttagcctaggtaccaacagaaacctggaccaggcctcccgaggcctccgtcatctactgatgcatccaacgcgggccacgtggacactcccagcccaggttcagtcggcagtgagtcgtagggacagtacttcactctacacntcancanctagcgtctagacgtatttcgacttactttatactgtacagtacgtagtacgtagaccgtaacgtcggtccctcgttactacgttcgggacggtacgggacgtagggtcggaagtacgtacgaaggacggtaacgtggtacggctacggactacctagttccgtgttacc

SEQ ID NO: 58444 - DNA, 527 bp, Homo sapiens
  misc_feature: GYAE6OF01CV06K.26.78.H01.1.454.CMB.1.raw
  modified_base (332)..(332): a, c, t, g, unknown or other
  misc_feature (332)..(332): n is a, c, g, or t
tcagagactatactcacgaccggtgctcgatttagtgtgagtagtttgggtttgggctgagcgtgggttttccgtcgttgctcttttaagaggtgtccagtgtcaggtgcagctggtggagtctggggggaggcgtggtccagcctggggaggtccctgagactctcctgtgcagcctctggattcaccttcagttactatactatgcactgggtccgccaggctccaggcaaggggctgggagtgggtggcagttatatcatatgatggaagcagcacatattacacagactccgtgaagggccgatcaccatctcagagacaatttgaanaacacgctgtatctagcaaatgaaacagcctgagagctagaagacacggctgttgttttactgtgcgagagagatgacgatgtacaggtagggaactacctgatgtctttacgatatcgtgggaccgtaagggactaagtggtctacggtctcgttacacgccctacccaccgaagggccccagtccggtccccg

SEQ ID NO: 58445 - DNA, 150 bp, Homo sapiens
  misc_feature: GYAE6OF01A10ED.26.78.H01.1.454.CMB.1.raw
  modified_base (130)..(150): a, c, t, g, unknown or other
  misc_feature (130)..(150): n is a, c, g, or t
tcagagactatactcacgaccggtgctcgatttagtgtgagtagtttgggtttgggcacagcggccctgggctgcctggtcaaggactacttccagtatagtctctgagcgggctggcaaggcgcatagnnnnnnnnnnnnnnnnnnnnn

SEQ ID NO: 58446 - DNA, 553 bp, Homo sapiens
  misc_feature: GYAE6OF01CYYBY.26.78.H01.1.454.CMB.1.raw
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggaccaggcctccaggctcctcatctatgatgcatccaacgcggccacgtggacactcccagccaggttcagtcgacagtgagtctagggacagtcttcactctacaccatcagcagctagacgctagaagtatttcgactactttattactgtcagcagacgtagctaacgtcggaccttcgtacctacgtttccgggacgggaacgggaccgtaggggtacggagtacgtcgtaaggacgtacgtaggtcggcgtacggaccaccgtactcgttgttaccc

SEQ ID NO: 58447 - DNA, 526 bp, Homo sapiens
  misc_feature: GYAE6OF01DRYPT.26.78.H01.1.454.CMB.1.raw
tcagagactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaaggccgattcacatctccagagacaatttgaagaacacgctgtatctgcaaatgaacagcctgagagctgaagacacggctgtgttttactgtgcgagagagatgacgatgtacagtggaactaccctgatgctttcgattatcgtggggccaagggacaagtggtacaccgttctccgttcacgtccctaccaccgaacgggcccctagtccggttcccttccccctggcccaccccttcccgtaacccg

SEQ ID NO: 58448 - DNA, 138 bp, Homo sapiens
  misc_feature: GYAE6OF01CF070.26.78.H01.1.454.CMB.1.raw
  modified_base (130)..(138): a, c, t, g, unknown or other
  misc_feature (130)..(138): n is a, c, g, or t
tcagagactatactcacgaccggtgctcgatttagtgtgagtagtttgggtttgggcacagcggccctgggctgcctggtcaaggactacttccagtatagtctctgagcgggctggcaaggcgcatagnnnnnnnnn

SEQ ID NO: 58449 - DNA, 551 bp, Homo sapiens
  misc_feature: GYAE6OF01DDE7N.26.78.H01.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaaggggaangccaccctctcctgcagggccagtcagagtgtggcagctactagcctggtaccaacagaaacctggccaggctcccaggctcctcatctatgatgcatccaagngggccactggcactcccagccaggttcaggtgcagtgagtcgtgggacagtacttcactcgtcaccatcgagcacgcctaagacgcctagaagtattttacgcttactttattacttgtacagcagtcgtacgactaacgtcggcctcgtcgtacgtttcgggcggtacgggaccgtaggggtcggtagacgtacgaggacggtaacgtggtacggcgtcgtaccacctatccgttcgttccg

SEQ ID NO: 58450 - DNA, 573 bp, Homo sapiens
  misc_feature: GYAE6OF01DAQUZ.26.78.H01.1.454.CMB.1.raw
  modified_base (203)..(203): a, c, t, g, unknown or other
  misc_feature (203)..(203): n is a, c, g, or t
  modified_base (465)..(465): a, c, t, g, unknown or other
  misc_feature (465)..(465): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgtggcagctacttagcctggtaccaacagaaacctggccaggctcccaggcctcctcatctatgatgcatccaacgacgggccacgtcggcaactcccaagccgtaggttcaggtcggcagtgagtcgtgggacagacttcactcctcaccatcagcagcctaagacgacctagtaagtattttgacttacttttattacgtgtacagcagcgtagacaacgtcgtccttcncgtacgtttccggacgggtacgggaccgtaggggtcggaagacgtaccgaaggtacggtaacggttcgggtcggcgttacggacctaccgtacttcgttcgttacccg

SEQ ID NO: 58451 - DNA, 507 bp, Homo sapiens
  misc_feature: GYAE6OF01AZXYG.26.78.H01.1.454.CMB.1.raw
tcagagactatactcacgaccggtgctcgatttagtgtgagtagtttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgacaaatgaacagcctgagagctagaagacacggctgtgtttactgtgcgagagagatgacgatgtacagtacgggaactacccgtgagtgtctttgatatcgtagggacaagggacaagtggtcaccgtctctcagccctcaccgaaggcccagtccggtccc

SEQ ID NO: 58452 - DNA, 129 bp, Homo sapiens
  misc_feature: GYAE6OF01A58AB.26.78.H01.1.454.CMB.1.raw
tcagagactatactcacgaccggtgctcgatttagtgtgagtagtttgggtttgggcacagcggccctgggctgcctggtcaaggactacttccagtatagtctctgagcgggctggcaaggcgcatag

SEQ ID NO: 58453 - DNA, 530 bp, Homo sapiens
  misc_feature: GYAE6OF01EYJ2G.26.78.H01.1.454.CMB.1.raw
  modified_base (519)..(519): a, c, t, g, unknown or other
  misc_feature (519)..(519): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccacgtggcatcccagccaggttcagtggcagtgagtctgggacagacttcactctcaccatcagcagcctagacgcctagaagtatttgctactttattactgtcagtcagtcgtagctaacgtcggcctctctacgtttccggcgggtacgggaccgtaggggtggaagtagtcgaaggacgtaacgtggtggcgtgaccaccncttcgtgttcc

SEQ ID NO: 58454 - DNA, 603 bp, Homo sapiens
  misc_feature: GYAE6OF01D2G5Q.26.78.H01.1.454.CMB.1.raw
  modified_base (205)..(205): a, c, t, g, unknown or other
  misc_feature (205)..(205): n is a, c, g, or t
  modified_base (429)..(429): a, c, t, g, unknown or other
  misc_feature (429)..(429): n is a, c, g, or t
  modified_base (466)..(466): a, c, t, g, unknown or other
  misc_feature (466)..(466): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgttctttgtctccgaggggaaanagccaccctctcctgcgagggccagtcagagtgttggcagctactagcctggtaaccaacagaaacctggccaggcctcccgaggctcctcatctatgatgcataccaacgacgggcccacgtcggacactccccagccctaaggttcaggtggacaggtgagtcgtagggacagtaccttcactcacacatcacgcacgtcctaagacgtacctagtaagttnttttgacttactttacttactgtacagtcagtcgtanacctaacgtcggtccttcttaccgtacgttcgggacggtaagggtaccgtaggggtacgaagtacgtaccggaaggaaccggtaacgttcgggtacggtaccgtacggacccaacgttacgttcgttcggtttaccc

SEQ ID NO: 58455 - DNA, 527 bp, Homo sapiens
  misc_feature: GYAE6OF01DKSF5.26.78.H01.1.454.CMB.1.raw
  modified_base (424)..(424): a, c, t, g, unknown or other
  misc_feature (424)..(424): n is a, c, g, or t
  modified_base (505)..(505): a, c, t, g, unknown or other
  misc_feature (505)..(505): n is a, c, g, or t
tcagagactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactcgtgaagggccgattcaccatctccagagacaatttgaagaacacgctgtaatctgacaaatgaacagcctgagagctagaagacacggctgttgttttactgtgcgagtagagatgacgtatgtacaggtggaactacctgatgtctttgaatntcggtgggacgaagggactaagtggtcaccgtctctcacgcctaccaccgacggacccctagtcccggttccttcccccgnggcccacccgttccgtaacccg

SEQ ID NO: 58456 - DNA, 516 bp, Homo sapiens
  misc_feature: GYAE6OF01BTATO.26.78.H01.1.454.CMB.1.raw
tcagagactatactcacgaccggtgctcgatttagtgtgagtagtttgggtttgggtgcccaagctgctggagggcacggtcaccacgcagctggtggagtctgggggaggcgtggtccagcctgggaggcccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaaacagcctgagagctgaagacacggctgtgttttactgtgcgagagagatgacgatgtacaggtgggaactaccctgattgtctttcgatatcgtggggaccgaagggacaagtggtcaccgtctcttcacgcctccaccgacggcccatccggtcccttccccgtgccctccctccctacccg

SEQ ID NO: 58457 - DNA, 545 bp, Homo sapiens
  misc_feature: GYAE6OF01A5N5L.26.78.H01.1.454.CMB.1.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagagtgttggcagctacttagcctggtaccaacagaaacctggccaggcctcccgaggcctcctnatctataatgacatccaacgagggccacgtggacactccccagccaggttcaggtgcagtgagtcgtgggacagtacttcactctacaccatcagcagcctagacgtcctagaagtatttcgacttactttattactgtacagcagtctagctaacgtcgcctcgtcgtacgttcgggcggtacgggaccgtagggtaggagagtacgaaggtacgtaagtggtcggctcggaccacgtatcgtgttctac

SEQ ID NO: 58458 - DNA, 543 bp, Homo sapiens
  misc_feature: GYAE6OF01EKEPE.26.78.H01.1.454.CMB.1.raw
  modified_base (203)..(203): a, c, t, g, unknown or other
  misc_feature (203)..(203): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctcccaggctcctcatctatgatgcatccaacgacgggccacgtggcactcccagcctaggttcagtggcagtgagtcgtgggacagtacttcactctcaccatcagcacgcctagacgcctagaagtattttgacttactttattactgtcagtcagtcgtagactaacgtcggtcctctccgtacgttcgggacggtacgggacgaggggtggacgtagtcgagacgtacgtggtcgcgtcgactaccgtacttcgtcgttccg

SEQ ID NO: 58459 - DNA, 682 bp, Homo sapiens
  misc_feature: GYAE6OF01CA3SZ.26.78.H01.1.454.CMB.1.raw
  modified_base (201)..(201): a, c, t, g, unknown or other
  misc_feature (201)..(201): n is a, c, g, or t
tcagagactatactcacgaccggtgctcgatttagtgtgagtagtttgggtttgggggaggaactgctcagttaggacccagagggaaccatggaagcccagctcagcttctcttcctcctgctactctggctcccagattccaccggagacattgttttgacacagtctccagccacctgtctttgtctccaggggaaanagccaccctctcctgcagggccagtcagagtgtggcagctacttagcctggtaccaacagaaacctggaccaaggccctacccgaggtcctcctacattctagtcgatcgactatcccgaaagacgggccaacgtggacactcccgagtcctaggttacaggtcggcagtgagtcgtagggacagtaccttcacctctacacctatacacgtcacggtaccctaaggaccgtccttaaggtaaagttactttttcggaacctttaactttttaacgttaccttaggtaccgaacggtacgaacggtaccggttaagacccgttaaacgggttcccggtaccctttaccgtaccgtttaccgggtttccgggggaacgggtaccggggaaccgggtagggggttacggaacggtacgtaacggaacggtaacggtaacgttggtacggaccgtacggacctaccgacgtttccgtggttccc

SEQ ID NO: 58460 - DNA, 533 bp, Homo sapiens
  misc_feature: GYAE6OF01BYW5H.26.78.H01.1.454.CMB.1.raw
  modified_base (336)..(336): a, c, t, g, unknown or other
  misc_feature (336)..(336): n is a, c, g, or t
  modified_base (406)..(406): a, c, t, g, unknown or other
  misc_feature (406)..(406): n is a, c, g, or t
tcagagactatactcacgaccggtgctcgatttagtgtgagtagtttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaaggggccattcaccatcctccagagacaattgaagaacacgntgtaatctgacaaatgaacagcctgagagctagaagacacggctgtgtttactgtgcgagagagatgagngtgtacaggtagggaactacccgtagacgtgtactttcgaattatcggtagggaccaagggacaagtcggtcctaccgtctcgttacacgccctaccaaccgaacgggccctacgtccggttccccg

SEQ ID NO: 58461 - DNA, 530 bp, Homo sapiens
  misc_feature: GYAE6OF01AGEI5.26.78.H01.1.454.CMB.1.raw
  modified_base (204)..(204): a, c, t, g, unknown or other
  misc_feature (204)..(204): n is a, c, g, or t
  modified_base (405)..(405): a, c, t, g, unknown or other
  misc_feature (405)..(405): n is a, c, g, or t
  modified_base (473)..(473): a, c, t, g, unknown or other
  misc_feature (473)..(473): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagagtgttggcagctacttagcctggtaccaacagaaacctggccaggctcccaggctcctcatctatgatgcatccaacacgggccacgtggcactcccagccaggttcaggtgcagtgagtcgtagggacagtacttcaccttctacaccatcagcagcctagcgcctgaagtntttgactactttattactgtcagcagcgtagcaacgtcgcctctctacgttcggacggtacggaccgngggtcgagacgtacgaggaacgtacgtggtcggctcggacacctgtcgttgttaccg

SEQ ID NO: 58462 - DNA, 563 bp, Homo sapiens
  misc_feature: GYAE6OF01BBD09.26.78.H01.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (388)..(388): a, c, t, g, unknown or other
  misc_feature (388)..(388): n is a, c, g, or t
  modified_base (554)..(554): a, c, t, g, unknown or other
  misc_feature (554)..(554): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaanagaaacctggccaggcctcccaggcctcctcatctatgatgcatccaacgcgggccacgtggccatccccagccctaaggttcaggtggcaggtgagtcgtagggactagacttcacctctcaccntcagcacgccctagacgccgtagaagtagttggtacgtacttaaattttattacgtagtactaagactaaataataactaccgtcggtccctccgtcttcgtacgtttcggacgggtacggacctagggttagaagtactacgaaagtacgtgtgcgtcgactacnttcgtgtcc

SEQ ID NO: 58463 - DNA, 552 bp, Homo sapiens
  misc_feature: GYAE6OF01BM8UX.26.78.H01.1.454.CMB.1.raw
  modified_base (383)..(383): a, c, t, g, unknown or other
  misc_feature (383)..(383): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggcctcccgaggctcctcatctatgatgcatccaccagggccacgtggtactcccggcagattcgagtggcgaggggtctagggacagaattcactctcacatcaacngcctgcagtctagagtattttgacttagtttattactgtacagctagtatcattgacgtcggccgtctcctacccgttcggaccgaagggaccacggacgtaggaagtaacgttaaacggacgttgggtacgtcgacgaccacctctacttgttccttcgtcgttcccg

SEQ ID NO: 58464 - DNA, 599 bp, Homo sapiens
  misc_feature: GYAE6OF01EURAJ.26.78.H01.1.454.CMB.1.raw
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccacctgtctttgtctccgaggggaaagagccaccctctcctgcagggccagtcagagtgttggcagctactagcctggtaccaanagaaacctggccaggcctccgaggctcctcatctatgatgcataccaacncgggccacgtcggcactcccagcctaggttcagtcggcaggtgagtcgngggacagacttcactctacactatcagcacgcctagacgcctagaacgtagtttcgacttaacttttacttacgtgtacacgtacgacgtcgtacgactacgtcggccttcgtcgtacgtttccgggacgggtacgggaccggtaggggtcgggaacggtacgtaccgaagggtaaccggtaacggttcgggtacgggtaccgttcggaccctaaccgtcgtttccgttcgtttacccg

SEQ ID NO: 58465 - DNA, 620 bp, Homo sapiens
  misc_feature: GYAE6OF01ACJF2.26.78.H01.1.454.CMB.1.raw
  modified_base (302)..(302): a, c, t, g, unknown or other
  misc_feature (302)..(302): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggcctcccgaggcctcctactatttangctgcatcccgaccagggccactggtaactcccgagccaggttcaggtggcaggtcggtctggggacaggtacgttcacgtctaccacctatcaagtcacgccctgacaggtctaggaacgtattggtagtacttaagttttacttacgttgtacaagtaccaaagttaactaacttacccgtggtacccctccggtccttaccgtaccgttttccgggacgggtaacgggtaaccgtaagggttcgacgtaactaccgtaaacgtaacgttggttcggactacggacctaacctattctaccgttcgttactacccg

SEQ ID NO: 58466 - DNA, 591 bp, Homo sapiens
  misc_feature: GYAE6OF01EWS46.26.78.H01.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
  modified_base (426)..(426): a, c, t, g, unknown or other
  misc_feature (426)..(426): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaanagccaccctctcctgcagggccagtcagagtgttggcagctacttagcctggtaccaacagaaacctggccaggctccaggctcctcatctatgatgcatccaacngggccatggcatcccagccaggttcaggtggcgtgagtcgtggacgagtacttcactctcaccactcacgcagcctagacgactagaagtatttagtctaactttatttactcgtanacgcgacgtacggtagacaactacggtccctctccgttaccgtttcgggacgggtacgggaccgtacggggtaggacggtacggtaccgaacggtaaccggaaccgttgggtacgggtaccgtacggtacccaccgttaacgtaccgtttgtcccttttaacccg

SEQ ID NO: 58467 - DNA, 568 bp, Homo sapiens
  misc_feature: GYAE6OF01DVHYB.26.78.H01.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (561)..(561): a, c, t, g, unknown or other
  misc_feature (561)..(561): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaangcccaccctctcctgcagggccagtcagagtgttggcagctacttagcctggtaccaanagaaacctggaccaggcctcccgaggcctcctcatctatgatgacataccaacgcgggccacgtggcactcccagcctaggttcaggtgcagtgagtcgtgggacagtaccttcgaccttctaccacctatcgacgcgacgtcctaaggacgtaccgtaggtaagtacttttcgacttaacttttattacctgtacacgtcgagtcgtacacgtaacgtcggccttcgtcgtacgttcggcgggtacgggtaccgagggtagagagtccgaagtacgtaacgtggtgcgtcgacacgtntcgtgtc

SEQ ID NO: 58468 - DNA, 583 bp, Homo sapiens
  misc_feature: GYAE6OF01D1HVT.26.78.H01.1.454.CMB.1.raw
  modified_base (203)..(203): a, c, t, g, unknown or other
  misc_feature (203)..(203): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaancgccaccctctcctgcgagggccagtcagagtgttggcagcttactagcctaggtaaccaacagaaacctggaccaggcctccgaggcctcctcatctatgatgacactaccaacgacggccagtcgactacgtccagacctaggttcaggtcgacgtaggtgacgtcgagggacacgtacttcactctacactatacgacgctacgtcgtagacgtactagtaagttactttacgacttactttatctgtacagcgtagacgtacgactacgtcgtcttacgtacgtacggttcggacgggtacggacggtagggtacgagtacggtacgaaggtacgtacggtggtacggctacgacgactacgttccgtgttacccg

SEQ ID NO: 58469 - DNA, 537 bp, Homo sapiens
  misc_feature: GYAE6OF01CS38T.26.78.H01.1.454.CMB.1.raw
tcagagactatactcacgaccggtgctcgatttagtgtgagtagtttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaattgaagaacacgctgtatctgcaaatgaacagcctagagagctagaagacacggctgttgttttactgtgacgagagagatgacgatgtacaggtagggaactacccgtgagtcgtcgtttcgattacgtcgtaggggaccgaagggactaagtcggtactaccgttctccttcacgtccctaccaacccgaacgggcccagtcccggttccccg

SEQ ID NO: 58470 - DNA, 773 bp, Homo sapiens
  misc_feature: GYAE6OF01ECM0U.26.78.H01.1.454.CMB.1.raw
  modified_base (208)..(208): a, c, t, g, unknown or other
  misc_feature (208)..(208): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagacttccaccggagactatttgttttgacacagtctccagccaccttgttctttgtctaccgagggaaancgccaccctctcctgcgagggccagtcagagtgttggcagtcttactacgccgtaggtaaccaagacgtaaaccgtggacccgacggcctacccgaggtcctccgtactacgttctagtcggtatcgacctaactacccgaaacgacgggaccctacggtcggacctaaccgtcccgacgtaccgtaaggttccaagggtcggactaagggttcggaacggttcggtaaggggaacctacggttaccttacctaaccgttccgtaaccaaccttacgtacccgaaggcccgtaacgtaccgtaacggtaccgtacccgttaagaaacgttttaacgtttcgaaccttttaacgttttacttaccgttacgtacctaggacgtacggtaaccgtacgtaccgtaacggttccgtaccttcccgttacggttaccgggttccgggacgggtaaccgggtacgggttaggggacgtacggttaacggtaccggtaaagggtacccggtaagttcggtacggtaccgtaccgtaacgacccgtttacggttaccgttcgtttaaccccg

SEQ ID NO: 58471 - DNA, 785 bp, Homo sapiens
  misc_feature: GYAE6OF01CM3FE.26.78.H01.1.454.CMB.1.raw
  modified_base (205)..(205): a, c, t, g, unknown or other
  misc_feature (205)..(205): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagactattgtttgacacagtcctccagccaccctgtctttgtctccgaggggaaancgccaccctctcctgcagggccagtcaagagtcgttggcagctacttagccgtaggtaccaaacgagaaaccctgggaccaggcctaccgaaggtcctcctacattctaagtgaacttgacctaactacccgaaacgacgggcccaacgttcggacctaaccgtacccccgaaggtaccccgtagggtttaccgaagggtttcggggaacccgtaacggggtttagggaacgggtttacccggttaacggggggaaaccccttaacggggttaaacccttttaccccgtaaaacgtttccccgtaaaccccgttaaacccgaaattcccggaaacggacccgtaacggtaccccgttaaagggaccgtacccgttaaaggttaaacgttacgtttttacgactttaaccgttttactttacgtcggtacacggtactacgtaccggtacacgtaaccgtcggtacctacgttaccgtacggttaccgggaccgggtaacggtaccggtagggtacggaagtacgtacgaacggacgtacggtggtacgtcgtacgacctaaccgtcttccgttcgttccg

SEQ ID NO: 58472 - DNA, 548 bp, Homo sapiens
  misc_feature: GYAE6OF01DZY8K.26.78.H01.1.454.CMB.1.raw
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagcccaccctctcctgcagggccagtcagagtgttggcagctacttagcctggtaccaacagaaacctggccaggcctcccaggctcctcatctatgatgcataccaacgacgggccacgtggccaactccccagcccgtaggttcaggtggctagtgagtcgtgggacagcttcactctcaccatcagcacgcctagcgactagaagtatttgctactttattactgtcagcagtcgtagacgtaacgtcggtccttcgtcttacgttcgggcggaacgggtaccggagggtcggagtagtcgaagacggtacgtggtcggcgtcgacctacactgttgttacc

SEQ ID NO: 58473 - DNA, 568 bp, Homo sapiens
  misc_feature: GYAE6OF01A9CPI.26.78.H01.1.454.CMB.1.raw
tcagagactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaaggccgattcaccatctccagagacaatttgaagaacacgctgtatctgcaaatgaacagcctgagagctagaagacacggtctgtgttttactgtgcgagagagatagacgatagtacgaggtagggaacctacccgtagacgttgtactttcgtaatacgtacggtgggggtaaccaaggggtaacaagttacggtccaaccggttctacttcgacgtccctaccgaaccgaacgggtccccacgttcccggttcccttaccccgtggcccctacccgttcccgtaacccg

SEQ ID NO: 58474 - DNA, 594 bp, Homo sapiens
  misc_feature: GYAE6OF01D1NCJ.26.78.H01.1.454.CMB.1.raw
  modified_base (205)..(205): a, c, t, g, unknown or other
  misc_feature (205)..(205): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctgtgtctaccgaggggaaangtcaccctctcctgcagggccagtcagagtgttagtcgcggcttagcctggtaccagcagacacctgggcagactccaggctcctcatttatgctgcactccgaccgagggcctacgtggtactcccagcctagggttcaggtggcgaggttcgggtctgggacaggtacgttcactctacaactatcaagcacgcctgccacgtcctggtaaggttattttagaccttaactttacgttacctgcccaggtcctaagttataagtgtaactttacccctataccgtaccggttccggggaccggggtacacggtccgtaaggaaacgtaaaccggtagttgtacggtctcgaccgtacacgttcttacgttcttactcgtcctacccg

SEQ ID NO: 58475 - DNA, 658 bp, Homo sapiens
  misc_feature: GYAE6OF01C1CX7.26.78.H01.1.454.CMB.1.raw
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaaagagccaccctctcctgcagggccagtcagagtgttggcagctacttagcctaggtaccaacagaaacctggacccaggcctacccaggcctcctcatctatgatgacatccaacgacgggcccacgtggccacgtccccagcccgtagggtttccaggtcggacgtaggtgtaggtccgtaggggaactacggtacctttcgacccttctaccctaaccgtactcgaacgaccaacggtcccgtaacggacggtacccgtaaggtaaacgtttagtttttacggacctttaacgtttttaacttaccgttacgtactagtaccgaaggtaccgtagacctaacgtcggtcccttctacgtaccgtttcgggacggacgggtacgtaggggtcgagacgtacggaagaacggtaacgtgggtacgacgtcggaactaccgtacttcgttcggttcc

SEQ ID NO: 58476 - DNA, 648 bp, Homo sapiens
  misc_feature: GYAE6OF01C3Z1Q.26.78.H01.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaaggggaaanacgcccaccctntcctgcaggccagtcagagtgttgcngctacttagcctaggtaccaacgagaaacctggaccaggcctacccgaggcctacctcactccgtcgtggtcgcactccgaccgacgggccaacgtcggtacgtcccggacagtactccgaaggtggcgacgggggtctaggggacagtaattcactctaccaccactcacctacgtccgagctagtcgtagtaagttagttttgactagttcttaacgttactagtcaagtactaagtttaattaaacttacgtcggttacctcgtttccggttacggggtaccggggggtaccaacggtcgtacggtagacgtacgtaaccgtagttcgtcggtaccttggaccctcttaacttcgttacgttcccgtttacgtaccctttcccggttccccgtccgttaacgg

SEQ ID NO: 58477 - DNA, 772 bp, Homo sapiens
  misc_feature: GYAE6OF01DJE3F.26.78.H01.1.454.CMB.1.raw
  modified_base (200)..(200): a, c, t, g, unknown or other
  misc_feature (200)..(200): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccacctgtctttgctccaggggaangccacctctcctgcagggccagtcagagtgttggcagctacttagcctaggtaccaacacgaaacctggccaggcctcccgaggcctcctcatctatcgatgcatccaacgacgggtccacgtcggacctactaccccgacgtcccgtaagggtttccgaaggtcggactagggtaggtacggtccggtaggggaactacgggtaacctttccctaacctcctaccaaccctagttaccgaacggacctaaccggacccgtttaacggaccggttacccttaagggtaaacgtttactttttacgggtaacctttaacgttttttaacgtttaaccgtttcggtaccgtaacggtcccgtaaaggtccgtttaacggaccgttaaaccgttccgggtaccctttccgtaccgttaacccgggttttcccgggacggggtaaccgggttaaacccggaaggggttaaaccggtaaaacgttaaccggtaaaaccggtaaggtttacggtacggtacccgttacggacccgtaaccgtttacgttaccgtttacgttcccgttaacgttacccg

SEQ ID NO: 58478 - DNA, 599 bp, Homo sapiens
  misc_feature: GYAE6OF01BW5QG.26.78.H01.1.454.CMB.1.raw
  modified_base (431)..(431): a, c, t, g, unknown or other
  misc_feature (431)..(431): n is a, c, g, or t
  modified_base (563)..(563): a, c, t, g, unknown or other
  misc_feature (563)..(563): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgagggaaagagccaccctctcctgcagggccagtcagagtgttggcagctacttagcctggtaccaacacgaaacctggccaggcctcccacgactcctacatctatgatgaccactccaacgcgggcccagtcggaccacgtccccagccgtaggttcagtggcagtgagtcgtgggacagtacttcacgtctccacctatcgagccgaacgtcctagacgtacgtagaaacgttntttagacttaacgtttattactgtacagtcgtagcgtagctaacgttcggcccttctaccgttacggttccgggaccgggtacgggtaccgtagggtcggaagtacgtacggacggtacggtaacgttcggnggtaccgtacgacctaccgtacttcgtacggttacc

SEQ ID NO: 58479 - DNA, 808 bp, Homo sapiens
  misc_feature: GYAE6OF01DRUBK.26.78.H01.1.454.CMB.1.raw
  modified_base (204)..(204): a, c, t, g, unknown or other
  misc_feature (204)..(204): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagactatttgttttgacacagtctccagccacctgttctttgctcgaaggggaangccacctctcctgcgagggccagtcagagtgttggcacgtctacgttagcctaggtaccaaacaggaaacctggaccagggcctaccgaggtcctcctacattcctaagtgaatcggacctaacgttacccaaacgacggggaccctaacggtcggacctaacgtccccgaaggtacccgtagggtttccaaggttcgggaccgtagggttacgtacggttccggtaggggaaacctaggttaaccctttaccaaaccgtttccgtaaccgaaacccctaaggttaccccgaaggaccgtaaccggtacccgttaacggacgttacccgttaaaggtaaacgggtttactttttaccggtaaccgtttaaactttttttaacgtaaccggtttacgtacctaacgggtacgtaacggttaccggttaacggaaccttaaaccgggtccggttaacccgttaccgtttaccgttaaccggggttttaccggggaccgggtaaacgggtacccggtagggggttaccggaaggttaaccgtacgtaacggaccggtaaacggttcgggaccgtcgtacgacctaccgttacgttgtccgtttaccg

SEQ ID NO: 58480 - DNA, 642 bp, Homo sapiens
  misc_feature: GYAE6OF01CQJII.26.78.H01.1.454.CMB.1.raw
  modified_base (277)..(277): a, c, t, g, unknown or other
  misc_feature (277)..(277): n is a, c, g, or t
tcagagactatactcacgaccggtgctcgatttagtgtgagtagtttgggtttgggctgagctgggttttcctcgttgctcttttaagaggtgtccagtgtcaggtgcagctggtggagtctgggggaggcgtggtccagcctgggagtccctgagactctcctgtgcagcctctggattcaccttcagttactatactatgcacgtgggtcccgccaggcctccgagggcgaagggggtctgggagtgggtggctagttatatcatatgatggaancagcacatattacacagactccgtagaacggccgacttcaccatcctaccagagaactaagtttagaaacgaacacgtactagtatactagactaaaagtacgtaaacacgacctagaggacacgtagaacgaaccgacggtacttggtttaggttttaccgtggtacgtacggaagacggaagtacgtaggtaactagtaggtaacgaggtacgggtaaccctaccgtagtacgttcgtcgtttacgtattacgtcggtacgggaccgaagggacctaagtacggtccgtaccgttccgttccgttacgaccgtacccgtaacccgacccggaaccggtccctaccggttccccgttcccccgg

SEQ ID NO: 58481 - DNA, 620 bp, Homo sapiens
  misc_feature: GYAE6OF01CQ26R.26.78.H01.1.454.CMB.1.raw
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaaagacgccaccctctcctgccagggccagtcagagtgttggcagctacttagcctggtaccaacagaaacctggccaggctcccgaggcctcctcatctatgatgcatcccaacgacgggccacgtggcctactcccgagcccgtagggttccaggtggctaggtcgagtcgtgggaacctaggacctttcaccgttctaccaccatccagcacgcctaagacgaccgtagaagttatttcgaccttacttttattacttgtctagactagtacgtagactacgtcggtacccttctcgtaccggtttccgggcgggacgggtaccgtaggggtcggaggtacgtaccggaaggaacggtaaacggttcgggtacggtccgttacggaccgtaaccgttaacgttccgttcggttaccc

SEQ ID NO: 58482 - DNA, 540 bp, Homo sapiens
  misc_feature: GYAE6OF01CIRSQ.26.78.H01.1.454.CMB.1.raw
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
  modified_base (420)..(420): a, c, t, g, unknown or other
  misc_feature (420)..(420): n is a, c, g, or t
  modified_base (487)..(487): a, c, t, g, unknown or other
  misc_feature (487)..(487): n is a, c, g, or t
  modified_base (534)..(534): a, c, t, g, unknown or other
  misc_feature (534)..(534): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaaagngcccaccctctcctgcgagggccagtcagagtgttggcagctacttagcctggtaccaacagaaacctggccaggcctcccgaggcctcctnactctaataatgcactaccaacgcgggccacgtggcactcccagcctaggttcaggtcggctaggtgagtcgtagggacaggtacttcactctacaccatcagcacgctagacgtctagaatntttgactatttatactgtcagcagtgtacacgtactcgcctcgtcgtcgttcggcgggtacggacgngggtaggagatagacgacgagtggtgctcggtacaccgtatccgttntcttcg

SEQ ID NO: 58483 - DNA, 534 bp, Homo sapiens
  misc_feature: GYAE6OF01B4GIA.26.78.H01.1.454.CMB.1.raw
  modified_base (414)..(414): a, c, t, g, unknown or other
  misc_feature (414)..(414): n is a, c, g, or t
  modified_base (453)..(453): a, c, t, g, unknown or other
  misc_feature (453)..(453): n is a, c, g, or t
  modified_base (492)..(492): a, c, t, g, unknown or other
  misc_feature (492)..(492): n is a, c, g, or t
  modified_base (525)..(525): a, c, t, g, unknown or other
  misc_feature (525)..(525): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacatttgttttgacacagtctccagccaccctgtctttgtctccgaggggaaagagccaccctctcctgcgagggccagtcagagtgttggcagctactagcctggtaccaacagaaacctggccaggcctcccgaggcctcctcatctatgatgacactccaacgcgggcccacgtggccactcccagtcgtaggttcaggtcggactaggtgtagtcgtagggacagtaccttcacctctacaccatcagcacgctagacnctagatatttgacttatttatctgtacagtcagtcgtancgactcgcctctcgtcgttcggcggacgggacgtagggngagacgtcgaagacgtagtggtgctacgacacntcgtgttac

SEQ ID NO: 58484 - DNA, 563 bp, Homo sapiens
  misc_feature: GYAE6OF01BKAVG.26.78.H01.1.454.CMB.1.raw
  modified_base (217)..(217): a, c, t, g, unknown or other
  misc_feature (217)..(217): n is a, c, g, or t
  modified_base (384)..(384): a, c, t, g, unknown or other
  misc_feature (384)..(384): n is a, c, g, or t
  modified_base (554)..(554): a, c, t, g, unknown or other
  misc_feature (554)..(554): n is a, c, g, or t
tcagagactatactcacgaccggtgctcgatttagtgtgagtagtttgggtttgggggaggaactgctcagttaggacccagagggaaccatggaagcccagctcagcttctcttcctcctgctactctggctcccagattccaccggagacattgttttgacacagtctccagccacctgttctttgtctccgaggggaaagagccaccctctccngcaggccagtcagagtgttgcagctacttagcctaggtaccaacagaaacctggaccaggcctccgaggcctcctcatctatgatgcactaccaacgacgggccagtggccactcccgagccgtaggttacaggtggctaggtgagtcgagggacagtctcacttcncaccatacgagtcacgccgtagaccgtctagaagtactttcgacttacgttttatctagtactacgctacgcgtacacgaactcggtcctactcgtacgttcgggacggtacgggacggtgggtagaacgacggttcgaaggccggtaagtggagtcgtacgactacgtntccgtgtac

SEQ ID NO: 58485 - DNA, 735 bp, Homo sapiens
  misc_feature: GYAE6OF01BGVD7.26.78.H01.1.454.CMB.1.raw
  modified_base (199)..(199): a, c, t, g, unknown or other
  misc_feature (199)..(199): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagactattgtttgacacagtctccagccacctgtcttgtctcgagggaancgccacctctcctgcgaggccagtcagagtgttgcagctacttagcctaggtacaacgacgaaacctggaccaggcctaccgaggtcctccgtcacttccgtatcggaacttggacctacgtacccgaaacggaccggggaccctaacgtcggacctaccgtaccccgagtaccccgtaaggtttaccgacgggttcggaccgtagggtacggtacggtccgtaggggactaacgtaccttcctacgtaccctaccgaaccacgtaccgacgaccgtaacgacccgttaaggaccgtaccgtaaggtaaacgtttacgttttaccgaccgttttaaccttttacgttaccgttagtacgacggtactaggtaccgtacggaacctaacggttccgtacccttacgtaccgttacgggtttccgggacggggtacggaccgggtagggtacggacgtaacggttccggaaggtaaccggtaacggttggtacggtaccgtccgtaaccgtaaccgtacttccggttcctttacccgg

SEQ ID NO: 58486 - DNA, 632 bp, Homo sapiens
  misc_feature: GYAE6OF01EKYBC.26.78.H01.1.454.CMB.1.raw
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (407)..(407): a, c, t, g, unknown or other
  misc_feature (407)..(407): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaaagagccaccctctcctgcagggccagtcagagtgttggcagtctactagcctaggtaccaacaagaaacctgccaggccncccgaggctcctnatctatgatgacatacccgaacgacgggcccacgtggcctactacccgagcctaaggttcaggtcggacaggtgacgtgtagggactagtaccttacgactctaccaactanacgagcgacgccgtaagacgtacctagtaaacgtacgtttagaccttaactttacttacgttcgtaccagtcgtacgtcgtaacgtaccgtaacgttcggtcccttactaccggttaccgtttaccggggacgggtaacgggtaccgtaagggtacggaacgtacgtacgacgggaaccgtacggtggtacggtaccgtacgacgtacccgtagttccgtggtcc

SEQ ID NO: 58487 - DNA, 712 bp, Homo sapiens
  misc_feature: GYAE6OF01EG909.26.78.H01.1.454.CMB.1.raw
  modified_base (208)..(208): a, c, t, g, unknown or other
  misc_feature (208)..(208): n is a, c, g, or t
tcagagactatactcacgaccggtgctcgatttagtgtgagtagtttgggtttgggggagggaactgctcagttaggacccagagggaaccatggaagccccagctcagcttctcttcctcctgctactctggctcccagattccgaccgggagacattgttttgacacagtctccagccaccttgtctttgctaccgaagggaaagngccaccctctcctgcgagggccagtcagagtgttagaacaacttagcctaggtaccagcagaacctggccagctccagctcctcatctcgtaggtcgcagtccaaccgtaggggccacgtcggtaacgtccccgggacctaggtaacttcgtaagttcgggacggtaacggggggttccgtacggggaaccagggtaaactttccgaaccgttacctccgaacccattacccaacccgacggaccctcgcgtaaccgttccgtacgaaacgttacgtttttcgacccttaagtttttaacttacgttcgttaccgtacgtacaaggttactacgtagtacggtaccgttacgggcccgtaccgttaccgtacccggtttaccggaaccgtaaaccgggaacctaccgaaccgtacgggaaacgtaaacgttaaaacggaaccgtagggtcgtaggtacggccaccgtatccgtacggttacttacgaccttaccgtcccgtacc

SEQ ID NO: 58488 - DNA, 786 bp, Homo sapiens
  misc_feature: GYAE6OF01DOOB0.26.78.H01.1.454.CMB.1.raw
  modified_base (156)..(156): a, c, t, g, unknown or other
  misc_feature (156)..(156): n is a, c, g, or t
  modified_base (487)..(487): a, c, t, g, unknown or other
  misc_feature (487)..(487): n is a, c, g, or t
  modified_base (580)..(580): a, c, t, g, unknown or other
  misc_feature (580)..(580): n is a, c, g, or t
tcagagactatactcacgaccggtgctcgatttagtgtgagtagtttgggtttgggggaggaactgctcagttaggacccagagggaaccatggaacgccccagctcagcttctcttcctcctgctactctcgcctcccagtacttccgaccgganactattgtttacacactagtcctaccacgccctacccttgttctttcgtcctaccggaaggggaaacgcgacccctacccttctaccgtcgaccgacggaccagtacgaaggtaggttggttacggacgtacgtaccttaacgttacggcccgtaaggtaaaccaaacgaacgtaaaccgcgaccgacggtcctacccgagtcccttacctacgtattttacgcgcgtacgactacacccgaccggacggaccctagtacgtacctccgagtccgtaggtcaggtccggatagggttacggtacgagggacgtagtaccgttcaacccgtnaaccctaacgatacgacgtcgacgtccgtagtccgtaagtcctaaggtaactaggttagtaactaacgtttaaatttcgtagacgtacgtaanaaccgttaattaacgtaccgaaccgttccggtacccttacggtaccgtttaacccggtacgggttacggggaacccgggtaaacggtaaccggttaaggttacgtaaaacgtaaccggaaaaccgtaaccgggttagtagggtaccgttccaaacccgttacgaacccttttagtccggtttaaactcccgttccgttaacccccg

SEQ ID NO: 58489 - DNA, 825 bp, Homo sapiens
  misc_feature: GYAE6OF01DMYV8.26.78.H01.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
tcagagactatactcacgaccggtgctcgatttagtgtgagtagtttgggtttgggctgagctgggttttcctcgttgctcttttaagaggtgtccagtgtcaggtgcagctgggtggagtcgtggggggaggcgtggtccagcctggggaggtccctgagactctcctgtgcagcctntggattcaccttnagttactatactatgcactcgggtccnccaggcctccgaggcaaggggctgggagtgggtggctagttatatcaatatgagtggaagcagacacataattaaccacagacgtccgtaggaacgggtccgtattccaacctatactaccctaattaactaacttaatttaggaaacgaaccgtaacgtccgttagtacttaccgtagtaacctaaaaagttcgaaaccgtaacggtcccgtacggaaaggacgtaccgtaacggtaaacggaacccggtaccgggttacgtttacgggttttaacgttttttaacgggtcggttacgggaacggtaaagggtaacggtaacggtaacgttaacgggaacgttaacggttaacgggttaaaccggtaacggggttaaccgggtaaacccgttaaccccgttaggtaaccgtttacgggtttacgttttaaccggtaagtttaaccggttcggggtaaccgggggtaaaccgtaaaacggggaccttaaacgggttccgggttaacccgttaccccgtttacggttacccttacccgtacccgtaccccggttaaccccgaacccggaacccgggtaccccttacggttccccggttaccccccgg

SEQ ID NO: 58490 - DNA, 665 bp, Homo sapiens
  misc_feature: GYAE6OF01B5HHD.26.78.H01.1.454.CMB.1.raw
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
tcagagactatactcacgaccggtgctcgatttagtgtgagtagtttgggtttgggctgagctgggttttcctcgttgctcttttaagaggtgtccagtgtcaggtgcagctgggtggagtctggggggaggcgtggtccagcctgggaggtccctgagactctcctgtgcagcctctggattcaccttcagttactatactatgcacgtgggtccgccaggctccgaggcgaagggggctggaggtgggtggcagttanatnatagtgatgganacagcacatactacaacgagacgtcggtaggaacgggccgtattaccacctactcctaccgagaagaactaagtttagaaacgtaaccacgtacttagtactcgtagaacctaaatacgaacacgcgtaaggagtacggactaaggaacgtacggaccggtagttagggtttacgttttaacgttggtacggtaacggaagggaagaggtaacggtgaacgtaacgtaggttaacggtaggtaccgggtaaaccttccggtagtacgttcttacgtttcgtaagtccggttacggacggggtaacgaaacgggtactaaggtccgtacgttcccgttactcttaccgacgtcccgacccgacgaaccgtccctagttcccgttacccccg

SEQ ID NO: 58491 - DNA, 691 bp, Homo sapiens
  misc_feature: GYAE6OF01BU0TR.26.78.H01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacatttgtttgacacagtctccagccacctgtctttgtctccgaggggaaangccaccctntcctgcagggccagtcagagtgttggcagctacttagcctaggaccaacagaaacctggccaggcctaccgaggcctcctcatctatgatcgacacgtacccaaagacgggcccagtcggacctacgtccccgaagtcccgaaggtttccgagggttcggactaggtcgtaaggtctaggggacaagttaccgttacactcctaccaaaccgtataccgaagcaacggtacctaacggacgtaccgtagtaacggttattttacgacctttaagtttactttacgtacgttacgacgtacgacgtacgtaagacctaacgttccggtaccttcgttaccgtacggttccgggacgggtaacgggtaccggtaaggggtcggtaaacggtacgtaacggtaaggtaaccgggttaaacgtacgggttaccggggtaccttacgggtaacccctaaccgttacgttccgttcggtttaccc

SEQ ID NO: 58492 - DNA, 693 bp, Homo sapiens
  misc_feature: GYAE6OF01DIGXD.26.78.H01.1.454.CMB.1.raw
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (482)..(482): a, c, t, g, unknown or other
  misc_feature (482)..(482): n is a, c, g, or t
tcagagactatactcacgaccggtgctcgatttagtgtgagtagtttgggtttgggctgagctgggttttcctcgttgctcttttaagaggtgtccagtgtcaggtgcagctggtggagtctggggggaggcgtggtccagccgtgggacggtccctgagactctccgtgtgcacgcctctggattccaccttctagttacttatactatcgacactggggtcccgcaggtcctccgagggcgaaggggcttgggaggtgggtgactagttatatcaatatgaatgggaacncagactactattaactacanacgtacttaccggaggaacgggaccacttccgactacttcgaccaagaataaccgtaagttaacgaacgtaaccacggtcttaggtactacgagaacctaaagtacgaacacgcctaggaacgacgtacgtagtaacggaaccgtcgtagtttacggtttattttacggngttaggacgtaggacgtaggtagacgtacgtactacggttaacgaggtacgtaaccgttaccgtagttaccgtcgttacgttacgtacttacgtaccggttaacgggaccgtaacgggtaactacggtcggttacctaccggttcccgttacttacccgccgaccctaacccgacggaacccggtccttaaccccgggtccgttacccccg

SEQ ID NO: 58493 - DNA, 867 bp, Homo sapiens
  misc_feature: GYAE6OF01B2LCN.26.78.H01.1.454.CMB.1.raw
  modified_base (153)..(153): a, c, t, g, unknown or other
  misc_feature (153)..(153): n is a, c, g, or t
tcagagactatactcacgaccggtgctcgatttagtgtgagtagtttgggtttgggggaggaactgctcagttaggacccagagggaaccatggaagcccagctcagcttctcttcctcctgctactctcggcctcccagacttccaccgganacagtttcgttttacgacactacgtctccagccctaccttgttcctttgtacgtccgaaggggtaaacgacgccctaacccgttctcccgtgaccgacggggcctaggttcaaggtacggtggttgctagtaccttacgttaacggccgttacggtaaacccaagtaaacggaaaccgttcggacccgtcgggacccttaccccgagggtccttccgtactaagttcctaagtcggtaacttccggacctaaacttacccgaaaccggtaccgggtaccctaacgttcgggaccctaacccgtaccccggtagtacccgttaaacggttccgtaacgggttcggtaacgtacggttagggtaccgttaccgggtagggtaaaccctaacgggttaaaccctttcccggtaaaaccgtttctaaacccgtaacccgtaaacgttccggaaaccgtaccgtaacggtaacccgttaacggaccgttacccgtaaggtaacgtttaacgtttccgtactttaacctttacggtaccttgtaaccgtagtaccgtaacggtaccgttacgtaaccggtaccgttacggccttaccggtaccgtttaccggttccggggtaaccggtaacggttaccggaggggttacgaacggttacgtacgtaacggaccgttaagggtcggttacgacgttagaccctaacgtcgtcttacggttc

SEQ ID NO: 58494 - DNA, 677 bp, Homo sapiens
  misc_feature: GYAE6OF01BN6N1.26.78.H01.1.454.CMB.1.raw
  modified_base (204)..(204): a, c, t, g, unknown or other
  misc_feature (204)..(204): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaaangccaccctctcctgcagggccagtcagagtgttggcagctacttagcctggtaccaacagaaacctggccaggcctcccgaggcctcctcatctatgatgcactccaacgcgggccacgtggaccactccccgagcccaggttccaggtcggctaggtgagtcgtagggacaggattcactcgtacaccataccaacacgcctgactacgtactagtaagttattttcggacttagttttacttacgtcgttacgacgtcgtaagtatcgtaagtacgtacggtcgggtcccgttaccgttacccgtaacccggtttaccggaacccggtaaacggggtaacccgtaaccgggtaaccggtaacgggtaaacggttaaaccggtttaaaacccggtaacggttacgggttaaccgggtcccggtttacggaaccccgttaacccgtaacgtttcccgtttccgggtttaaccc

SEQ ID NO: 58495 - DNA, 732 bp, Homo sapiens
  misc_feature: GYAE6OF01BVQ7G.26.78.H01.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagactatttgttttgacacagtctccacgccaccctgtctttgtctccgaggggaanagcccaccctctcctgcagggccagtcagngtgttgcagctatagctggaccaacagaacctggaccaggcctccgaggcctcctcatctatgatgcactaccgaacgacggggccacgtcggaccactaccccgagccgtaggttccgaggtcggactagggtacggtagtaccggtacggggaacctacggttacccttccgtaaccctttcgtacccaaccctacgtaccgaacgcctaacgtaccgttaacggaccgtaccggtaaggttaaacgttattttacggtacctttaacttttaacgtttacgtacggttacctacggtcgtacggttaccgtacggaccgttaaccggtcggttacccttccggttaccgttcccgggtttacgggggaccggggtaacgggggacccgggtaaggggttacgggaacggtaagtaccgggtaacgggtaaccggtacggttacgggtccgggaccgttacgaccgtacccttcggttcttccggtttacccgg

SEQ ID NO: 58496 - DNA, 708 bp, Homo sapiens
  misc_feature: GYAE6OF01D2UC8.26.78.H01.1.454.CMB.1.raw
  modified_base (218)..(218): a, c, t, g, unknown or other
  misc_feature (218)..(218): n is a, c, g, or t
  modified_base (271)..(271): a, c, t, g, unknown or other
  misc_feature (271)..(271): n is a, c, g, or t
tcagagactatactcacgaccggtgctcgatttagtgtgagtagtttgggtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagttactatacgtatgctacgtgggtccnccgaggcctaccgaggaccgaaggggtctagggaggtcgggtggacagtttanagtcaatagtgagtgggaagctaagcaactaataattaacaacgagtacttaccgaggaacgggcctaagttacaccatcctaccagagaactaattaggaaactaacgacgtctagttaactcgtagaactaaagttagaaaccgtagaccctaggaagtaacgacgtaaggaaacgaacgtacgggtacttaggtttacgttttacgtacggttagacggtaaggagaagtacgtaagtacgtagttaacgtacggtaaggttacgggaactaaccggtgtaacgttcgttacgttaacgtacttacgtaccggggttaaccgggaacggtaaaacggtaccgtaaacggttcccggtaacgtaacccgttccgttaccgtacgtaccggtaccctaccgaaccgtaacgggtccctaccgtccggttacccccg

SEQ ID NO: 58497 - DNA, 773 bp, Homo sapiens
  misc_feature: GYAE6OF01CDOSL.26.78.H01.1.454.CMB.1.raw
  modified_base (217)..(217): a, c, t, g, unknown or other
  misc_feature (217)..(217): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccgaccggagactatttgttttgacacagtctccacgccctacccttgttcctttgtctaccggaagggggaaancgccctacccttcctccgtgcgacgggccagtacagtagttgttcggcagtctacttcgccgtacggtaccaaacgacgtaaaccgcggtaccacgggtccctcccgacggtccttcccgtactacttcctaggtacgagttaccggcctaaaccgtacccgaaaccgtaccgggggtacccctacgggttcggaccctaccccttacccccggaacggtaccccgttaagggtttcgaagggtcggacgtaggtcgtacggttcggacggaacgtacgtactacgtcctcgacctcagtcacgactacggaccgtagacctacgtagtaacgtttatttacgtactttacgtttacttcgtacgtgtaccgtgtaccgtacgacgttacccgtacggtacccgttaccgttaccttaccggtttacggtaccggggtacggggaccgggtacggggtaggggtacggtagtaccggtacggtaaccggacggttaaacggttcggtaccggttacggtaccctacggttaccttcgttccgttcgtttacccccg

SEQ ID NO: 58498 - DNA, 725 bp, Homo sapiens
  misc_feature: GYAE6OF01BZLFG.26.78.H01.1.454.CMB.1.raw
  modified_base (197)..(197): a, c, t, g, unknown or other
  misc_feature (197)..(197): n is a, c, g, or t
  modified_base (259)..(259): a, c, t, g, unknown or other
  misc_feature (259)..(259): n is a, c, g, or t
  modified_base (672)..(672): a, c, t, g, unknown or other
  misc_feature (672)..(672): n is a, c, g, or t
tcagagactatactcacgaccggtgctcgatttagtgtgagtagtttgggtttgggtgcccaagctgctggaggcacggtcaccacgcagctggtggagtcgtgggggagcgtggtccagcctgggagtccctgagactctcctgtgcagcctcgtggattccaccttcagttactatactatgcacgtcgggtccncagtcctccgaggcgaagggctaggagtgggtggctagttatatcgattgtgagtagggacncagaccactaattaactactacgaacgtacgtaccggtagggaacggccgtaacttaccaacctacgtacctaccgaacgtaacgaacctaaagttttacgaaacgtaaccgtaaccgtcgttaacggtactacgtacgaactaaagttaacgaacgtacgccgtacggaagaacgacgtaacgaacgaccgtacggtacgttagtttcggttttattcggtaggacgtaagaaggtacgtaagtacgtacggtagtacgtacgggtaggtaccggtaaccgtacgtcgtacgttacgttcgttacgtagttacgtacgggtacgggtacccgtaaagggtaacctaggttaccggtacctccgttacgttccgtacctaccgtccccgtaacccgaccgaacccggtacccncgtttaccccggttcccgtaccccgtaccggcccctaccgtccccgtaaaccg

SEQ ID NO: 58499 - DNA, 723 bp, Homo sapiens
  misc_feature: GYAE6OF01BB5NS.26.78.H01.1.454.CMB.1.raw
  modified_base (159)..(159): a, c, t, g, unknown or other
  misc_feature (159)..(159): n is a, c, g, or t
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
tcagagactatactcacgaccggtgctcgatttagtgtgagtagtttgggtttgggtgcccaagctgctggagggcacggtcaccacgcagctggtggagtcgtgggggaggcggtggtccagcctgggacggtccctgagactctcctgtgcagcctntggattccaccttcagttactatacgtatgacacgtgggtccgccaggcctaccgaggcgaaggggtctggaggtggggtggctagtttatgtacatatgagtggaancacgcactattactacagagtctacggtaggacgggctacgtccaacntccacgagacgataagttgaaactacgcgtatagtactcganacaatagaactacgacgtagagtacgtacgtagaaaccggtacgtcggttacgttaggtttttacgtttagtcggtaggacggaaggtacgtaggtaacgtacggtaacgtaaggttacggtaacgtaacgggttaccgggtaaaccctttccggtacgttagttacggtttactttaacggtacgtttaacggttacgggtaacccgggtaaggtaaccggttaacggtaaccgtttcgtaaccccgggtaaccgtttctacccggttaccgaccccggtacccaccggtaacccgggtaaccgtcccggttaaccgtcccgtttccccgtaccccgaccgttaccctccccctacgggtaaccc

SEQ ID NO: 58500 - DNA, 948 bp, Homo sapiens
  misc_feature: GYAE6OF01EN16W.26.78.H01.1.454.CMB.1.raw
  modified_base (401)..(401): a, c, t, g, unknown or other
  misc_feature (401)..(401): n is a, c, g, or t
tcagagactatactcacgaccggtgctcgatttagtgtgagtagtttgggtttgggggaggaactgctcagttaggacccagagggaaccatggaacgccccagctcagcttctcttcctcctgctactctgcctcccagtacttccgaccggagtactattttgtttcgacacgtacgtctccgacgaccctaccttgttctttgtccgtaccggaaggggaaactacgccctaaacccttctccgtgaccggacgggccctagtacgaggtacgttggttcggacacggtacttacgttacgccgttacggtaaccaaacaaccggaaccgtcggacccgaacggtccccgtacccgtaggtcccttaccgtacctaagttccgtattggtaacgtacncctaaccgaaccggaaccggaccgggtacctacggtccggtacctacccggtcccgaacggtaccccggttaagggttccgtaacgggtccggtaacgtacggttacgggtacggtacccggttacggggaacctaacgttaaccgtccctaacgttaccctccgtaaacctcggtaaccgacggtaaccgtaccgtaaccgtaacggacccggttaacgttaacggttaacgtttacgtttaaccgtactttttaacgttttacgtttaacgttacggtaacctacgggttaacccgtaacggttaccggtaacgtaccgttaacccgggtttaccggtaccccgtttaaccgggtttcccggttaacccgggggttaccgggggttaacccgggggttaccgggtaaacccgggggttaggtaaccgggtaaacggtttcgggaaaacccgggttaaggtaacccggtaaacggggtttccgggtaccgttaccggggttaccggtacctaacccggttttacgtacgtttccccgtttaaccgg

SEQ ID NO: 58501 - DNA, 919 bp, Homo sapiens
  misc_feature: GYAE6OF01CER01.26.78.H01.1.454.CMB.1.raw
tcagagactatactcacgaccggtgctcgatttagtgtgagtagtttgggttgggggagaactgctcagttaggacccagagggaaccatggaacgccccagctcagcttctcttcctctgctactctggcctccagtacttccgaaccggagtaaatagtgatcgacgctagtccaccgagcccacctgtctgtcgtccgtaccggaaggggaaagtaccgtcccaccccgttctccgtacgaccggacgggccaggtcaaggtaggttcggttaggccgacgttacgttacgccggttacggtaccgagccgaacgtaacccggaccgtagggaaccacggtacccacccgtaaggtccttcccgttaattagtttacgcggtacctcgaacccgtactaccccggacggtaccggtacctacgggttacgtacccacccggacgtccggtaacggttacgacggtcggtaccggttaggggtcccggggtagtaccgggtaatacgggttaccttaccgaccgttaacctaccccggttaaaccgacgttaacgaaccggtaccgtaccgtaccgtccggtaactacggttaacccggttaagttaacgttaacgggttagtaaccggttaactttaacgtttaaccgtttacgttaacggttaacgtaaccgtaaaccgtttaaacgttaaccgtaaaccgttacccgggtaccgttacccggttaccgtaccgttttaacccgggttaccgggtttaaccggggtaacccgggtaaacgggtaaacccgggttaagggttaaacccgtaaacgggttaacccgtaaaacccgttaacgggttaacccggttagggttaccgttaaccgggtaacggtaaccttaaccgttaaccgtttacccggtttaacccgg

SEQ ID NO: 58502 - DNA, 934 bp, Homo sapiens
  misc_feature: GYAE6OF01A63CY.26.78.H01.1.454.CMB.1.raw
tcagagactatactcacgaccggtgctcgatttagtgtgagtagtttgggtttgggggaggaacgtgcgtcaccgttacggacccgtacgagggaacctatggaagtccccgagctcagcttcctcttcctcctgctactctggctcccaggtattccgaccggagactattttggtttttcgactacgtacgttacctttaccgacgccctacccgttggttcgtttggtccgtacccggaaggggggtaaacgtacggaccccgtaccccgttccggtacccgggttcggaccggtacggggtacccccgtaaggtccccgggtaagggggttaccggtttggggtttcgggacctaccggttaccgttaaccgttacgggtccccgtacgggttaaccccaaacgtaacgggtaaacccgtccggacccgtaccgggtaccgttaccccgttaacgggtaccctttccttaccgtaattcccgttaagttccggtaaccgttccggaacctaccttaacccggaaacgggaccgggtaacctacggtacggacctaccgtcccgtaacgtccggtaaggttacggacggtacgtacgtaacggtagtaacgtcgtaacgggtactaacggtaccttaaccttacttcccgtacgtaaccgagtaccgaactacgacgtacccggtacgtcccgtagtaggtaaacttacgttacgtaacttacgtttatacgttcgtacgcgttaagcggtaccgttacgaccgtaaccgttccggtccttaccggttaccggttacgggtacccggggacgggtaccgggttgggacgggttacggtaacttaccgggtaacgtacgggtaaccggtcgggtacggggttcgaaacggttcccggaacggttaccgttccggttacggtttcggtacccg

SEQ ID NO: 58503 - DNA, 805 bp, Homo sapiens
  misc_feature: GYAE6OF01BRU7B.26.78.H01.1.454.CMB.1.raw
  modified_base (176)..(176): a, c, t, g, unknown or other
  misc_feature (176)..(176): n is a, c, g, or t
  modified_base (218)..(218): a, c, t, g, unknown or other
  misc_feature (218)..(218): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
tcagagactatactcacgaccggtgctcgatttagtgtgagtagtttgggtttgggggaggaactgctcagttaggacccagagggaaccatggaacgcccagctcagcttctcttcctcctgcctactctggctcccagtattccaccggagactatttgtttgactacgagtcncctacgccaccgttgttctttgtcctaccggaagggggaaanacgcccacccttctccgtcgcggacggcctagtcgagngtgtgcngtctacgtgccgtacgtaaccaacgaacgtaaaccgtcggaccacggtcccgacccgacggtcctccgtacacttactagtagacttcgaactacgtaccgaaccggtcgggacccacgtcggaccctaaccgttacccggacgtacccggtacggtttacgaggttacgacggtagtcgacggttcgaacggtacctaacggtaccttacaaccgttcctaaccaaccgtctaccggaacgtccgtaccgtacgtaacgtacgtaccggttaagtaaccgtttagttaacgtttccgtttaacgtttttcgttaaccgttacgtttaccgacggttacgtcggtaaccggtactaaccgttaaccgttcccggttaccgttacccgttaccggtttcggggttaccggggtaccgggaaaccggggttaccgggtaagggggttaccaacggggttacctacgggttaaacggaccggtaaaggttcgaacccgggtcgttaacccgccttaaccggtacccttggttccgtttaaccccg

SEQ ID NO: 58504 - DNA, 1017 bp, Homo sapiens
  misc_feature: GYAE6OF01DTPBZ.26.78.H01.1.454.CMB.1.raw
tcagagactatactcacgaccggtgctcgatttagtgtgagtagtttgggtttgggggaggaactgctcagttaggacccaggagggaaccatggaacgccccagctcagtcttctcttccctcctcgctactctggcctcccagtacttccgaccggagactatttgtttagaccactagtcctaccacgccctacccttgttcctttcgtacctaccggaaagggggaaacgccgcccctaccccttccgtccgtcggaccggaccgggacctacggtcgaaggtgggtttcggttacggaccgtagtaccgttaaccgttaccggtcccggtaacggtaaccaaacggaaccgtaaccggtccgggaccgtaacggtccctacccgacggttccctaccgtacacgttactagtagtactcgtacctaacctaacccggaacggtaccgggaccctacggtaccggtacctaccccgtacccgtacggtaccggttacggtacggtcgggtaggacgtaaggtcggtacggtacggttacggaaccgttaacgtcccgtttaaccacccgttaccaaccgtaccgtaccgtaccggtaccgacccgtaacggtttaaccggtaaccgggtacctaaccgggtttaaaggttttaccggtttaacccgtttttacggtttaaacccttttaaccgtttttaaccggtttaccggttaacggttaccctaaccgggttaaccgggtaacggtttcccggggtaaaaccctccggttttaaaccccggtcccgggttacccccttttaacgggttttccccggggtttaaacccgggggttccggggggaaaacccggggttccggggggtaaacgggggttaaccggggtaaccggggttaaaggttaacccgtaaaccgggtaaaccgggttaacgggtaacgggttttcgggaccccggttaaacggttacccgaaccgttcggtttaacccgtttccgttaaccgtttccccg

SEQ ID NO: 58505 - DNA, 209 bp, Homo sapiens
  misc_feature: GYAE6OF01CLUKS.26.78.H01.1.454.CMB.1.raw
  modified_base (181)..(181): a, c, t, g, unknown or other
  misc_feature (181)..(181): n is a, c, g, or t
  modified_base (188)..(209): a, c, t, g, unknown or other
  misc_feature (188)..(209): n is a, c, g, or t
tcagagactatactcacgaccggtgctcgatttagtgtgagtagtttgggtttgggctgagctgggttttcctcgttgctcttttaagaggtgtccagtgtcaggtgcagctgggtggagtcgtggggggagcgtgggtcccagccctggggacgtccctgacgctctcgtgtgcagcctntgacttnnnnnnnnnnnnnnnnnnnnnn

SEQ ID NO: 58506 - DNA, 959 bp, Homo sapiens
  misc_feature: GYAE6OF01CQOUO.26.78.H01.1.454.CMB.1.raw
  modified_base (152)..(152): a, c, t, g, unknown or other
  misc_feature (152)..(152): n is a, c, g, or t
  modified_base (174)..(174): a, c, t, g, unknown or other
  misc_feature (174)..(174): n is a, c, g, or t
  modified_base (212)..(212): a, c, t, g, unknown or other
  misc_feature (212)..(212): n is a, c, g, or t
  modified_base (928)..(928): a, c, t, g, unknown or other
  misc_feature (928)..(928): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggcctcccagtactcgacgganactatttgttcactagacgtcncacgcctcctgttcttcgcgtaccgggaaggggaaacnccgacccctaccctcgttcccgacggaccggtacgggaccctacggtaacggacggtttaagggttgggtaccggacgtaaccgttaccggtttaaaccggttacccgtcccggttaaaccgggtaaacccctaaaaaccggtaaccggtaaaacccggggttcccgggaaccccggttaccgggtacccccggtttaacccccgggaagggttccccttaaccccgttagtaaaaccggtttttacctagggtaaccggttaaacggtcccggtaaaccctaaaccggttaaccccggaaaacgggggtaccccgggttaaccccgaacgggtttcccgaacccgtaccccgttaccccggtaacggttaccgggttacgggtaacccggtagggggtaccgtaccggtaagggtacggtttaccggggtaccggtaacgggaccctttaccgtacccgtacctaccctttacgtacctaaaccgtgaccggtaacgacgtacgtaccgtaacggtcgtaaccgttaagttacgttacgtttaacgtaccttttaacgtttactacgtcgtagacggtaccgaaggttcccgtaacgtcccgtaacgtttccggaacccgttttcgtaccgggttaacggttaccggggccgtaaacgggggccggtaggggtaccgtaggaacgtacggtaaggacggttacggtcgtacgggntaaccccgattacctcgttcgttccgttacg

SEQ ID NO: 58507 - DNA, 888 bp, Homo sapiens
  misc_feature: GYAE6OF01BBEGD.26.78.H01.1.454.CMB.1.raw
  modified_base (199)..(199): a, c, t, g, unknown or other
  misc_feature (199)..(199): n is a, c, g, or t
tcagagactatactcacgaccggtgctcgatttagtgtgagtagtttgggtttgggtgcccaagctgctggagggcacggtcaccacgcagctggtggagtcgtgggggaggcgtggtccagcctgggacggtccctgagactctcctgtgcagcctctggattccaccttctagttactatactatgcacgtggtccnccgagctcgaggcgaaggggctagggaggtgggtggactagttaatacgtctaagtatggagtaggaagcgagacactattaacttacaactacgtaccgttaccggaggaacggcctattacccgaccacgttcgtaccgagtaacgaccgttaaagtttacgggaaacaaccgtacggtaccttgtaactcgtaaacgtacaaaacgtagtaaaccacgtaccgtaggaacgacggtacgtaaggaaacgaccgttacggttcgtttaacggttttagttttacgtacggttcggaacggttaagggtaacggacggttaaaggtacggtaacccggttaagttaccgggtaaacggttacggggtaaaccggttaacccttaccggtacggttacgttacggtttaccgtttaacggttaacggttacccgttacgggggttaaaccggggtaaaccgggttaaacgggtaaaccgtttaacgggttacccggttaccccgttacccggttttaaccctcggtttaacccggtaccccggttacccccgttaaacccggtaaacccgggtcccccggggtttaccctttaccccgggtttaccccccgggtttaacccccccgttacccccggttacccccggtaaccccccggtttcccccgtaaacccccggttaaaccccggg

SEQ ID NO: 58508 - DNA, 807 bp, Homo sapiens
  misc_feature: GYAE6OF01A0BS9.26.78.H01.1.454.CMB.1.raw
  modified_base (175)..(175): a, c, t, g, unknown or other
  misc_feature (175)..(175): n is a, c, g, or t
  modified_base (737)..(737): a, c, t, g, unknown or other
  misc_feature (737)..(737): n is a, c, g, or t
tcagagactatactcacgaccggtgctcgatttagtgtgagtagtttgggtttgggggaggaactgctcagttaggacccagagggaaccatggaagccccagctcagcttctcttcctcctgcttactctggcctcccagacttccgaccggagactatttcgttttgactacngtcctccacgcccaccttgttctttgtcctacggaaggggaaacacgccctaccctctccgtgcgacgggcctagtcagtagtgttacgcgacggtcttacgccgttacggaaccaacgaggtacgtcgtacggacctacgggtccctaccccggctcccgtactacgttaccgtaccggaactaccgtaccccggaaacccgggtccacggttacggacctaaccggttacccaaggacgttaagggttccgagggttcgggaccgtaggggtccggttactacgggaacgtaacgtaaccgttaacgttccgtaaccctttctaaccgtaacgttacgaccgtacaccggtactacccggttaagaccgtacgtttaacggtaagtttctttacctacgttttaacctttacgttacttaggtacgtaacgtacggtagtaaccgttacgaccgttaacgtccgtacccttccgtaccggttacggtccgggacgggtaccgggtacggttagggtaggacggtaacgtacggtaacgaccggtaaagtcggtccggtanacggtaccgtaacccgtaggtttaccgttacctttacccgttacgtttaacccgttcccttacccgtacg

SEQ ID NO: 58509 - DNA, 831 bp, Homo sapiens
  misc_feature: GYAE6OF01DCX97.26.78.H01.1.454.CMB.1.raw
  modified_base (151)..(151): a, c, t, g, unknown or other
  misc_feature (151)..(151): n is a, c, g, or t
tcagagactatactcacgaccggtgctcgatttagtgtgagtagtttggggtttgggggaggaactgctcagttaggacccagagggaaccatggaagccccagctcagcttctcttcctcctgctactctgctccagattccgaccgganactattgtttgacacagtctccacgccctacccttgttctttgtcctaccggaagggggaaacgacgtccccaccccttcctccgtacggcggacgggcctaggtccaaggtagttggtggacacggtcttacgttacgccgtacggtaaccaacgaacgaaccgtcggaccgacggtacctaccccggagtccttacctgtacttactacgtgtactcgacctaaccgtacccggaacgaccgggacctaccggtacggacctacccgtaccccgaggtacccgtacgggttaccgtaggttcggaccgtaggttacggcgttacggtagggaactacgttacccttcgaccttaccgtaaccgactaccgtacaacgttccggaacgtaccggtaacgtacggtacccgtttaaggtaaccgtttttaagtttaccggttacccttttaaacgtttttacgttaccgttcgtaacctacgggtaccgagttaccggtaacgtaccttaacccggttccgttacccttacgtaccgtttaccggggttccgggacgggttaaccccgggaggttacgggtacggggtaacgaccggtaaaccgtaagggaacccgggtttcgacgggtttccgaccgggttaaccgaccgtaaccgtttccgtcgtttccccgttaccg

SEQ ID NO: 58510 - DNA, 902 bp, Homo sapiens
  misc_feature: GYAE6OF01A1J0I.26.78.H01.1.454.CMB.1.raw
  modified_base (154)..(154): a, c, t, g, unknown or other
  misc_feature (154)..(154): n is a, c, g, or t
  modified_base (215)..(215): a, c, t, g, unknown or other
  misc_feature (215)..(215): n is a, c, g, or t
tcagagactatactcacgaccggtgctcgatttagtgtgagtagtttgggtttgggggaggaactgctcagttaggacccagacgggaaccatggaagccccagctacagcttctcttcctcctgctactctggctcccagacttccaccgganactatttgttttcgactacagtctccacgccaccttgttctttgtctaccgaagggaaacncgaccctaccctctcctgcgacggccagtcaggtgtgttggcagtcctaacttcgcctacggtaaccaacgacgaaccgtcggaccacggtccctccgaggtccctcctacacttactagtgtaagtcgacctaacgtacccgaaacggtaccggccctaacggtccggacctaacccgtaccccggtaacggttacccggtaacggtttacgaacgggttccggtaacctagggggttacgtacccgggtttccgggaacgggtaaccgtaaacgttacccgtttacccacccttaccgtaaccacccgtaacttcccggacaacccgtacgtacccgtagtaaccggaccgtttaaggtaactttaagtttccgtaaccgttttaactttaacgttaccggtacgttacgaacgttacccgtaaggtaacccggttaagtacccggttaaccggtaccggtttaccccgttacccggttttaccgggttaaaacccgggggttccgggaaccgggggttacccgggtaaacggggttaaccgggggtttaagggaaacccttaacccggggtaaccgggttaaacccgtaaaccgggtttaccgggtacggggttacccggtaaacccgttcccggtaaacccgttaaccccgggttattttccccgttaaccgggtttaacccc

SEQ ID NO: 58511 - DNA, 758 bp, Homo sapiens
  misc_feature: GYAE6OF01BJ3DP.26.78.H01.1.454.CMB.1.raw
  modified_base (180)..(180): a, c, t, g, unknown or other
  misc_feature (180)..(180): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
tcagagactatactcacgaccggtgctcgatttagtgtgagtagtttgggtttgggctgagctgggttttcctcgttgctcttttaagaggtgtccagtgtcaggtgcagctgggtggagtcgtggggggaggcgtgggtccagcctggggaggtccctgagactctcctgtgcagcctntggacttcaccttcagttactatactatgactacgtcggtacccgccaggctccgagggcaaggggtctggaggtggggtgcaggttatatnatatagataggaagcagcanatactaccacagactacggtgaacgggcattaccactactctaccgaagacgaactaaacgtttagaaacgtaaccacggtacttagttaactacgtacgtaacgaaagttaacggaaactaccgtaccgtaggaacgtacggtacgtaacggaaacggtaccggtaacgggtacgttacgggttttacgttttaccggtggttacgggacggtaaggtaggtaacggtagtaacggtaacgtagtaccgtaacggtacgggtaaccggtaaccgttaccgtacggtaacgttacggtttacggttacgttacgttacgttaccgggtaacgggaaccggtaacggtaaacgtaacggtaccggtaccgtaacccgtttcgttaaccgtacccgtaccccggtacccttaaccccggaacccggtaacccgggtacccggtaaccgttccccggttaaccccccgg

SEQ ID NO: 58512 - DNA, 503 bp, Homo sapiens
  misc_feature: GYAE6OF02IT3PQ.26.78.H01.1.454.CMB.1.raw
tcagagactatactcacgaccggtgctcgatttagtgtgagtagtttgggtttggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctccaggctcctcatctatgatgcatccaacagggccactggcatcccagccaggttcagtggcagtgagtctgggacagacttcactctcaccatcagcagcctagagcctgaagtatttgctactttattactgtcagtcagcgtagcaactggcctctctactttcggcggacgggaccgagggtggagagtcgagacgaacgtgtggctgccaccagtctgtc

SEQ ID NO: 58513 - DNA, 512 bp, Homo sapiens
  misc_feature: GYAE6OF02GO1FO.26.78.H01.1.454.CMB.1.raw
tcagagactatactcacgaccggtgctcgatttagtgtgagtagtttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagagatgacgatgtacagtgggaactacctagatgctttcgatatcgtgggaccaagggacaagtggtcaccgttctccttcgacgcctaccaccgaacgggcccacgtcggtccccg

SEQ ID NO: 58514 - DNA, 519 bp, Homo sapiens
  misc_feature: GYAE6OF02FQSLO.26.78.H01.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
tcagagactatactcacgaccggtgctcgatttagtgtgagtagtttgggtttgggggaggaactgctcagttaggacccagagggaaccatggaagccccagcgcagcttctcttcctcctgctactctggctcccagattccaccgcagaaattgtgctgacgcagtctcccgggaccctgtctttgtctccaggggaaagngccaccctctcctgcagggccagtcagagtgttagcaactactatttagcctggtaccaacagaagtctggccaggctccccggntcctcatctacggaacatcccaaccgggccactggcatcccagacaggttcagtggcagtgggtctgagacagacttcactctcactatcagcagactggagcctgaagtattttgcagtgtattactgtcagcagtatgctacctctactttccgtgtacttttggccgtagggaccagctggatatacaacgaactgtaggctagcacctatcctgtcttcgtatccg

SEQ ID NO: 58515 - DNA, 524 bp, Homo sapiens
  misc_feature: GYAE6OF02JYAZN.26.78.H01.1.454.CMB.1.raw
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacngggccactggcatcccagccaggtcagtgcagtgagtcngggacagacttcactctcacatcagcagcctagacgctgaagtatttgactactttattactcgtcagtcagcgtagcaactcggtcctctctacgtttcggcggacgggtaccgagggtcggagtacgtcgaaggacgtaacgtggtacggctacgcgaccgacttcgtactcg

SEQ ID NO: 58516 - DNA, 524 bp, Homo sapiens
  misc_feature: GYAE6OF02GJFG8.26.78.H01.1.454.CMB.1.raw
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcttcatctacggtgcatccaccagggccactggtactccccgcaggttcagtggcagtgggtctgggacggagttcactctcaccatcagcagcctgcagtctgaggtattttgctaacttattactgccagcaagtataatgattaccctatctaccgttcgggccggggacacggctaggaaactaaacgaactgtgctgcacatctgtcttcacttctcccgcactctgtaacg

SEQ ID NO: 58517 - DNA, 734 bp, Homo sapiens
  misc_feature: GYAE6OF02GP18I.26.78.H01.1.454.CMB.1.raw
tcagagactatactcacgaccggtgctcgatttagtgtgagtagtttgggtttgggtcgtgagctgggtttccttcgttgtctcttttaagtaggtgtccagtgtcaggtgcagctggtggagtctgggggaggcggtggtccaggcctgggaggtccctggagactctcctgtgcagcctctggattcaccttcagttactatactatgcactgggtccgccaggctccaggcaaggggctggagtgggtggcagttatatcatatgatggaagcagcacatatactacagactccgtagaagggccgagttcaccatctccagtagaccgtaatttagaagtaacaacgactagtatctagaccaaatgaaacagcctagagacgctagaagaacgacggtactggttagtttttaccgtagttcggacgaaggtaaggaaggtaattcgggaaacgtaacgttaggttaacgaaaggttacgggggtaaacccttaaaccccggtacggtaacgttagttacccgtttttaaccggaatttaaaccggttccggttaacgggggtaccccgggtaaaacgggggtaaccgaaacggtttacggggtttaacccgaaacccccgggttttcgttaaccccgtttccgttaaccgggtcccctttaacccccgaacccgggtaaacccgggtacccccgttaaccgggttccccggtttttaacccccccggg

SEQ ID NO: 58518 - DNA, 537 bp, Homo sapiens
  misc_feature: GYAE6OF02J1DFV.26.78.H01.1.454.CMB.1.raw
  modified_base (203)..(203): a, c, t, g, unknown or other
  misc_feature (203)..(203): n is a, c, g, or t
  modified_base (405)..(405): a, c, t, g, unknown or other
  misc_feature (405)..(405): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctccaggcctcctcatctatgatgcatccaacacgggccacgtggcactcccagcctaggttcaggtggcaggtgagtcgtgggacagacttcgactctcaccatcagcacgcctagcgcctagaatntttcgactactttattactgtcagcgtagtcgtagctaacgtcgcctctccgtacgttcggcggacgggaccgagggtcgagtacgcggacgacgtaacgtggtcgcgttcgccgtacgtacgtcgtgttcc

SEQ ID NO: 58519 - DNA, 632 bp, Homo sapiens
  misc_feature: GYAE6OF02IQEGB.26.78.H01.1.454.CMB.1.raw
  modified_base (202)..(202): a, c, t, g, unknown or other
  misc_feature (202)..(202): n is a, c, g, or t
  modified_base (381)..(381): a, c, t, g, unknown or other
  misc_feature (381)..(381): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgctccaggggaaangccaccctctcctgcagggccagtcagagtgttggcagctacttagcctggtaccaacagaaacctggccaggctacccgaggcctcctcatctatgatgcatccaacaggccatggcatcccagccaggttcagtgcagtgagtcgtagggacaggacttcacgttcacaccatcgancgacgcctaagacgaccgtagaacgtattttacggacttaacgttttaacttaaccgtgttaccgaacgtacgtaggtaccggttaacgaccgtaaaccgttcgggtaccccttacttacccgtaaccgttttacgggaccggttaacgggggaaccgtacgggggttacggtaacggtacgttacggtaacggaaccggtaacgtccggttggacgtcggtactacccgtaagttccgttagtttacccg

SEQ ID NO: 58520 - DNA, 517 bp, Homo sapiens
  misc_feature: GYAE6OF02GL0BE.26.78.H01.1.454.CMB.1.raw
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagacgcctagaagtatttgctactttattactgtcagcagcgtagcaactggcctctctacgtttcggcggacgggaccgagggtggagtacgtcgaaggacggaacgtggtggcgtcgccaccattctgttcc

SEQ ID NO: 58521 - DNA, 542 bp, Homo sapiens
  misc_feature: GYAE6OF02IOT5I.26.78.H01.1.454.CMB.1.raw
  modified_base (297)..(297): a, c, t, g, unknown or other
  misc_feature (297)..(297): n is a, c, g, or t
tcagagactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcatctggattcaccttcagttactatactatgcactgggtccgccaggctccaggcaaggggctggagtgggtggcagttatatcatatgatggaagcagcacatattacacagactccgtgaggccgattcaccatctccaganacaatttagaagaacacgctgtatctgacaaatgaacagcctagagagctagaagacgacggctgttgttttactgtgcgagagagatgacgatagtacgagtaggaactacctgatgtctttcgattagtcgtagggaccgaaggacgaagtcggtactaccgtcttcgttcgacgtccctaccgaaccgtaacgggccctacgttcccggttcccttcccccgtcggtccctacccctacccg

SEQ ID NO: 58522 - DNA, 598 bp, Homo sapiens
  misc_feature: GYAE6OF02HU76U.26.78.H01.1.454.CMB.1.raw
tcagagactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactgggtccgcaggctccaggcaaggggctggagtgggtggcagttatatcatatgatggaagcagcacatattacacagactccgtgaaggccgattcaccatctccagagactaatttagaagaacacgctagtatctgacaaatgaacagcctgagagactagaacgacacggtctgtttagttttactgtgcgtagagagatgacgagtagtacgaggtacgggtaactaccgtagtatgtcctttagtactacgttacggtacggggaccgtaagggacgtaaagtcggtaccgtaccgttccttaccgttccgtacgtccccgtacctaacccggaacgggtacccctaacgttcccggtttcccgttccccccgtaccggtcccctaccccttccccgtaacccgg

SEQ ID NO: 58523 - DNA, 515 bp, Homo sapiens
  misc_feature: GYAE6OF02FHDUF.26.78.H01.1.454.CMB.1.raw
  modified_base (373)..(373): a, c, t, g, unknown or other
  misc_feature (373)..(373): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggcctccaggctcctcatctatgatgcatccaacagggccagtggcactcccagccaggttcagtggcagtgagtcgtgggacaggtacttcacttcncacccatcagcagtctagagcctagaagtatttgactacttttattactgtcagcagtcgtagacaacgtcgacctctctacgttcggcggaggacgagggtgagagtacgagacgaacgtgtggctcgcacgtctcgtgtc

SEQ ID NO: 58524 - DNA, 531 bp, Homo sapiens
  misc_feature: GYAE6OF02HUAFQ.26.78.H01.1.454.CMB.1.raw
  modified_base (414)..(414): a, c, t, g, unknown or other
  misc_feature (414)..(414): n is a, c, g, or t
tcagagactatactcacgaccggtgctcgatttagtgtgagtagtttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacagctgtatctgcaaatgaacagcctagagagctagaagacacggctggttgttttactgtgacgagagagagtgagatgtanagtagggaactaccgtagatgtcttcgatagtcgtggggaccaagggacaaggtggtcgaccgttctcttcgacgtccctaccgaacccgaacgggaccctacgtccggttaccccg

SEQ ID NO: 58525 - DNA, 551 bp, Homo sapiens
  misc_feature: GYAE6OF02F7M1U.26.78.H01.1.454.CMB.1.raw
  modified_base (204)..(204): a, c, t, g, unknown or other
  misc_feature (204)..(204): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagngccaccctctcctgcagggccagtcagagtgttggcagctacttagcctggtaccaacagaaacctggccaggcctccaggctcctcatctatgatgcatccaacgacgggccacgtggccactcccagcctaggttcaggtcgcagtgagtcgtgggacagacttcactctcaccatcagcacgcctagacgccgtagaagtatttcgactactttattactnttcgatcngtcgtagctacgtgaccttctactacgtttccggacggtagggaccgtaggggtcggagtacgtacggacgaacggtacgtcggtggctcggacctaccgacgttcgtcgttacc

SEQ ID NO: 58526 - DNA, 746 bp, Homo sapiens
  misc_feature: GYAE6OF02JVD9F.26.78.H01.1.454.CMB.1.raw
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
tcagagactatactcacgaccggtgctcgatttagtgtgagtagtttgggtttgggggagggaactgctcagttaggacccagagggaaccatggaagccccagctcagcttctcttcctcctgctactctggctcccagattccaccggagacattgttttgacacagtctccagccaccctgtctttgtctccaggggaagagccaccctctcctgcagggccagtcagagtggttnggcagtctaccttaggcctacggtaccaaaccaggaaaccctggccacggcgtcccacggcctcgtctatctatgangccaacgtaccgaacgacgggtaccacgtacggccacgtacccgacggtaccgagggtttacgaacggtaggtacgaaggttcggtaacgggttaccgtaggggtaaccgtacgtaacctttacgaaccgttacctaccgtaaccaacgtaccgaacggacctaacgggtaccgttaacgaaggtacccgtagtttaaacggtactttttaacgtcgttaaacttttacgtttaaccgtacgttaccgaagtaccgaagggtaccgtaaagtccggtaaccgttacggtacccttcccgtttaccggaccggttttacgggggaccggtaagggggtacccgtaggggttacggacggtaacgtacggaaacggtacggtaacggttgttacgggacgttaccggaccttaaccggtattcccgttacgg

SEQ ID NO: 58527 - DNA, 707 bp, Homo sapiens
  misc_feature: GYAE6OF02IA70U.26.78.H01.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaanacgccaccctctcctgcagggccagtcagagtgttggcagctacttagcctggtaccaanagaacctggccaggctcccgaggctcctcatctatcgatgcatcccaacacgggcccacgtggactacgtcccaggccgtaggttcacggtcgacgagttacggacggttcgtaggggactagtaaccgttcaacgtttcaccacccgtaaactcctaacggccaacgtacccgttaagaaccggacccttaaggaacgttaagtttcgtaccttacgttttaactttacgtacgttacgtaacggcttacggaccgttaagtaccgtaaacgtcggtacccttacgtaccgttaaccgtttccggggaccgggtacgggggtaacccgtacgggggtacgggaaccggttacggtaaccggtaaaggtaccgggtaaccggtttacgggtacgggtaaccggttacggaccgttacccggtactttaccgttagggtttaccc

SEQ ID NO: 58528 - DNA, 553 bp, Homo sapiens
  misc_feature: GYAE6OF02IXPPK.26.78.H01.1.454.CMB.1.raw
  modified_base (378)..(378): a, c, t, g, unknown or other
  misc_feature (378)..(378): n is a, c, g, or t
tcagagactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaaggccgattcaccatctccagagactaatttgaagaacacgctgtatctgacaaatgaacacgcctagagacgctagaaagacacggtactgttgttttacgngtgacgagagagtagtgacgatagtacgtaggtaggaacctaccgtgatgtactttgatacgtcgtcgggacgtaagggactaagtcgtaccgtacgttctacttcgacgtccctaccgaaccgacggtcccagttcccgtcccttccccgtcggtaccctaccccgtctacccg

SEQ ID NO: 58529 - DNA, 538 bp, Homo sapiens
  misc_feature: GYAE6OF02IRM6Q.26.78.H01.1.454.CMB.1.raw
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (475)..(475): a, c, t, g, unknown or other
  misc_feature (475)..(475): n is a, c, g, or t
tcagagactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcacatctcagagacaatttgaaagaacacgctgtatctgacaaagtgaacagcctagagagctagaagacacggtntgttgtttactgtgacgagagagatgacgatgtanaggtaggaaccttaccgtagatgtactttcgaattagtcgtagggaccgaagggacaagtggacctacgtcttcttacncgtcctaccgaccgaccggtccacgttccggttccttccccgcgtaccctaccctccctaccg

SEQ ID NO: 58530 - DNA, 611 bp, Homo sapiens
  misc_feature: GYAE6OF02F08TN.26.78.H01.1.454.CMB.1.raw
  modified_base (205)..(205): a, c, t, g, unknown or other
  misc_feature (205)..(205): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaaagngccaccctctcctgcagggccaggtcagagtgttggcagctacttagcctggtaccaacagaaacctggccaggcctcccaggcctcctcatctatgatgcactccaacgacgggcccagtggcactccccgagtcctaggttcagtggcaggtgagtcgtgggacagtacttcactccncaacntcagcacgcctagacgtcctaggaagttatttgacttacttttattacttgttacagcgtacgtcgtaacgcgtaaccgtcggtcccttactccgttaccggtttcgggacgggtaacggggtaaccgaggggttacggaggtacgtacggaacggtaaccgggtaacttcggggttacggaccgttcggaaccttaaccgtacgtttccgtgtttacccg

SEQ ID NO: 58531 - DNA, 664 bp, Homo sapiens
  misc_feature: GYAE6OF02IP8JA.26.78.H01.1.454.CMB.1.raw
tcagagactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactggtccgccaggctccaggcaaggggctggagtgggtggcagttatatcatatgatggaagcagcacatattacacagactcgtgaagggccgaattcaccatctccgagagactaaatttgaacgaacacgcttagtatctagctaaatgaaacacgtcctagtagagctagaacgacacggctgttgtttactgtgcgagagagatgacgtataggtacaggtacgggtaaccgtacccgttacggtattcggtacctttacggtaagttacgttacggtacgggggtaacccgtaaacggggttaaccgtaaacggtttaggtacccgtaaccggttaccgtttaccgtttaaccgtaccggtccccttaccccgaacccggtaaaccgggcccccgttaacgttacccgggtttaccccgtttacccccccgttacggggtaccccctacccccgtttaccccgtaaccccgg

SEQ ID NO: 58532 - DNA, 619 bp, Homo sapiens
  misc_feature: GYAE6OF02I1IZ3.26.78.H01.1.454.CMB.1.raw
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggcctcccgaggctcctcatctatgatgcatccaacgacgggccacgtcggcactccccgagcctaggttcaggtcggcaggtgacggtcgtgggacagtaccttcactcctaccacctactcgaacgcaacgtccgaagacgcctagaagttatttcgacttaacttttattacgttcgtacacgtcgagtacgtaacgactaacgtcggtccttcgttaccgtacggtttaccgggcgggtaacgggaccgtaggggtacggacgtaacgtacgaaggtaaccggtaacgttcgggtacgggtcgtacggtaccgtaacccgtacgttcgttaccgttaccg

SEQ ID NO: 58533 - DNA, 629 bp, Homo sapiens
  misc_feature: GYAE6OF02JFG75.26.78.H01.1.454.CMB.1.raw
  modified_base (203)..(203): a, c, t, g, unknown or other
  misc_feature (203)..(203): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctcccaggctcctcatctatgatgcatccaacgacgggccacgtggccactccccgagccaggttcaggtggcaggtcgagtcgtgggacaggtacttcgacctctacaccagtcacgcacgtcctaaggacgtcctagtaaagtatttacgacttacttttacgttaactgttaccagtcctacggaccgtacgaccgtaaccgttcggacccttccttccgtaaccgttttcggggaccgggtaacgggtacccggtaggggtcggaggtaacgttcggaacggtaaccggtaacggttggtacgggtccgttacggacccgtaacccgtacgttccgttacgttacccg

SEQ ID NO: 58534 - DNA, 586 bp, Homo sapiens
  misc_feature: GYAE6OF02JCRG9.26.78.H01.1.454.CMB.1.raw
tcagagactatactcacgaccggtgctcgatttagtgtgagtagtttgggtttgggctgagctgggttttcctcgttgctcttttaagaggtgtccagtgtcaggtgcagctggtggagtctggggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaacggccgatcaccatctccagacgacaattgaagaacacgctagtatctgacaaatgaacagacctagagagcgtagaacgacacggtctgttgtttacgtgtgacgagagagagtacgagtatagtacgaggtacgggtaacctaccgtagtagtcgttacgtttacgattacgtcggtacggggaccgtaaacgggtactaaggttcggtaccgtacccgttcgttaccgttaccgtacgtacccgtacccaacccgtaccgggacccctacgttacccggttcccccg

SEQ ID NO: 58535 - DNA, 576 bp, Homo sapiens
  misc_feature: GYAE6OF02GR96T.26.78.H01.1.454.CMB.1.raw
  modified_base (205)..(205): a, c, t, g, unknown or other
  misc_feature (205)..(205): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaaggggaaanagccaccctctcctgcagggccagtcagagtgtggcagctacttagcctggtaccaacagaaacctggccaggctccaggctcctcatctatgatgcataccaaacgacgggccaacgtggaccaactccccagcccgtaggttccaaggtggacagtgagtcgtagggaacagtaccttcaactctacaccatcagcacgactagacgcctagtaagtatttagacttactttattactgtacagcagtcgtagactaacgtcggtacctctcgtacgtttcgggacggtaacgggaccgtaggggtaggagtacgtacgaacgacggtaacgtggtaggtcgtacggacctaccgtagttctagttacc

SEQ ID NO: 58536 - DNA, 792 bp, Homo sapiens
  misc_feature: GYAE6OF02F1YAJ.26.78.H01.1.454.CMB.1.raw
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccagcagaacctgccagctccaggctccncatctctggtgcatccaccagggccacgtcggtactccccgggccagtacttcgagtcggcgtacgggggtctggggacaggaaactttcgacgttctacgtaaccattaccgacgaccagccctggccgtaagtccgttaggaaaggttagtttcgggtcgtacgttaaactttttacgtttaaccgtttagtacccgtaaggtacccttaaaagttaaacgtttaaacttaaccccggtttacggggtaccccctttacccgggtacccgttttaaccgttacccggttttttaacccggggggacccggggtaaacgggggtttaaacccccgttaaaggggggttttttaaccggacgggttaaaaccttaacccgggttaaaaacccgggtaaacccgtttttcggggttaaccggggttaacccgtacccggggttaacctaacccccgttaaaggtttccccgtttacgggttttaccccgttttaccgttaacccccgg

SEQ ID NO: 58537 - DNA, 600 bp, Homo sapiens
  misc_feature: GYAE6OF02GY79S.26.78.H01.1.454.CMB.1.raw
  modified_base (204)..(204): a, c, t, g, unknown or other
  misc_feature (204)..(204): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaaanagccaccctctcctgcagggccagtcagagtgttggcagctacttagcctggtaccaacagaaacctggccaggcctcccgaggcctcctcatctatgatgcataccgaacgcgggccacgtggcactcccagccgtaggttcaggtgactagtgagtcgtgggacagtacttcacttctacacatcgacgcacgcctagcacgtagaagttagtttgacttactttattacgtgtacagtcgagtcgtacgctaacgttccggtccttaccgttccgttacggttttccgggacgggtaacggggtacccgtagggggttacgaaggtacgtaaccgaagggtaacgtaacggttgggtacggactacggacctaacgtcgttccgtgttacccg

SEQ ID NO: 58538 - DNA, 525 bp, Homo sapiens
  misc_feature: GYAE6OF02GG8PU.26.78.H01.1.454.CMB.1.raw
tcagagactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctagagagctagaagacacggctgtgttttactgtgcgagagagatgacgatagtacgagtgggaactacccgtagactgtctttcgatattcgtggggacaacgggacaagtcggtacaccgtctctcacgcctccaccgaacggtcccagtccggtccttccccgtggccctacccgtcctacccg

SEQ ID NO: 58539 - DNA, 619 bp, Homo sapiens
  misc_feature: GYAE6OF02HJRV0.26.78.H01.1.454.CMB.1.raw
tcagagactatactcacgaccggtgctcgatttagtgtgagtagtttgggtttgggctgagctgggttttcctcgttgctcttttaagaggtgtccagtgtcaggtgcagctggtggagtctggggggaggcgtggtccagcctggggaggtccctgagactctcctgtgcagcctctggattcaccttcagttactatactatgcactgggtccgccaggctccgaggcgaaggggctgggaggtggggtggcagttatatcatatgatggaagcagcacatattacacagactccgtgaacgggccgagttaccaccatccaccagacgaactaatttagaagtaacacgtctagttatctgactaaatagaaacgacgtcctagagtacgacgtagaacgaccgaacggtcgttagttcgttttactggtgacgaggagagtatgagagttaggtagaggtacggaacctaccgtagtacgtcgtactttacgtagttacgtcggtacgggaccgtaacgggactacggttacggtccgtaccgttcgttccgttaccgaccgtacccgttaccgaaacccggtacccggaccctaccggttcccgttacccccgg

SEQ ID NO: 58540 - DNA, 661 bp, Homo sapiens
  misc_feature: GYAE6OF02IYW5Y.26.78.H01.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
tcagagactatactcacgaccggtgctcgatttagtgtgagtagtttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccnccaggctccaggcaaggggctgggagtgggtgcagttanatcatatgatggaagcagcacatattacacagactccgtaggaaggccgattcacatctaccaagagactaatttagaacgaacacgactagtaatctagacaaagtagaaacacgcctagaagagtcgtagaagaccgaacggtctagttacgttttaactgttacgacggtagaggacgtagtacggaacgtagtagtaacgtagggtacgggtaacctaccggtagacgttacgttctttacggaattacgttacggtacggggtaacccgtaaacggggtacgtaaaggttaccgggtaacccggttaacccgttaccgttaccgttacccgtaacggttcccccgttaacccgtaaaccccggaacgggtaccccccttaacggttccccgggtttacccccg

SEQ ID NO: 58541 - DNA, 671 bp, Homo sapiens
  misc_feature: GYAE6OF02IYV91.26.78.H01.1.454.CMB.1.raw
tcagagactatactcacgaccggtgctcgatttagtgtgagtagtttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcacgtggggtccgccgaggcctccgaggcgaggggctgggaggtgggtggcagttatatcatatgatggaagcagcacatattacacagacgtccgtaggaagggccgagttacaccacttcctccaggaacaactaatttagaaacgaaacacgcttagtattctgacaaatagaacacgcctgaagagactagaacgacgacggctgtttacgttttagtggtgacggaggaacggagtaagtacggtaacgtaagttacggtaacgtacgggttaacgggtaaacccttacccggtacgtagttacgttacgttttacgaactttagtcggttaacgggggaaccgtaaacgggtacgtaacggtttaccgggtaccgttaccccggttctttacccttaccgtaccgtaccccgtacccgaacccggaacccggtaccccgtacggtccccggttttacccccg

SEQ ID NO: 58542 - DNA, 579 bp, Homo sapiens
  misc_feature: GYAE6OF02FYC4D.26.78.H01.1.454.CMB.1.raw
  modified_base (203)..(203): a, c, t, g, unknown or other
  misc_feature (203)..(203): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggccaggcctcccaggcctcctcatctatgatgcataccaacgacgggccacgtggaccactcccagccgtaggttcaggtcggcaggtgagtcgtggggacagtacttcactctcactatcagcagcctagacgtcgtagaagttactttacgacttacttttattacgtgttacagtctagtcgtacgactaacgtcgtaccttctacgtacgttcgggacggtacgggaccgagggtcggagtacgtacggaacggtaacgtaacgtggtacggccgtacggaccctacgtacttccgtgttacccg

SEQ ID NO: 58543 - DNA, 637 bp, Homo sapiens
  misc_feature: GYAE6OF02F2PK0.26.78.H01.1.454.CMB.1.raw
tcagagactatactcacgaccggtgctcgatttagtgtgagtagtttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagactaatttgaagaacacgctagtatctgacaaatgaacagcctgagagcgtagaacgacgacggctgttagttttactggttgacggagaggagtagtagacgtatagtaacgtaggttacgggtaaccttaacccgtagtacgttcgttacgttttacgaatttaacgtaccggttacgggggaacccgtaaaggggtacctaaaggttaccgggttaacccgtaacccggtttccgttacccgtttaccgaccgttaccccgttaccccgtaacccggtaaccgggtacccctacggttcccccggtttaccccccg

SEQ ID NO: 58544 - DNA, 771 bp, Homo sapiens
  misc_feature: GYAE6OF02G0PDF.26.78.H01.1.454.CMB.1.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
tcagagactatactcacgaccggtgctcgatttagtgtgagtagtttggggtttgggggaggaactgctcagttaggacccagagggaaccaatggaagccccagctcagcttctcttcctcctgctactctggctcccagattccaccgggagacattgttttgactacagtctccagccaccctgtctttgtctccgaggggaaanagccctaccctctcctgcgacggccagtcagngtgtgcagctacttagcctggaccaanacgaaacctggccaggctccgaggactcctacattctacgtcgatacgctaactacccgaaccgacgggcccaacgttacggtacctacccgaacgacccgtaagggttacaagggttcggacgtaacggtcggggtacgttaggggaacaggttacgttaccaacgttcctacgtaaccgtaacgtcgaagccgaagtcctacgaccgtaagtcgtaaacggaagttaagtttacgtaagtaccttttaaaagtttacgtttaaccgtgttaacaaacgtaactaaagtttaaacttaaaacgtacccgttacgggtcccctaaccgggttaccttaacggttaacccgttttaccgggggaaccgaaaccgggggttaaccgttaaaggttcggtaaaggaccgttaaaccgaaaaaccggttacggttacgggtaacgttaccggtaacggtaacccggtaaccgttaacggtttccgtttaacggttactttaaccccgg

SEQ ID NO: 58545 - DNA, 804 bp, Homo sapiens
  misc_feature: GYAE6OF02F2OVX.26.78.H01.1.454.CMB.1.raw
tcagagactatactcacgaccggtgctcgatttagtgtgagtagtttgggtttgggctgagctgggttttcctcgttgctcttttaagaggtgtccagtgtcaggtgcagctggtggagtctgggggagcgtggtccagccctgggagtccctgagactctcctgtgtcagtcctcgtggtattccaccttcagtttactatactatcgactacgtgggtcccgcgagggcctccgaggccgaaggggtcctggggacgtggggtcgactagttatagtctaagtatgtacgtaggaacgtcctaggtacctaacttaagtaactttaacgaccgtaacggtaccgttaccggtaggaaccgggaccgtacgttacccgaacctacgtaccgtacccgaaggtaacgtaaaccttaagtttacggaaaacgtaactaccggtgttaacgttaactcgtaacgaactaaaacgtacgtaaacgtacgtaccgtaggaaggtaaccggtacgtaacggaacgtaccgtaccggtacgttacggtttacggttttacgtacggtaacggtacggaacggtaacggtaacgtaacggttaacggtacgtaagttaccggtaacgtaaccggttaccggaaacccttaccgtagttacgtcgttaccgttacgttaacgtacggtaccggtacgggtaacgtaacgtacgtaacggtccggtaaccgtaccgttaccgttacgttaccgtacgtaccccgtaaccggaaccggtaccggttaccctaccggttacccggttaccccccg

SEQ ID NO: 58546 - DNA, 569 bp, Homo sapiens
  misc_feature: GYAE6OF02F4QEF.26.78.H01.1.454.CMB.1.raw
  modified_base (201)..(201): a, c, t, g, unknown or other
  misc_feature (201)..(201): n is a, c, g, or t
tcagagactatactcacgaccggtgctcgatttagtgtgagtagtttgggttgggggaggaactgctcagttaggacccagagggaaccatggaagccccagctcagcttctcttcctcctgctactctggctcccagattccaccggagacattgttttgacacagtctccagccaccctgtctttgctccaggggaaangccaccctctcctgcagggccagtcagagtgttggcagctacgttagcctaggtaccaacagaaacctggaccaggctccgaagctcctcatctatgatgacataccaacgacggccacgtggcactccagccaggtcagtggacagtagagtcgtgggacagtactacactctccacatcagacacgctagacgctagaatacttacgacttactttattacgtgtacacgcacgtcgtagactaacgttcgacccttgtacctacgttccgggacggtaacgggaccgtaggggttcggaacgtaacgtcgaaggtaaccgaacgttggtaaccgcgtacgaccgtaactacgttctacgttaccg

SEQ ID NO: 58547 - DNA, 541 bp, Homo sapiens
  misc_feature: GYAE6OF02HFUD8.26.78.H01.1.454.CMB.1.raw
  modified_base (292)..(292): a, c, t, g, unknown or other
  misc_feature (292)..(292): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggcctcctnatctatgatgcatccaacagggccactggcatcccagccaggttcagtgctagtgagtctagggacagtacttcactctcaccatcgagcagcctagacgctagaagtatttgactactttacttacttagtcagcagtacgtgactaacgtcgcctctcaccgtttcggcggtacggaccgagggtaggagtacgtacgacggaacgaacgtacggtggtcgtacgccgacgtacttacgtgttaccg

SEQ ID NO: 58548 - DNA, 708 bp, Homo sapiens
  misc_feature: GYAE6OF02IV1IB.26.78.H01.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccacctgtctttgctccgaggggaaanagccaccctctcctgcagggccagtcagagtgttggcagcttacttagcctggtaccaanagaacctggccaggctcccgaggctcctnactctatgatgcactccaacgnggcccacgtggcctactcccagccgtaggttcagtcggctaggtcgcgtcgtaggggacacgtacgttccacgtcctaccacctactacgacgtccacgtaccgtaacggaccgtaccgttaaggaacgtttaacgttttcggtaactttaacgttttttaacgttaaccgtttacgtaccgtaaaggtccgtacggtaccgtacgtaccgtaaccgtcggtaccttccgttaccggttaccgttttaccggggaccgggtaaccggggtaaccgggttcggggtaacgggtaaccggtacgttaaccggggaaccgttaaccgggtaaccgtacggggttacggtaccggttacggacccgttaaccgtaccgtttaccggttcgtttaccccg

SEQ ID NO: 58549 - DNA, 750 bp, Homo sapiens
  misc_feature: GYAE6OF02IL66G.26.78.H01.1.454.CMB.1.raw
tcagagactatactcacgaccggtgctcgatttagtgtgagtagtttgggtttggggggaggaactgctcagttaggacccagagggaaccatggaagccccagcgcagcttctcttcctctgctactctggctcccagatattaaccggaaaaataatgatgactcagtctccaggccaccctgtctgtcgtctccgaaggggaagacgtccaccctctcctgcgacggccagtcaaggtagttagttaacgtaacaacttcgccgtaggtaaccagacaacgaaaccgtcggaccacggcctcccgacggtcctcctacacttctcgtggtgcctactccgaccgcggacctacgtcggtaccgtcccggactagtctcgaggtcgggcggtagggggtcgagggactagtacttcgactactccaactacgtaccctaaccgcggtacctgacgtacgttcgtaacggtaacgtttacgttacgaccgttaacgttacttaacgttacgtcgtaactacgtacttaaacgttaacgtttaacgttacggtacgttaccgtttccggttaccgggttttacccggggggaaccggggttaaccgtacgggtaccggttacggacggtaaaccgttaccgtaaaccgtacggttacgggtcggtaaccggtcgtaaccgtaccgtacgtttaccgttacggtttacccttaccgtttacccgttacccttacccgtaccggttaaccgg

SEQ ID NO: 58550 - DNA, 918 bp, Homo sapiens
  misc_feature: GYAE6OF02G7POI.26.78.H01.1.454.CMB.1.raw
tcagagactatactcacgaccggtgctcgatttagtgtgagtagtttgggtttgggtcgtgagctgggtttcctcgttgctctttaagaggtgtccagtgtcaggtgcagctggtgagtcgtggggagcgtggtccagcctgggacgtccctgagactctcctgtgtccagtcctctaggtattccaccttcacgttatactactatgacctacgtcgggtccgccgtagggccttccgagggaccggaacggggtcttggggaccggtggggtacgtactacggttactatccgaattagtgagttacggaactaccgtagtcaactagttaactacgaccgtacggtaccgtaccgtaggaaccggacccttaagtacccgaactacgttaccgtacgaacgtaacgtaacgttaacgttaacgaaacgtaaccgtacgtcggttaacgtaccgtacgtaacgttaaacctaaacgtacgtaaccgtacggtcccgtaagggtaaaccgtcggtaacggtaaccgtaaaacggacccgtaaacccgggttcgttaaccggtttttacggttaaacgttacgggtaccgaaccgggtaaaggtaacggtaaccgttaacggtaacgttaaaccggttaacggtttaaccgaaaaccgggtttaacgggtttaccccgggaaaccctttaacccggtacggttaacggtttccgtttaaaccgtttaaccggaacgggtttcccgttaaccgggtaacccgggggttaaacaaccgggttaaccggttacggtttaccccgggtaaacgtttacccccggttacgttaacccggttacccggttaaacccctcccggttaacccgtaacccgggtaaccggtcccccgttaaacgggtttcccccgttaaccccccgg

SEQ ID NO: 58551 - DNA, 1015 bp, Homo sapiens
  misc_feature: GYAE6OF02HL94J.26.78.H01.1.454.CMB.1.raw
tcagagactatactcacgaccggtgctcgatttagtgtgagtagtttgggtttgggggaggaacgtgctcagttaggaccagagggaaccatggaagcccagctcagcttctcttcctctgctactctcggctcccagtacttccgaccggagacatttgtttagacacgagtctccgacgccacccgttgttctttgtacctaccggaaggggaaacgacgccctacccttctccgtgcgacggacctagtcgaggtacgtggttcgcgagtcctaacgttacgaccgttacggtaaccaagtaaccggaaaccttcgggaccgaacgggtccccttacccggaacgggtcccttaccgtaccttaacttaccgtaacgttagggaaccttacggtaccttaaccggtaccccgaaaaggtaacccggggcccttaaccggtaccggaccctaaccggttaccccacgggtacccggttaacgggtttacacggggttaccggacttacggggttgaaccgggttcggtaacgggaaccaacgtttaccgtaccgtaaccttccgtaacccacccgtacgtttaaccgcggtaacctaccgggacctttaaacgggccgttaacccggtaggtaaacgttaacgttttttaccgaacgttttaaccgttttttaaacgaccgttttacgggaccttaaacgggacgttttaaccgggaccggttttaaacccgtcgttaaaccccgggttccccgtttaacggtttccccttaacccgggggttttacggtttaccccgggggggaaacgggtttaaacccccgggggtaagggtttaacccggggggttaacgggttaaccgggttacccgttaaaaccccgggtaacggtaaacccccggggggtttaaaggtttccggggtaaacccggggttttcccgaacccgggttaaccccggttttaaacccccgggtaatttttccccccggggtagtttttaaacccccccggg

SEQ ID NO: 58552 - DNA, 730 bp, Homo sapiens
  misc_feature: GYAE6OF02JMLS9.26.78.H01.1.454.CMB.1.raw
  modified_base (169)..(169): a, c, t, g, unknown or other
  misc_feature (169)..(169): n is a, c, g, or t
  modified_base (214)..(214): a, c, t, g, unknown or other
  misc_feature (214)..(214): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
  modified_base (646)..(646): a, c, t, g, unknown or other
  misc_feature (646)..(646): n is a, c, g, or t
tcagagactatactcacgaccggtgctcgatttagtgtgagtagtttgggtttggggaggaactgctcagttaggacccagagggaaccatggaagccccagctcagcttctcttacctctgctactctggctcccagacttccaccggagactattgtttgaaccacngtctaccacgtccaccctgttctttgtcctaccgaaggggaaaancgtccctaacccgtctccctggaccgaacgggtcccagtcaacgtcgttcggttacggcacgctacgttacggccttacggtaccaacgaccgaaccgtgaccgacgtctcccgaggccttcctcaacttcgtaagcgtatacgacttaccgaccaacggtcggacctaccgttgaacgtcctacccgcgtccgtacggttaccgacgttagggaactccgggtaagtacgggttccgtaacggggtaaccacggttaaccttcgaacccttcaacccaacgttntaacccganacgtacgtaccggagacgtacgtagtaacttcgtacgtaccttaatttacgttctggtaccagtacgtaatccgtagacccttagtacgtccttagacccgtttcgtaaccgggtaccggtaacgccgggttaagggngtaacgtacggttacgaaccgggtaaacttcggtaccggacgttacgtaccccgagttacccgaagtttaccccttggttaacc

SEQ ID NO: 58553 - DNA, 759 bp, Homo sapiens
  misc_feature: GYAE6OF02F13YT.26.78.H01.1.454.CMB.1.raw
  modified_base (683)..(683): a, c, t, g, unknown or other
  misc_feature (683)..(683): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagcccaccctgtctttgtctccgaggggaaagcgccaccctctcctgcagggccagtcagagtgtggcagctacttagcctaggtaaccaacacgaaacctggacccaggtcctacccgaggtcctcctacattctaatgactggactaacgtaccgaaacgacgggaccctacgtacggaccaaccgttcccgaacggtcccgtaaggggtttaccaagggttcggacgtaaggttacggaacggttcgtacgggggaaacctaacggtaccctttaccgaaccgttaccgtaacctaacccgtaacgtccaacggtaccgtaaacggtacccgtaaagggtaacccgtaccgttaaggtaaacgtttacgttttacggaacccttttaaacttttacttaacgtcgttacacggtacgtaacggtacgtaacgaccgtaacgtccggtacccttacgtaccgttaaccggtttccgggaacgggtaaccggggaaccgtagggggtanaacggtacgtacgaacggtaaccgtaacgttcggtacggtacgtaccggaacctacgtacgttccttacgttaccg

SEQ ID NO: 58554 - DNA, 687 bp, Homo sapiens
  misc_feature: GYAE6OF02GMSZT.26.78.H01.1.454.CMB.1.raw
  modified_base (155)..(155): a, c, t, g, unknown or other
  misc_feature (155)..(155): n is a, c, g, or t
  modified_base (212)..(212): a, c, t, g, unknown or other
  misc_feature (212)..(212): n is a, c, g, or t
tcagagactatactcacgaccggtgctcgatttagtgtgagtagtttgggtttggggggaggaactgcctcagttaggacccagagggaaccattggaagccccagctcagcttctctcctcctgctactctggctcccagtattccaccggganacgtattgttttgacctactaggtctccagccaccctgtctttgctccaggggaaangccaccctgtctgcagggccagtcagtacgtggttggcagccttacttagcctgggtaccaacaggaaacctggccaggcctaccccgaggcctccgtcattcctatgagtcgcaatccctaaacgaggggccctaacgtgggcctatccccggaggccctaggggtttccaggttcggacaggtcgtaagtccgtagggactaggtacttacgaacgttcctcaacctagtccagcagcctagacgccctgaaacgtatttacgacctacgttttaatttactcgttcaggtaccaggtacgttaacgactaaccgtcgggtacccttcgttaccgtaacgttttccgggacggggttaaccgggaacccggtaggggttacgggtaacgacggttaccgaagggtaacccgtaaggttacggtacgggtacgttacggtacccgtaccggtaacgttccggttacggttaccc

SEQ ID NO: 58555 - DNA, 775 bp, Homo sapiens
  misc_feature: GYAE6OF02F79E9.26.78.H01.1.454.CMB.1.raw
  modified_base (229)..(229): a, c, t, g, unknown or other
  misc_feature (229)..(229): n is a, c, g, or t
tcagagactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccacctgtctttgctccgaggggaaagagccacctctctgcgaggccagtcagngtgtgcagctacttacgcctggtaaccaacgagaaaccctggaccaggcctccccgaggcctcctcgaacttctactaggactcgacctactaccaacggtttacgggacccacgtgggactactaccccgacgtcccgtaggttaccgtaacggtcgggtacacgggttagggtacggtttaccggtagggggtaacctaacgggttaaccctttccggtaaccctccgttaaccccgtaaacccttaaccgtttacgaaaccggtacccgaacggtaaccccgtaaaggtaacccggtacccgtttaaggtaaaacggtttacgtttttacggaccgtttaaaccttttaacgtttactaccgggtttacgtaaccgtacgtacggtacgtaaacgtaccgaaacggtttccggacctttaccgtccgttacccgtttacgggacccgggtaggggtacccgttaggggtacgggacgtaacgtacgaacggtacgtaaccgttggtacggtccgtacgtaccgaccggttctacgtgttcccg

SEQ ID NO: 58556 - DNA, 1043 bp, Homo sapiens
  misc_feature: GYAE6OF02JC70X.26.78.H01.1.454.CMB.1.raw
tcagagactatactcacgaccggtgctcgatttagtgtgagtagtttgggtttgggtgcccaagctgctggagggcacggtcaccacgcagctggtggagtcgtgggggaggcgtggtccagcctgggacggtccctgagactctcctgtgcacgtccgtctaggacttcaccttcagttactatactatgctacgtcgggtccgccgaggtcctaccgaggtacgaaacgggggtcgtagggagggttacggggtggaccctaaagggtttttaacgtaaagtttcccgaaaagtttaaacgttacgggtaaaagttttacggggggaaaaacggcccgtaaaacgggtacccgtaaaccgtaaacggtttaaacgttttaaaaccgtaaaacccgtacgggttaaaacccgttaacccccgggtttagggtaaaaacggggggtaccccggtaaaacgtttttacccgtaaaccccgtaaacgttacccgttaaccccgaaacggttaacggaaacccgtaaaacgttttttaggaaaaaccgggtaaaacccgtaaccgggtaacccgttaggttaaacgttaccgttaacggtaacctaaaaacgttacgaaaaccgtaacgaacccgtttacggaaacggtaacgtaccgttaacgggaaaacgtaacccggtaaccgggtaaccgttaggtttacggtttttaaccgtaggttacggaacccggtaaaggtaacggtaaacggtaacgttacggtaaaccgggtaacgttaacgggtaaaccggtaacgggttaaccgggtaacccgttaaacccggttaggtaaacgttaccggtaaccgttttaacggaaacgtttaaccggtaccggtacggggtaaccggtaaacggggtaacgtaaaggttaccggtaaccgtaccggttaccgtaccgttacggtaccgttaacccgtaccggtaacgaaaccgggtaccctaccggtaccggttacccgttaccccgtaccgtaacccgtaccccgttacccgtaaccgg

SEQ ID NO: 58557 - DNA, 690 bp, Homo sapiens
  misc_feature: GYAE6OF02J3BZS.26.78.H01.1.454.CMB.1.raw
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
  modified_base (479)..(479): a, c, t, g, unknown or other
  misc_feature (479)..(479): n is a, c, g, or t
  modified_base (562)..(562): a, c, t, g, unknown or other
  misc_feature (562)..(562): n is a, c, g, or t
  modified_base (618)..(618): a, c, t, g, unknown or other
  misc_feature (618)..(618): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
  modified_base (673)..(673): a, c, t, g, unknown or other
  misc_feature (673)..(673): n is a, c, g, or t
tcagagactatactcacgaccggtgctcgatttagtgtgagtagtttgggtttgggggaggaactgctcagttaggacccagagggaaccatggaagccccagctcagtcttctcttcctcctgctactcgtcggcctcccagtacttccgaaccggagactacgtttgttttacgacacgtagtcctccgacgccctcccttgttctttcgtccgtaccggaaggggtaaactccgccctacccttccgtccgtcggccgacgggaccagtacgagtacggttggttcggctacgtcctacgttacgtctacggacctaacgacgaacctcggcacgccncgcgcctcnctatctagtnctcncactaccgacgcgaccgtcgtcnccaccgtacgtccgtacgtacgggtactcgggtgaccgtggtacggtacgtcggtactacgacgttactcctacgtacaccacgtacggacncggtaacctagtccgtaagacgtacgtagtacgtttacgttctaacgtttctacgttcacgtctacggcctaagtccgtaacncgggtccttacccgtcttacggtaccgttaggggaccgttacggggactcgggtangtacgtaacggtcccgtagcggttacgggtcncggtacncggtaccttccgggtntttacgggccttacccg

SEQ ID NO: 58558 - DNA, 746 bp, Homo sapiens
  misc_feature: GYAE6OF02FTXTL.26.78.H01.1.454.CMB.1.raw
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (399)..(399): a, c, t, g, unknown or other
  misc_feature (399)..(399): n is a, c, g, or t
  modified_base (532)..(532): a, c, t, g, unknown or other
  misc_feature (532)..(532): n is a, c, g, or t
tcagagactatactcacgaccggtgctcgatttagtgtgagtagtttgggtttggggggtagggaactgctcagttaggacccagagggaaccatggaagccccagctcagcttctcttcctcctgctactctggctcccagacttccaaccggagactagttgttttcgacacgatctccagcccaccctgtctttgtctcgagggaagcgccacctctccgnccgagggccagtcagtagtgttgcanctattcgctagtaccanacaacgnggacagcctccgagacctcctcattctatacgatgactactaccgtaacggacggacccaggttaccgaacctacgtaccccaacgggtcctacgggggttacacgggttcggactacggggtanaccgggtttcggaacgggtaaccgtacgttaccgttacctacccgttaccgtaaccctaaccgtcttaaccgaacggtcctaaccgggtacgtacgaacgtacccggttaggttaaaccgtttcggtttaacnccgttttaaaggtttacgtttaaccggtcgtaaacgacgttaaaccgaaacttttaaaagtaccgttaccggtaccggttacggtacggggttaccgtaccggaaccgttaaacgggacttaacgggactaacggtacgaaacgtacgtacgggtacgtacggccgaactaccgcgttacggttaccagtttacccgaccgttaccctacccgg

SEQ ID NO: 58559 - DNA, 727 bp, Homo sapiens
  misc_feature: GYAE6OF02HD4XC.26.78.H01.1.454.CMB.1.raw
  modified_base (88)..(88): a, c, t, g, unknown or other
  misc_feature (88)..(88): n is a, c, g, or t
  modified_base (116)..(116): a, c, t, g, unknown or other
  misc_feature (116)..(116): n is a, c, g, or t
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
tcagagactatactcacgaccggtgctcgatttagtgtgagtagtttgggtttgggctgagctgggttttcctcgttgctctttaagnggtgtccagtgtcaggtgcagctggtgngtcgtgggggagcgtgtccagcctgggacgtcctgagctctcgtgtcgcagcctgtggtacttccaccttcagtttacctagtactactcgactacgtgggtaccnccgaggcctccgaggacggagggtctggaggtgggngactagttacntacatagtgagtagagcacgcagtatatacanacgtactcggagacggtctacgtccactatcctanacgtagtaactagttacgaaacgcgtactacgtagttaactcaacgttaacaaagtaccgaacgtacgtaccgaaggctacggtacaacggaacgtaccggtacgttcgtttaaggtttacgtttacggcggtacgggcgtaaacggtacggaagtcggtaacgtacggttataccggggttattaccggggaaaccgtaccttaccgggtacttacggttccgttagtaacggttattaccgggtacggtaacgggaaccgtaacggttacctacggttcccggttacccgtaacggtttccgttaacccggtaaccgttacccgtaaacccggttccccgaaaaccgggtcccgtacccggttttaccccgggtacccttccccccggg

SEQ ID NO: 58560 - DNA, 859 bp, Homo sapiens
  misc_feature: GYAE6OF02G3BL5.26.78.H01.1.454.CMB.1.raw
  modified_base (158)..(158): a, c, t, g, unknown or other
  misc_feature (158)..(158): n is a, c, g, or t
  modified_base (255)..(255): a, c, t, g, unknown or other
  misc_feature (255)..(255): n is a, c, g, or t
tcagagactatactcacgaccggtgctcgatttagtgtgagtagttttgggtttgggtgcccaagctgctggagggcacggtcaccacgcagctggtggagtcgtgggggaggcgtggtccagcctgggaggtccctgagactctcctgtgcagcctntggattcacctttcagttactatactatgcacgtgggtccgccaggcctaccgaggacgaagggggctagggtaggtggggtggactaaggtttaanatcgaattattaggaatgggaagacctaaggacctaacaattaacttaaccgaaacgtaacggtaaccttacccgggttaagggaaaacggggtacccgtaaacgttttacccaaacccgtaacttaccgttacccgaaaggaacgtaaacctaaaagtttttacggaaaacgtaaaccgaccggtaccttagttaacgttaccgttagaactaaaaacgttacgaaaaccgtacgtaccgtagggaaggaacgtacgtaacggaaaacggaaccgtaacgggtacgtttagggttttacgtttttaccgtaggttacgggacgtaaagggaagtaacggagttacgacgtaagttacggtaacgtaagggtacggtaaacccttacgtaagtacgttacgttacgtttacgaacgttacgttccgggtaacgggggaaccgtaaaggtaacccgtaaagggttaccggtacccgttaacccgttcgttaacccgtttaccgtaaccggaccccttaccccggaaacccggttaaaccgggcccttaacgttccccggttacccgtttaccccgacggtaacccctacccgtcccgtaaaccgg

SEQ ID NO: 58561 - DNA, 926 bp, Homo sapiens
  misc_feature: GYAE6OF02HTP9C.26.78.H01.1.454.CMB.1.raw
tcagagactatactcacgaccggtgctcgatttagtgtgagtagtttgggtttgggggaggaactgctcagttaggacccagagggaaccatggaacgccccagctcagcttctcttcctcctgctactctggctcccagtattccaccggagactattttcggttttagactacgtagtcctaccacgcctacccttgtttctttagtccgtaccgaaggggtaaacacgccctacccgttcctaccgtaggaccgacgggtacctagtaccgaggtaaggttcggttggacctagtaccgttaacgttacgtacccgtaacggttaaacccaaacgtaaacggtaaacccggttacggacccggtaaacgggtcccctacccgggtaacggtccccttaccgtttaacgtaaccgttacctttaaacgtacggtaacttaccggtaaaccttaaaccgtaacccggaaaccgggttaaaccggggccctacggtaaccgggtactacccgttaacccgagggttacccgtagggttaccggtaagggttaccgacgtacgggttacggtacgtttaggggaccgggtaaaacttaacttaccccgtttacaacgtttaccgaccctaaaggtacctaccgtaacgacccgtaaggtaccgtttaaaggaccgtacggttaacttaacggttttactttaaccggtaaccttttaacgttttaacttaacggtttaccgtacgtaacgttaacgtacgggtttaaccgtacgtaaacccgttaggaccttacccgttacgttaccgttaaccgggttcggggaacggtaaccggttagtcgggttacgacgtaacgacggtaaacggttaactacgggttacgacgtacggtaccaaccggttacctttagtacgttcgttaacc

SEQ ID NO: 58562 - DNA, 831 bp, Homo sapiens
  misc_feature: GYAE6OF02GJ057.26.78.H01.1.454.CMB.1.raw
  modified_base (196)..(196): a, c, t, g, unknown or other
  misc_feature (196)..(196): n is a, c, g, or t
tcagagactatactcacgaccggtgctcgatttagtgtgagtagtttgggtttgggtgcccaagctgctggagggcacggtcaccacgcagctggtggagtctgggggaggcgtggtccagcctgggagtccctgagactctcctgtgcagcctctggattccaccttcagttactatactatgcagtcgggtccnccaggtcctccgaggcaagggggctagggagttgggtgactagtttacatcaattatggattaggaacgccgtaaggccaacgattaacttacaacaaggtaccttaccggttggaacggggtccctatttccgaacctacgttccgtacccgaaggacgtaacctaagttttacggaaacgaaccgacgtacgttaggtaacttcgttagaaccttaaacgtcgaaaccgagtccctaaggtaccgagtaccgttaagggaaaccgtaaccggaaccgggttctttacggtttttacggtttttaaccgcggttacggtaccggtaaaggtaaggtaaacggttagtaacgggtaacggttacgtacgggttaacgtaacggggtttaccgggaaacccctttaccgggtaactacggttacggtttaaccggtttacgaacggttttaaccggttcggggttaaacccggggtacgaaaacggggttacttaaaccggtcgggtaacccttaccggttctttaccgttccgtaaccgtcccgttaaccccgtaaccggaacccgggttaccctaaccggttcccgttaccccgttacccccgtacggtacccctaccccgttccgtaacccgg

SEQ ID NO: 58563 - DNA, 719 bp, Homo sapiens
  misc_feature: GYAE6OF02FU0XV.26.78.H01.1.454.CMB.1.raw
  modified_base (157)..(157): a, c, t, g, unknown or other
  misc_feature (157)..(157): n is a, c, g, or t
  modified_base (324)..(324): a, c, t, g, unknown or other
  misc_feature (324)..(324): n is a, c, g, or t
  modified_base (435)..(435): a, c, t, g, unknown or other
  misc_feature (435)..(435): n is a, c, g, or t
  modified_base (450)..(450): a, c, t, g, unknown or other
  misc_feature (450)..(450): n is a, c, g, or t
tcagagactatactcacgaccggtgctcgatttagtgtgagtagtttgggtttgggggaggaacctagctccagtttaggacccagtacgggaaccatggaagccccagctcagcttctcttcctcctgctactctggctcccagattccaccgganacattgttttgacacagtctccagcctacctgtctttgtctccgaggggaaagtgccaccctctccgtgcgtagggcctagtcagagtgttcgctagtcttacgttacgccttaggtaaccaacgtacgtaaaccgtggacccagggtccctacccgcggtctcctnacttctagtgatcggactacgtccgaacgtcgggcccaacggtggacctaacgtcccgaaggccgttaggtccaggtcgacgagtcgagtccgtagggactacgtcttacnctccgtacaaccgtntaccgagtacacgtaccgtaaggaccgtaccgtaaggtaacgtttacgtttacggacctttaacgttttaacgttaaccgtacgtttacgacgtaaccgtacggttacggtaccgtaaccgtacggttccggtacccgtttaccttaccgtttacgggttaccggaccgggtaacgtaacccgggttagggtacgtacgtaacgttaccgggtacggaacggttagacgggtcggtacgtcgaaccctccgtactccgttacttacccg

SEQ ID NO: 58564 - DNA, 181 bp, Homo sapiens
  misc_feature: GYAE6OF01BTV2Z.13.54.E10.1.454.CMB.1.raw
  modified_base (179)..(181): a, c, t, g, unknown or other
  misc_feature (179)..(181): n is a, c, g, or t
tcagtcacgtactacacgaccggtgctcgatttagatcgtagcagaacacacaaagggcccatcggtcttcccctggcaccctcctccaagagcacctctgggggcacagcggccctgggctgcctggtcaaggactacttcctagtacgtgactgagcgggctggcaaggcgcatagnnn

SEQ ID NO: 58565 - DNA, 178 bp, Homo sapiens
  misc_feature: GYAE6OF02G3KNJ.13.54.E10.1.454.CMB.1.raw
  modified_base (178)..(178): a, c, t, g, unknown or other
  misc_feature (178)..(178): n is a, c, g, or t
tcagtcacgtactacacgaccggtgctcgatttagatcgtagcagaacacacaaagggcccatcggtcttcccctggcaccctcctccaagagcacctctggggcacagcggccctgggctgcctggtcaaggactacttcctagtacgtgactgagcgggctggcaaggcgcatagn

SEQ ID NO: 58566 - DNA, 421 bp, Homo sapiens
  misc_feature: GYAE6OF01A3ZPQ.1.6.A06.1.454.CMB.1.raw
  modified_base (412)..(421): a, c, t, g, unknown or other
  misc_feature (412)..(421): n is a, c, g, or t
tcagacgagtgcgtcacgaccggtgctcgatttagatctactgactcgcggggatagagtaaccctctcctgcggggccagtcagactctttccggtaacctcttggcctggtatcaacataagcctggcctggcgcccaggctcctcatttttgatgcatccatgagggcctctggcgtcccagacagattcagtggcagtgggtctgggacacacttcgtcctcaccatcaacagtctggagcctgaggattctgcggtgtattactgtacaacaatatgctgcatcacctcgaatctctttcggcggagggaccaaagttgaaagtaaagcgaactgtgctgcacatctgtcttcattcctcccgcatctgaacgcactcgtctgacgcggctgggcaaggcgcatagnnnnnnnnnn

SEQ ID NO: 58567 - DNA, 645 bp, Homo sapiens
  misc_feature: GYAE6OF01AX71I.1.6.A06.1.454.CMB.1.raw
  modified_base (426)..(426): a, c, t, g, unknown or other
  misc_feature (426)..(426): n is a, c, g, or t
  modified_base (493)..(493): a, c, t, g, unknown or other
  misc_feature (493)..(493): n is a, c, g, or t
tcagacgagtgcgtcacgaccggtgctcgatttagatctactgacagggggtgggtccaggaggcagaactctgggtgtctcaccatggcctggatccctctacttctccccctcctcactctctgcacaggctctgacggtcctcctagtgtgctgacacacgccctaccctcggtgtccgtgtcccccgaggacaggacggccaggactccgacctcgctcgtagggagatgacattcgacccaacctactatttcttagtggtaccagcgagaacgccgaggccgacggcccttggtgttgttgaatataagtaaactcacgtggaacgtcggtccttacggacgggtctcccgtgacgtcgtcttaccgtcgtcgtcctaccaccgtacgaacgggaactagtcgtacactagttccgaacngtactacgggcgaacgtccgaagtacgaacgaacggcggacgtacgtacgacgtttattcgtactanacttctacgacgtactagtactacgtaggtttacttacgttcgtaccggtacggtacgtcgggtaacctacggtaccgtacccgtcgtacgacctaccggacccgtacccgacccctaccctaccgtacctaccctcgtcccgtttccccgg

SEQ ID NO: 58568 - DNA, 677 bp, Homo sapiens
  misc_feature: GYAE6OF01C2DUA.45.83.H06.1.454.CMB.1.raw
  modified_base (392)..(392): a, c, t, g, unknown or other
  misc_feature (392)..(392): n is a, c, g, or t
tcagacgcgatcgacacgaccggtgctcgatttagatcacgtgcgtcgcggggagagctctggagaagagctgctcagttaggacccagagggaaccatcggaaacccagcgcagcttctcttcctcctgctactctggcctccagactaccaaccggaaaaattgtgttgacacagtctccaggccaccctgtctctcgtcctccgaggggacacacgcccaccctctcctgcgacgggccagtaggagtgtacaagtaacgtacgttaggctacggtaaccaacgaacgaaaccgtggaccacggcctacccgaggcctccctacactccatcgatcgaccactaccaaacgtcgggtccctggccgtcccgagtaccgtacggttccgnggacgaggtgggtacgtagggacaggtacgttcaccgtctaccgacgtcgacgcctacggtaccgtaggtacgtcccgttagtacgttaggtttacgttttcgacgtttaacgttttccgttacgtttcgtaccgagtcccgtacggttcccggttacccgaccgtacccggtcccgtaccctcggttacccgggtttcgggggaccggggtacggtacgggtaggacgtagtacggacggacggtcgtaggtcggacctcggacctacgacgttcgtgttaccg

SEQ ID NO: 58569 - DNA, 610 bp, Homo sapiens
  misc_feature: GYAE6OF01EKJDQ.45.83.H06.1.454.CMB.1.raw
  modified_base (190)..(190): a, c, t, g, unknown or other
  misc_feature (190)..(190): n is a, c, g, or t
  modified_base (207)..(207): a, c, t, g, unknown or other
  misc_feature (207)..(207): n is a, c, g, or t
  modified_base (323)..(323): a, c, t, g, unknown or other
  misc_feature (323)..(323): n is a, c, g, or t
  modified_base (603)..(603): a, c, t, g, unknown or other
  misc_feature (603)..(603): n is a, c, g, or t
tcagacgcgatcgacacgaccggtgctcgatttagatcacgtgcgtcgcggggagagctctggagaagagctgctcagttaggacccagagggaaccatggaaaccccagcgcagcttctcttcctcctgctactctggctcccagaaagtactggagagagtgtgttgacgcagtctccaggcaccctntcttgctccaggggaangcaacctctcctgcaggaccaccagagtgtagagcaatcacttagcctggtaccagcagaaacctggccaggcctaccaaagtctcctcatctacggtgacatccaggtacggccnctggcactacccgagtacaggttcaggtcggctaggtggtcgtagggactagtacttcacttcctacgaccatccaacgtaacggttggacgtccgtagtaacgttagttttcgacgttaggttacttaagtttagttcgtacctaactttacctagtttccgggtttactttacctttccgtttcgttccgttccgtttccgggtcccgttacgggaccctacgtacggttacggaaacttccgaaaacgtcgttaggtacgtacgtagacctaccgtnttaccgg

SEQ ID NO: 58570 - DNA, 756 bp, Homo sapiens
  misc_feature: GYAE6OF01EWPUL.45.83.H06.1.454.CMB.1.raw
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
tcagacgcgatcgacacgaccggtgctcgatttagatcacgtgcgtcgcggggagagctctggagaagagctgctcagttaggacccagagggaaccatggaaaccccagcgcagcttctcttcctcctgctactctggctcccagaaagtactggagagagtgtgttgacgcagtctccaggtaccctctctttgtctccgaggggaaagagcaacccctctcctgcacggaccacccagagtggttacggagcaatcacttagccgtggtaccagcaagaaacctggccaggctaccaagtcctcctacatccgtacggtnacactccaggtacgggccncgtggcctactcccgaagacgtaagggttcaggtggaccgtagggtcgggtcgtacggggactaggtaccttccacgttctaccacctactaccaaccgtaaggttacgggacgtccgtaggtaacgttacgttttggactttcggttacctttaattttacgttttacggttaccttaaacctttcgtttaaggtttccggttttcccgttttccgtttttcccgttttttacggttttccccggtttcccggtttttcccgggtacccccggtttaccggggtaaaccccttaaccggttaaacgggttaaacgggttaaaaccgttaacccggttaaaaaccgtaaccgggtttacgggtaccgggttacccgttacggtaccctaacccgtttcttcccggttttacccg

SEQ ID NO: 58571 - DNA, 734 bp, Homo sapiens
  misc_feature: GYAE6OF01B4H2F.45.83.H06.1.454.CMB.1.raw
tcagacgcgatcgacacgaccggtgctcgatttagatcacgtgcgtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccggagactcgatggagggtgccgtttggtcccggacccgggggggtctcgtggacgacttctccgtgtcgctaagttcgtaggactttccaccctccaccctacctactaccccagtcgacgtcgtcggtcccgccgacgcccgggaccgggggaacggggaccggaacgttcggggtccacgacgtactaaacgtacgtggagtagtggggtacggtaactttccgttacgtacggtcgacggtacctccggtaggacggggtcttcgggttaccaccgtactccgtacgacgaacgtactaacgttacggaagtaaggttacttggtttatacttaccgtaaataacgtacgtaaacgtacgtaacgggaaacgttcgggaaacggaccgtccgggttccgttacgttactttcggtaacgtcggtaaaccgttaacccgggttcccctaacgtacgtttacgggcggttacccttcgttaacgttaccgtaccgttttacgtttcccttttttaggtttaacgg

SEQ ID NO: 58572 - DNA, 839 bp, Homo sapiens
  misc_feature: GYAE6OF01CCOA8.45.83.H06.1.454.CMB.1.raw
  modified_base (830)..(830): a, c, t, g, unknown or other
  misc_feature (830)..(830): n is a, c, g, or t
tcagacgcgatcgacacgaccggtgctcgatttagatcacgtgcgtcgcgggggagagctctggagaagagctgctcagttaggacccagagggaaccatggaaaccccagcgcagcttctcttcctcctgctactctggctcccagaaagtactggagagagtgtgttgacgcagtctcaggccacctctcttgtcctaccgaggggaaatcgaccaaccgtctcctgcacggacccaccgaggtagttgtaaggcgacaatctacgttacgccgtacggtaaccagacaacgaacctcggaccgaacggtcctaaccaaaagtcctacctacactacctaacgggtcacaaccgtaccgaagggttaacgggcccgacgtaggtaccgtaacctacccgaagtaaccgtaaggttaccgtaaagggtcggtaaccggtacgggtacggggttacgtaacggggtaacctaaaccgggttaacctttacccgtaacccttaccggttaaccccaacccgtaaccgttaaccgaacgggttaaaacggtttccgggtaaaccgtaaccgttacggttaaaaccgtttgtttttaaccttacggtttacgtttaacctttaagttttaacgtttactaacctttaaaccgttagttttaacggtccgggttttaccgttttaccttttccgggttttaggtttaccccgttcgttttaccccggggaccccgtttacggggaacccgaaccggttaaggttaaacgggaaaccttaaacggtaaaacccgaacggtttcggtacggtacttaccggaacctaacccggttntttacccgg

SEQ ID NO: 58573 - DNA, 849 bp, Homo sapiens
  misc_feature: GYAE6OF01ACI0J.45.83.H06.1.454.CMB.1.raw
  modified_base (149)..(149): a, c, t, g, unknown or other
  misc_feature (149)..(149): n is a, c, g, or t
  modified_base (198)..(198): a, c, t, g, unknown or other
  misc_feature (198)..(198): n is a, c, g, or t
  modified_base (583)..(583): a, c, t, g, unknown or other
  misc_feature (583)..(583): n is a, c, g, or t
tcagacgcgatcgacacgaccggtgctcgatttagatcacgtgcgtcgcggtgaggacgctgaccacacggtacgtgctgttgtactgctcctcccgcggtctttgtcttggcattatcgcacctcccacgccgtccacgtaccagttnaacttcgacctcgagggttcttcgtcggctcaccgtcccaaccaccacnctatgtcgacccgtcggacgggggtaccgggagtactcacgtgggaggggttccgttccggttcggggtacccggggtaccccgggggggttctcgtaggacgtaccttccttccgtgttacgacttaacgttttcgtacggtacttccgaccccttaccctaaccctaccctacttcccgagtcggacggtccggttccgggtcccgccgaccggggccggggaccgggggaacggggtccgggaggtcggggacgcgaagtacaacgttaggtggtcggtaggttacggggtacggttaccgtttaccgttacgtaccggacgtacgtaccggttcgggtacgggtcgggtacgttcccggtacctacttacgttccgtaacncggtaaacgtaaacgtaacgtttaaggaacgttagttagtttacggtaacgttacttaacttaaacggtaacgtaaccggttaacgtaaccggtaagggtaaaccggaaccggggtaacgtaacccgggtacggtccggttttactttacgtttacggttcggtacgttaacccgttaacccggtcccgttaacggtaggttccggtacgttcttacgttacccgttacggttacgttttccctttttaagttttcgtttaacggg

SEQ ID NO: 58574 - DNA, 774 bp, Homo sapiens
  misc_feature: GYAE6OF01BE9PN.45.83.H06.1.454.CMB.1.raw
  modified_base (192)..(192): a, c, t, g, unknown or other
  misc_feature (192)..(192): n is a, c, g, or t
tcagacgcgatcgacacgaccggtgctcgatttagatcacgtgcgtcgcggtgaggacgctgaccacacggtacgtgctgttgtactgctcctcccgcggctttgtcttggcattatgcacctccacgccgtccacgtaccagttgaacttgacctcaggtcttcgtggctcacgtccaccaccacgcatgngacctcgacggggtccgggagatcgagtggagggtcgccgttgggtcccggacccgggggggttctacgtggacgtcctccttcctgtcgactaacgtttcgtcggtacttccaccctccgacccacctactcctaagtgacgtcgtccgggtcccgaccgacggcccgggaccgggggaacggggaccggtaaggtcggggtaccgcgaacgtacaaacgttagtggtagtaggtggtacggttacgtttcccgtacgtacgacgtacgtaccgtcggtaggtacgggtccgttacgggttaccgaacctacgttccgtaccgaaggaacgtaaccgtaaacggttacggaaacgttagttaacgttggtttacgttaattacccgtaaacgtaacgtaacgtaacccgtaacgggtaacggtaaacggtccggtaacgggaccgtacgggttcccttacgtttacgttcgttacgggtacggtaaacccggttaaccccggttaccgtaccgttacggttacggttcggtacctttacttacgtacccgttacgtttcgtttacgtttttacgtttacgg

SEQ ID NO: 58575 - DNA, 680 bp, Homo sapiens
  misc_feature: GYAE6OF02F0L3L.45.83.H06.1.454.CMB.1.raw
  modified_base (111)..(111): a, c, t, g, unknown or other
  misc_feature (111)..(111): n is a, c, g, or t
  modified_base (298)..(298): a, c, t, g, unknown or other
  misc_feature (298)..(298): n is a, c, g, or t
tcagacgcgatcgacacgaccggtgctcgatttagatcacgtgcgtcgcgggggagagctctggagaagagctgctcagttaggacccagagggaaccatcggaaaccccngcgcagcttctcttcctcctgtctactcgtcggcctaccgaagtaacgtcgtaggagtagtagtgtgtcgacgctacgtcctacgacgcctaccttcgttcgttcgtaccgtacgggaagggaacgacctaccctacccgttcgtccgtacgaccgtaccgaacccacgtaggtacgtaggtacganactactcgtactcgtcgtacgacgacgtaaccacgaccgtcgacgacgtacaccgacgtcctacgacgtacgtcgtacgactacgcgtacggtcgtcggcgtacgacctacgtaccgacgtaggtacgtagacggtagcgtggtcggtacgtcggaactcgtacgttccactacctactacgactacgtaacgtagtacgacgtacgtactagttcttacgttctacgtttacgttacttacgttacgtacctacttcgttacgttcgttccgtttccgttcgttcgttccgtacgttcgccgttacgtagacggtaacgttacggaacgttacgtaaccgtaggtacgtacggtacgtacgtacgtcgttactcgttaccg

SEQ ID NO: 58576 - DNA, 747 bp, Homo sapiens
  misc_feature: GYAE6OF02GSFLN.45.83.H06.1.454.CMB.1.raw
  modified_base (334)..(334): a, c, t, g, unknown or other
  misc_feature (334)..(334): n is a, c, g, or t
tcagacgcgatcgacacgaccggtgctcgatttagatcacgtgcgtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccgggagatcatggagggtgccgttggtcccggacccgggggggtctcgtggacgacgttctccgtgtgactaatttcgtggtattccaccctcccaccacctactcccatgacgtccgtcgggcccnccgacggccgggtaccgggggaacgggaccggaagtcggggtcgcgacgacaagtaacgtggtagaggtggtaggtaacgtttccgttacgtaacgtcgtaacgtacgttccgtaggggacggggtcgttcgggttaccaccgtcgttaccgtaccgaggtaaccgtaactaacgttaccggaagttacgttacgttagtttacgttacttaacctaacgtaaattaaccgggaaaccttaccgggtaaacggtaaacggtacgggaacgggtaacccgacggggtttacccgttagttaaccgttttcgtacgggtacgtaaccggttaaccgtttacccgggtaaccttaaggttacggttacggtcttacgtttacgtcgtaacggtttcgttttaccttttagttacgg

SEQ ID NO: 58577 - DNA, 552 bp, Homo sapiens
  misc_feature: GYAE6OF02HHKKU.45.83.H06.1.454.CMB.1.raw
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
  modified_base (321)..(321): a, c, t, g, unknown or other
  misc_feature (321)..(321): n is a, c, g, or t
  modified_base (367)..(367): a, c, t, g, unknown or other
  misc_feature (367)..(367): n is a, c, g, or t
  modified_base (453)..(453): a, c, t, g, unknown or other
  misc_feature (453)..(453): n is a, c, g, or t
  modified_base (539)..(539): a, c, t, g, unknown or other
  misc_feature (539)..(539): n is a, c, g, or t
tcagacgcgatcgacacgaccggtgctcgatttagatcacgtgcgtcgcggggagagctctggagaagagctgctcagttaggacccagagggaaccatggaaaccccagcgcagcttctcttcctcctgctactctggcctcccagataccaccggagaaaattgtgttgacacagtctccagcccaccctgtctttgtttccaggggaaangcccaccctctcctgcagggccagtcgagggtnttaacagctactagcctggtaaccaaacaaaaacctggccaggctccaggctcatcatctatgacgcatcgaacngggccacgtggcactcccagccgaggtcagtcggtcaggtgggtcngggacagtacgttcactccacactatcagcagcctcgacctgagtatttcgaccttattactctgtcagctaggcgtggccgacgngccgtctcgtaacgttcggagggtacggaaccgagggtacgagtaactaccgaaacggtacgtggtacggtctacggacctacgtnttcgtagttaccc

SEQ ID NO: 58578 - DNA, 575 bp, Homo sapiens
  misc_feature: GYAE6OF02IVO0E.45.83.H06.1.454.CMB.1.raw
  modified_base (557)..(557): a, c, t, g, unknown or other
  misc_feature (557)..(557): n is a, c, g, or t
tcagacgcgatcgacacgaccggtgctcgatttagatcacgtgcgtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgccttggtccacccgggggggtctcgtgagactctcctgtgcaatttctggattcacctccaccacctatcccatgagctgggtccgccagccggccgggggaaggggccggaagtggggtcgcgagacaataacgtggtgagtgggtaggaagtttccttctacgcagacctcggtggaggggtctgggttcaccatctcagagacaagttcgaagagtagtgttgtatactaacaatgaacaccgtagaaagtcggagacgacggccgtactagtttctgtcgacgtaacggttcccacccgttatacggtcggcttctactcgtacggttnttacctttttagtttacg

SEQ ID NO: 58579 - DNA, 698 bp, Homo sapiens
  misc_feature: GYAE6OF02FYNND.45.83.H06.1.454.CMB.1.raw
  modified_base (247)..(247): a, c, t, g, unknown or other
  misc_feature (247)..(247): n is a, c, g, or t
tcagacgcgatcgacacgaccggtgctcgatttagatcacgtgcgtcgcggtgaggacgctgaccacacggtacgtgctgttgtactgctcctcccgcggctttgtcttggcattatgcacctccacgccgtccacgtaccagttgaacttgacctcagggtcttcgtgctcacgtccaccaccacgcatgtgacctcaggggtccgggagatcatgagggtgccttggtcccgacccgggggggtntccgtgacgactctcctgtgctaatttctggattcacctccacctactactcccatgagcgtgggtccgccgacgtcccggccgggggaagggggccggaagtcggggtcgacctaggacaagtaacgtggtagagtgggtaggtaacgtttccgttacgtacgcgtaacgaccgtccggttaggggacggggttcctgggtttaccgaacctatacccgttcccaaggacgaacctaagtttccggaaaggtaacgttaagttcgttagtacgttactaaactaaagtacgtaacgtaacccggtaggtaaacgttcggaacgggaaccgtacggtaccgttattacgtttactggttacggacgtaaacggttccccgaaccgttacgtacggttcgggtactttcgttaacgttcccgtacttcggtttaccctttttattttaccgg

SEQ ID NO: 58580 - DNA, 728 bp, Homo sapiens
  misc_feature: GYAE6OF02F3WW6.45.83.H06.1.454.CMB.1.raw
tcagacgcgatcgacacgaccggtgctcgatttagatcacgtgcgtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatggaggtgccttggtccgacccggggggtctctgagactctcctgtgcaatttctggattcacctcccaccctacctactccccatcgagcgtagggtcccgccgacggcccgggaccggggggtaacgggggcccgggaaaggttcgggggttccgacgaacggactaaacgtaaccgttgggtaggagttgggttagggtaaacgttttcccgtttaccgtaaccggtacgaacggtacccgttacccggtagggacgggggtccttcggggtttaccaaccgtacgttccctaccgaggtaacgaacgtaacgttacggaaacggtagttagttcgtttaggttactaccgttaaacgaaattacggaaacccttaaccggtaggaaacggtcggtaacggaccgtacgggaccttacttagtttcgtaggtacgacgtaaccgttcccgaaccttagtacggtcggtcttacttacgtactacggtttctttactttttagtttacgg

SEQ ID NO: 58581 - DNA, 935 bp, Homo sapiens
  misc_feature: GYAE6OF02JWBO3.45.83.H06.1.454.CMB.1.raw
tcagacgcgatcgacacgaccggtgctcgatttagatcacgtgcgtcgcggtgaggacgctgaccacacggtacgtgctgttgtactgctcctcccgcggctttgtcttggcattatgcacctccacgccgtccacgtaccagttgaacttcgacctcagggtcttcgtggctcaccgtccaccaccacgcatggtcgacctcgacgggggtccgggagatcgagtggacgggtcgccgtttcgggtacccggtacccggggggggtcttcgtacggacgtaccgttccgttccttgtcggtactaacgttttccggtacgggtactttaccgtaccccgttacccctaacccgtacccttaaccgttccccgtaagtacggaccggtacggttcccgggtacccgacccgaccgggccccggggtaccgggggaacgggggtacccggaacggtccggggtccggaccgtacggacctaaagttaaccgtcggttacgtacggttcgggtaacggttaccgttttaccgttcggtaaccgtacgtacgttaccgtcgggtacgggtacggggtccgttaccggtttaccgaacccgttacttacccggtacgaacgggttaaactaacggtttaacggttaacgggtaaacggttacggtttaacgttacggttttaacggtaacctttacggaaaacgtttaaggtaacccggtaaaaccgttaaccggttacggtaaacgggttccggggtaaacggttccggtaaacccggggtttcttaaccgtttaacgttacggttaccgggttaccggttaaaccggttaccccggttacccggttacctttaaagggtcggggttaccgtttacctttacggttaacgttacccggttaccgttttaccggttttacctttttagttttaaccggg

SEQ ID NO: 58582 - DNA, 293 bp, Homo sapiens
  misc_feature: GYAE6OF01BL2VU.24.10.A10.1.454.CMB.1.raw
  modified_base (288)..(293): a, c, t, g, unknown or other
  misc_feature (288)..(293): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctgccccctcggtcactctgttcccaccctcctcacatagtagtctgagcgggctggcaaggcgcatagnnnnnn

SEQ ID NO: 58583 - DNA, 291 bp, Homo sapiens
  misc_feature: GYAE6OF01DIFGP.24.10.A10.1.454.CMB.1.raw
  modified_base (288)..(291): a, c, t, g, unknown or other
  misc_feature (288)..(291): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctgccccctcggtcactctgttcccgccctcctcacatagtagtctgagcgggctggcaaggcgcatagnnnn

SEQ ID NO: 58584 - DNA, 297 bp, Homo sapiens
  misc_feature: GYAE6OF01ELTDG.24.10.A10.1.454.CMB.1.raw
  modified_base (292)..(297): a, c, t, g, unknown or other
  misc_feature (292)..(297): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggcctcgccccctcggtcactctcgttccccaccctcctcacatagtagtctgagcgggctggcaaggcgcatagnnnnnn

SEQ ID NO: 58585 - DNA, 294 bp, Homo sapiens
  misc_feature: GYAE6OF01DGR8X.24.10.A10.1.454.CMB.1.raw
  modified_base (289)..(294): a, c, t, g, unknown or other
  misc_feature (289)..(294): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggaggaccaagctgaccgtctagtcacgccaagctcgcccctcggtcactctcgttcccaccctcctcactatagtacgtctgacgcggctggacaaggcgacatagnnnnnn

SEQ ID NO: 58586 - DNA, 288 bp, Homo sapiens
  misc_feature: GYAE6OF01A5LCY.24.10.A10.1.454.CMB.1.raw
  modified_base (279)..(279): a, c, t, g, unknown or other
  misc_feature (279)..(279): n is a, c, g, or t
  modified_base (285)..(288): a, c, t, g, unknown or other
  misc_feature (285)..(288): n is a, c, g, or t
tcagactactatgtcacgaccggtgctcgatttagcgtcgatctcaggggtcccggagcgattctctggctccaagtctggcacctcagcctccctggtcatcagtgggctccggtccgatgatgaggctgattattactgtgcagcatgggatgccagtctgagtggtacgctgttcggcggagggactaagctgaccgtcctaggtcagcccaaggctgccccctggtcactctgttcccgcctcctcacatagtagtctgagcggctggcaaggcncatagnnnn

SEQ ID NO: 58587 - DNA, 295 bp, Homo sapiens
  misc_feature: GYAE6OF01CD366.24.10.A10.1.454.CMB.1.raw
  modified_base (289)..(295): a, c, t, g, unknown or other
  misc_feature (289)..(295): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctgccccctcggtcactctcgttcccgccctcctcacatagtagtctgagcgggctggcaaggcgcatagnnnnnnn

SEQ ID NO: 58588 - DNA, 293 bp, Homo sapiens
  misc_feature: GYAE6OF01DJTJC.24.10.A10.1.454.CMB.1.raw
  modified_base (288)..(293): a, c, t, g, unknown or other
  misc_feature (288)..(293): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggaggaccaagctgaccgtcctaggtcagcccaaggctcgccccctcggtcactctcgttcccaccctctcacatagtagtcctgagcggctggcaaggcgcatagnnnnnn

SEQ ID NO: 58589 - DNA, 293 bp, Homo sapiens
  misc_feature: GYAE6OF01DLST1.24.10.A10.1.454.CMB.1.raw
  modified_base (283)..(283): a, c, t, g, unknown or other
  misc_feature (283)..(283): n is a, c, g, or t
  modified_base (289)..(293): a, c, t, g, unknown or other
  misc_feature (289)..(293): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctcgccccctggtcactctcgttcccgccctcctcacatagtagtctgagcgggctggcaaggcncatagnnnnn

SEQ ID NO: 58590 - DNA, 303 bp, Homo sapiens
  misc_feature: GYAE6OF01CTULG.24.10.A10.1.454.CMB.1.raw
  modified_base (296)..(303): a, c, t, g, unknown or other
  misc_feature (296)..(303): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggaggaccaagctcgaccgtcctaggtcacgcccaaggcctccgccccctcggtcactctcgttccccgccctcctcacatagtagtctgagcgggctggacaacggcgcatagnnnnnnnn

SEQ ID NO: 58591 - DNA, 273 bp, Homo sapiens
  misc_feature: GYAE6OF01EN0LP.24.10.A10.1.454.CMB.1.raw
  modified_base (253)..(253): a, c, t, g, unknown or other
  misc_feature (253)..(253): n is a, c, g, or t
  modified_base (269)..(273): a, c, t, g, unknown or other
  misc_feature (269)..(273): n is a, c, g, or t
tcagactactatgtcacgaccggtgctcgatttagcgtcgatctcaggggtcccggagcgattctctggctccaagtctggcacctcagcctcgctggccatcactgggctccaggctgaggatgagggtgattactactgccagtcgtcgaagatgttcggcggagggactaagctgaccgtctaggtcagcccaaggctcgccccctggtcactctcgttccccgcctcctcacatagtagtctgagcggntggcaaggcgcatagnnnnn

SEQ ID NO: 58592 - DNA, 365 bp, Homo sapiens
  misc_feature: GYAE6OF02JA267.24.10.A10.1.454.CMB.1.raw
  modified_base (308)..(365): a, c, t, g, unknown or other
  misc_feature (308)..(365): n is a, c, g, or t
tcagactactatgtcacgaccggtgctcgatttagcgtcgatctcaggggttcccgggagcgattctctggactccaagtctggcacctcaggccctccctggccatcaggtggctccggtccgatgatgaggctgattattactgtgcagcatgggatcgccagtctgagtcggtacgctgttcggcggagggaccaagctgaccgtcctaggtcagcccaagggctagcccccctacggtcactctcgttcccaaccctcctcacactagtagtcctggagccgggactggccaaaggcgcatagnnnnnnnnnnnnnnnnnnnnnnnnnnnnnnnnnnnnnnnnnnnnnnnnnnnnnnnnnn

SEQ ID NO: 58593 - DNA, 289 bp, Homo sapiens
  misc_feature: GYAE6OF02G98SE.24.10.A10.1.454.CMB.1.raw
  modified_base (287)..(289): a, c, t, g, unknown or other
  misc_feature (287)..(289): n is a, c, g, or t
tcagactactatgtcacgaccggtgctcgatttagcgtcgatctcagggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctgccccctcggtcactctgttcccgccctcctcacatagtagtctgagcgggctggcaaggcgcatagnnn

SEQ ID NO: 58594 - DNA, 292 bp, Homo sapiens
  misc_feature: GYAE6OF02GIAYS.24.10.A10.1.454.CMB.1.raw
  modified_base (284)..(284): a, c, t, g, unknown or other
  misc_feature (284)..(284): n is a, c, g, or t
  modified_base (290)..(292): a, c, t, g, unknown or other
  misc_feature (290)..(292): n is a, c, g, or t
tcagactactatgtcacgaccggtgctcgatttagcgtcgatctcagggtcccggagcgattctctggctccaagtctggcacctcagcctccctggccatcaggtgggctccggtccgatgatgaggctgattattactgtgcagcagtgggatgccagtctgagtggtacgctgttcggcggagggaccaagctgaccgtcctaggtcagcccaaggctcgccccctggtcactctcgttcccaccctcctcacatagtagtctgagcgggctggcaaggcncatagnnn

SEQ ID NO: 58595 - DNA, 297 bp, Homo sapiens
  misc_feature: GYAE6OF02IJABZ.24.10.A10.1.454.CMB.1.raw
  modified_base (168)..(168): a, c, t, g, unknown or other
  misc_feature (168)..(168): n is a, c, g, or t
  modified_base (246)..(246): a, c, t, g, unknown or other
  misc_feature (246)..(246): n is a, c, g, or t
  modified_base (283)..(283): a, c, t, g, unknown or other
  misc_feature (283)..(283): n is a, c, g, or t
  modified_base (291)..(297): a, c, t, g, unknown or other
  misc_feature (291)..(297): n is a, c, g, or t
tcagactactatgtcacgaccggtgctcgatttagcgtcgatctcagggtcccggagcgattctctggctccaagtctggcacctcagcctcctggccatcagtgggctccggtccgatgatgaggctgattatactgtgcagcatgggatgccagtctgagtggacnctgttggcggagggaccgaagctgaccgtcctaggtcgagccaaggtctgccccctcggtacgactctgtcccgtccnccttccaacagtaagtgtctcgagcggctgacgaagngcattagnnnnnnn

SEQ ID NO: 58596 - DNA, 290 bp, Homo sapiens
  misc_feature: GYAE6OF02F223Y.24.10.A10.1.454.CMB.1.raw
  modified_base (287)..(290): a, c, t, g, unknown or other
  misc_feature (287)..(290): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctcgccccctggtcactctgttcccaccctctcacatagtagtctgagcgggctggcaaggcgcatagnnnn

SEQ ID NO: 58597 - DNA, 325 bp, Homo sapiens
  misc_feature: GYAE6OF02F8CQ5.24.10.A10.1.454.CMB.1.raw
  modified_base (292)..(325): a, c, t, g, unknown or other
  misc_feature (292)..(325): n is a, c, g, or t
tcagactactatgtcacgaccggtgctcgatttagcgtcgatctcagggtcccggagcgattctctggctccaagtctggcacctcagcctccctggccaatcagtgggctccggtccgatgatgaggctgattattactgtgcagcatgggatgccagtctgagtggtacgctgttcggcggagggaccaagctgaccgtcctaggtccagcccaaggctgccccctggtcactctgttccccgccctcctcacatagtagtctgagcgggctgggcaaggcgcactaggnnnnnnnnnnnnnnnnnnnnnnnnnnnnnnnnnn

SEQ ID NO: 58598 - DNA, 296 bp, Homo sapiens
  misc_feature: GYAE6OF02G5KOK.24.10.A10.1.454.CMB.1.raw
  modified_base (289)..(296): a, c, t, g, unknown or other
  misc_feature (289)..(296): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctgccccctcggtcactctcgttcccaccctcctcacatagtagtctgagcgggctggcaaggcgcatagnnnnnnnn

SEQ ID NO: 58599 - DNA, 293 bp, Homo sapiens
  misc_feature: GYAE6OF02H6421.24.10.A10.1.454.CMB.1.raw
  modified_base (289)..(293): a, c, t, g, unknown or other
  misc_feature (289)..(293): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctgccccctcggtcactctgttccccaccctcctcacatagtagtctgagcgggctggcaaggcgcatagnnnnn

SEQ ID NO: 58600 - DNA, 290 bp, Homo sapiens
  misc_feature: GYAE6OF02FNN5V.24.10.A10.1.454.CMB.1.raw
  modified_base (287)..(290): a, c, t, g, unknown or other
  misc_feature (287)..(290): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctgccccctggtcactctgttcccgccctcctcacatagtagtctgagcgggctggcaaggcgcatagnnnn

SEQ ID NO: 58601 - DNA, 333 bp, Homo sapiens
  misc_feature: GYAE6OF02IZ3KA.24.10.A10.1.454.CMB.1.raw
  modified_base (289)..(290): a, c, t, g, unknown or other
  misc_feature (289)..(290): n is a, c, g, or t
  modified_base (292)..(293): a, c, t, g, unknown or other
  misc_feature (292)..(293): n is a, c, g, or t
  modified_base (295)..(295): a, c, t, g, unknown or other
  misc_feature (295)..(295): n is a, c, g, or t
  modified_base (298)..(333): a, c, t, g, unknown or other
  misc_feature (298)..(333): n is a, c, g, or t
tcagactactatgtcacgaccggtgctcgatttagcgtcgatctcaggggtcccggagcgattctctggctccaagtctggcacctcagcctccctggccatcagtgggctccggtccgatgatgaggctgattattactgtgcagcatgggatgccagtctgagtggtacgctgttcggcggaggaccaagctgaccgtcctaggtcagcccaaggctcgccccctcggtcactctcgtcccgccctcctcacatagtagtctgagcgggctggcaaggcgcataggnngnngnagnnnnnnnnnnnnnnnnnnnnnnnnnnnnnnnnnnnn

SEQ ID NO: 58602 - DNA, 365 bp, Homo sapiens
  misc_feature: GYAE6OF02IWZ58.24.10.A10.1.454.CMB.1.raw
  modified_base (245)..(245): a, c, t, g, unknown or other
  misc_feature (245)..(245): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (297)..(300): a, c, t, g, unknown or other
  misc_feature (297)..(300): n is a, c, g, or t
  modified_base (302)..(365): a, c, t, g, unknown or other
  misc_feature (302)..(365): n is a, c, g, or t
tcagactactatgtcacgaccggtgctcgatttagcgtcgatctcgaggggtcccggagcgattctctggctccaagtctggcacctcagcctccctggccatcactgggctccaggctgagatgagggtgattactactgccagtcgtcgaagatggttcgcggagggactaagctgaccgtctaggtcagcccaaggctgccccctaggtcactctgttccccacctcctcacatagtagtcngacgcggctggctaaaggcgctagtaagnagcatnacgcttggaacnagctnnnnannnnnnnnnnnnnnnnnnnnnnnnnnnnnnnnnnnnnnnnnnnnnnnnnnnnnnnnnnnnnnnn

SEQ ID NO: 58603 - DNA, 295 bp, Homo sapiens
  misc_feature: GYAE6OF02G0NX7.24.10.A10.1.454.CMB.1.raw
  modified_base (172)..(172): a, c, t, g, unknown or other
  misc_feature (172)..(172): n is a, c, g, or t
  modified_base (282)..(282): a, c, t, g, unknown or other
  misc_feature (282)..(282): n is a, c, g, or t
  modified_base (288)..(295): a, c, t, g, unknown or other
  misc_feature (288)..(295): n is a, c, g, or t
tcagactactatgtcacgaccggtgctcgatttagcgtcgatctcaggggtcccggagcgattctctggctccaagtctggtacctcagcctccctggccatcagtgggctccggtccgatgatgaggctgattattactgtgcagcatgggatgccagtctgagtggtacnctgttcggcggagggaccaagctgaccgtcctaggtcagcccaaggctgccccctggtcactctgttccccacctcctcacatagtagtcctgagcgggctggcaaggcncatagnnnnnnnn

SEQ ID NO: 58604 - DNA, 578 bp, Homo sapiens
  misc_feature: GYAE6OF02JNZ87.24.10.A10.1.454.CMB.1.raw
  modified_base (141)..(141): a, c, t, g, unknown or other
  misc_feature (141)..(141): n is a, c, g, or t
  modified_base (179)..(179): a, c, t, g, unknown or other
  misc_feature (179)..(179): n is a, c, g, or t
  modified_base (209)..(209): a, c, t, g, unknown or other
  misc_feature (209)..(209): n is a, c, g, or t
  modified_base (292)..(292): a, c, t, g, unknown or other
  misc_feature (292)..(292): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (469)..(470): a, c, t, g, unknown or other
  misc_feature (469)..(470): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (531)..(531): a, c, t, g, unknown or other
  misc_feature (531)..(531): n is a, c, g, or t
  modified_base (540)..(540): a, c, t, g, unknown or other
  misc_feature (540)..(540): n is a, c, g, or t
  modified_base (552)..(552): a, c, t, g, unknown or other
  misc_feature (552)..(552): n is a, c, g, or t
  modified_base (576)..(576): a, c, t, g, unknown or other
  misc_feature (576)..(576): n is a, c, g, or t
tcagactactatgtcacgaccggtgctcgatttagcgtcgatctcaggggtcccggagcgattctctggctaccaagtctggcacctcagcctccctggccatcagtgggctccggtccgatgatgaggctgattattacngtgcagcagtggatcgccagtctaggagtcggtaccgnttcggtaacgggtcgaaggaccaaggtccncggaccgttacgtgtaccaccggtaccgaacggtccttcccggacccccgttcggtactaccgttcccgttccggtacccccncccttccgtaacctaatacgttaacgtaccggttcgtacggaccggtcgggtaccgtacggaccgacgggtcaacgtacgtaacggctacgcgaagctacgaacgctagcagctagcctagactcanaacgcttancgtaatcgacgtctagcgatccngtcngangcngtntcgannactangtacngacacgtntncgtgacgtancgtanctacgnganacgatacgtatacgacngtcaacgtnacgtctgtaacncctacggtctagtactcgtacgancg

SEQ ID NO: 58605 - DNA, 501 bp, Homo sapiens
  misc_feature: GYAE6OF01E27B5.8.42.D09.1.454.CMB.1.raw
  modified_base (396)..(396): a, c, t, g, unknown or other
  misc_feature (396)..(396): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctcagcgtccgggtctcctggacagtcagtcaccatctcctgcactggagccagcagtgattacaactatatctcctggtaccaacaacacccagacaaagcccccaaactcatgattttgagtcaataagcggcctcagggtccctgatcgcttctcaggctccaagtctggcaacacggcctccctgaccgtctctgggctccagactgaggatgaggttcngattattactgcagctcatatcaggcagcaacagggtatcggcggaggaccaagtgaccgtctaggtcagcccaggctcgccccctggtccactctgtcccaccc

SEQ ID NO: 58606 - DNA, 535 bp, Homo sapiens
  misc_feature: GYAE6OF01CK9TR.8.42.D09.1.454.CMB.1.raw
  modified_base (227)..(227): a, c, t, g, unknown or other
  misc_feature (227)..(227): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacaccaggcaaagcccccaaactcatgtatttttgagtacaataagcggccctcgagggtccctgactcgcttctcacggctccaagtctggacaacacggcctccctgaccgtctcgtcgggcctccagactgaggtatgagctgtattatactgcagctcatattcagcagctaacgagggtacttcggacggacggacctagtcgaccgtcgtacggtcacggcccgaaggtcctcgccccctcggtaccacttccgtcgttcccccg

SEQ ID NO: 58607 - DNA, 777 bp, Homo sapiens
  misc_feature: GYAE6OF01CAGHJ.8.42.D09.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcacatctcctgcactgganccagcagtgattacaactatatctcctagtaccaacaacaccaggacaaacgccccaaatcatgtattttagagtacaataagccgtcctcgacgggtccctagactcgtcttctacgacggtcctacgtaagtcgtacggaccaaccgtaccggtccctacccgtcggtacccgttccgttccgtcgggtacctacccgaaggtaaccgttaggaacgggtagtcgggaaggtccttaagttaacgtttaacgtttaacgtacggctaaacggtccttaacgtaagtttaacgtttacggaagggtaccgaaacggtaaccgaaacggttaaagggggttaaccggtttaccgggggaaaccggggtaaccggggtaaaccccgtaaagggtttacccggtaacccgggttaacccggttaacggggtacccgtaaaccgggtaccccggaaacgggttccccgttaccccgggtacccccccgtttacggggttacccctaacccgtttcccgttacccggtttccccccggtccccgtttaacccccggg

SEQ ID NO: 58608 - DNA, 531 bp, Homo sapiens
  misc_feature: GYAE6OF01C5EH1.8.42.D09.1.454.CMB.1.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (336)..(336): a, c, t, g, unknown or other
  misc_feature (336)..(336): n is a, c, g, or t
  modified_base (450)..(450): a, c, t, g, unknown or other
  misc_feature (450)..(450): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactntatctcctggtaccaacaacacccaggcaaacgccccaaactcatgatttttgaggtcaataagcggccatcaggggtccctgatcgcttctnagctcaagtctggcaacacggcctccctgaccgtctcgtgggctccgagtactgaaggatgaggtctgattattactgtcagctcatattcgagcagacaagtaggtattcggnggaggacgtaagttcgaccgtctaggtcagacccgaaggcctacgcccctacgggctaccttcgtccgttcccctaccccg

SEQ ID NO: 58609 - DNA, 518 bp, Homo sapiens
  misc_feature: GYAE6OF01A397P.8.42.D09.1.454.CMB.1.raw
  modified_base (510)..(510): a, c, t, g, unknown or other
  misc_feature (510)..(510): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagccccaaactcatgattttgaggtcaataagcggccctcagggtccctgatcgcttctcaggctccaagtctggcaacacggcctccctgaccgtctctgggctccagactgaggatgaggctgattattactgcagctcatattcagcagcaacgagggtattcgggcggaggaccaagttgaccgtctaggtcacgcccaaggcctcgccccctcggtccacgtcctcgttcccnccctcccg

SEQ ID NO: 58610 - DNA, 716 bp, Homo sapiens
  misc_feature: GYAE6OF01DUAUF.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtaccaacaacaccagcaaacgccccaaactcatgtattttgaggtacaataagcgccctcgacgggtcctgactcgcttctcaggctcaagtctgacaacgacggcctcctcgaccgtctcgtcgggcctccgagtacgtggacggtagtggacggtcttaggtaattttacgttaaccgtcggtacctaacgtccttacgtaacgtttaactttacggaacgggtacctaacggtaacccgtaaacgggtaacggggtttaacggtttaccggggaccggggtaaaccgggtaacccgttaaacgggtttaccggtaacccggttacccggttaaacgggttcccggaaacccggtaccccggtaaacgggtccccgttaccccggtaccccccggttaccgggttacccttaaccccgttcccgtttaccccggtttccccccgtaaccccgtttacccccgg

SEQ ID NO: 58611 - DNA, 581 bp, Homo sapiens
  misc_feature: GYAE6OF01BJVJZ.8.42.D09.1.454.CMB.1.raw
  modified_base (231)..(231): a, c, t, g, unknown or other
  misc_feature (231)..(231): n is a, c, g, or t
  modified_base (343)..(343): a, c, t, g, unknown or other
  misc_feature (343)..(343): n is a, c, g, or t
  modified_base (436)..(436): a, c, t, g, unknown or other
  misc_feature (436)..(436): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagccctccctccgcgtccgggtctccgtggacagtcagtccaccatcctcctgcacgtggacnccagcagtgattacaactatatctcctggtaccaacaaccaccaggacaaacgccccaaactcatgtattttgaggtcaataagcggcctcgacgggtccctgatcgcttcncaggcctacaagtctggacaacaccggcctcctcgacccgtctcgtcgggcctccgagactgaggatggagtctgtattattactgcagctanattattcaggacagactaacgtagggttactcgggacggaacgggtacctaaggttcgaccgtaccgtacggtcgaacgtcccgaaggtccgtccgtcccccgtacggtcctaccgtccgttccgttcccccgtcccttaccccg

SEQ ID NO: 58612 - DNA, 510 bp, Homo sapiens
  misc_feature: GYAE6OF01CTZD8.8.42.D09.1.454.CMB.1.raw
  modified_base (243)..(243): a, c, t, g, unknown or other
  misc_feature (243)..(243): n is a, c, g, or t
  modified_base (504)..(504): a, c, t, g, unknown or other
  misc_feature (504)..(504): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactntatctcctggtaccaacaacacccaggcaaagccccaaactcatgattttgagtcaataagcggcctcagggtccctgatcgcttctcaggctcaagtctggcaacacggcctcctgaccgtctctgggctccagactgaggatgaggctgattatactgcagctcatattcaggtcagcaacgagggtattcgggcgagggaccaaggttcgaccgtcgtaggtcacgacccaaggctcgcccctgtcactctcgtcccncctccg

SEQ ID NO: 58613 - DNA, 517 bp, Homo sapiens
  misc_feature: GYAE6OF01BE9B0.8.42.D09.1.454.CMB.1.raw
  modified_base (510)..(510): a, c, t, g, unknown or other
  misc_feature (510)..(510): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgacccgtctctgggctccagactgaggatgaggctgattattactgcagctcatattcaggcagcaacgagggtattcgggcggagggaccaagttcgaccgtcgtaggtcagcccaggctcgcccctcgtcactctcgtcccnccctccg

SEQ ID NO: 58614 - DNA, 534 bp, Homo sapiens
  misc_feature: GYAE6OF01CO61A.8.42.D09.1.454.CMB.1.raw
  modified_base (520)..(520): a, c, t, g, unknown or other
  misc_feature (520)..(520): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaacgcccccaaactcatgtattttgaggtcaataagccggccctcgagggtccctgatcgcttctcaggctccaagtctggacaacacggccctcctcgaccgtctctcgggctccgagactgaggatgaggctagtatttatactgcagctcattattcgaggcagcaacgagggtacttcgggacggagggaccaggttcgaccgtaccgtaggtcacgcccgaaggctcgcccctcggtccnctcgtcgttccccg

SEQ ID NO: 58615 - DNA, 700 bp, Homo sapiens
  misc_feature: GYAE6OF01CE1W6.8.42.D09.1.454.CMB.1.raw
  modified_base (242)..(242): a, c, t, g, unknown or other
  misc_feature (242)..(242): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagccagcagtgattacaactntatctcctggtaccaacaacaccaggacaaacgccccaaactcatgtattttgaggtcaataacgcgccctcgagggtccctgactcgcttctcaggcctcaagtctcggcaacacggcctccctgacccgtctcgtcgggctccgagactggacggtactaggtacggtacgttaggtaactttaacgttacgtacggactacggtcctactaattacgttaccgaaggtaccgaaggtaccgaaacggttaacggggttacggttaccggggtacgggtaacggggtaacccgtaaacgggtttaccggaaccccgggtttacccggttacgggtacccgaaccggttacccccggaaacgggttccccgtccccgggtaccccccggtttaccgggttacccgtaacccgttttcccgtttacccggtttacccccgtacccccgtttaccccgg

SEQ ID NO: 58616 - DNA, 550 bp, Homo sapiens
  misc_feature: GYAE6OF01D829U.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcgagggtccctgatcgcttctcaggctccaagtctggcaacacggccctcctgaccgtctctgggctccagactgaggatgaggctgattatactgcagctcattattcaggcagcaacgagggtattcgggacggagggacccgtaaaggttcgaccggtcctagggtccacggacccaaggcctccggccccccttcggtcccactccttcccggttcccccaccccgttccccg

SEQ ID NO: 58617 - DNA, 635 bp, Homo sapiens
  misc_feature: GYAE6OF01D5SI4.8.42.D09.1.454.CMB.1.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (339)..(339): a, c, t, g, unknown or other
  misc_feature (339)..(339): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccggtctccgtggacagtcagtcaccatctcctgcactgganccagcagtnattacaactatatctcctggtaaccaacaacaccaggacaaacgccccaaatcatgtattttgagtacaagtacgcgtcctcgacgggtccctgactcgtcttcncgacggctactaagtccgtacggaccaaccgaccggtccctacccgtcgtacccgttcgtcgtcgggcctaccgacgtacgaggaggtagtcggagtctagtatttactacgtgactagtctactaattacttacgagacaacgaacctaacggtagggttacgttcggggacggacgggtaacctaaggttcgtacccgttaccgtaacgggtaccaccggtacccgaaggtccctacccgtcccccgtacggtccctaccgttcccgttacccgttccccgaccccgttacccg

SEQ ID NO: 58618 - DNA, 519 bp, Homo sapiens
  misc_feature: GYAE6OF01BZXTA.8.42.D09.1.454.CMB.1.raw
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
  modified_base (466)..(466): a, c, t, g, unknown or other
  misc_feature (466)..(466): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaacgcccccaaatcatgattttgagtcaatagcgccctnagggtccctgatcgcttctcaggctccaagtctggcacacggcctcctgaccgtctcgtggctcagctgagntgaggctgattattactgctagctacattatcgagcagcaacgagggtattcggacggaggaccagttgaccgtcctaggtccngcccaagggtcctacgcccccttccggtacaccttctcgttccccgccctccg

SEQ ID NO: 58619 - DNA, 421 bp, Homo sapiens
  misc_feature: GYAE6OF01ER064.8.42.D09.1.454.CMB.1.raw
  modified_base (405)..(405): a, c, t, g, unknown or other
  misc_feature (405)..(405): n is a, c, g, or t
  modified_base (411)..(421): a, c, t, g, unknown or other
  misc_feature (411)..(421): n is a, c, g, or t
tcagctcgcgtgtccacgaccggtgctcgatttagacacatacgcagggaaaggggctggagtgggtctcagttatttatcgcgatggtggcacacactacgcagactccgtgaagggcagattcaccgtctccagagacaattccaagaacatggtgtatcttcaaatgaacagactaacagccgaggacacggccgtatattactgtgcgagacatgactacggtgagccctggggccagggaaccctggtcaccgtctcctcagcctccaccaagggcccatcggtccttccccctggccgcccctgcctcccgaggacgccaccctccgagacgcacagccggccctgggctgcctggcaaggctacttccgacacgcgagctgagcgggctggcaaggcncatagnnnnnnnnnnn

SEQ ID NO: 58620 - DNA, 545 bp, Homo sapiens
  misc_feature: GYAE6OF01ER41K.8.42.D09.1.454.CMB.1.raw
  modified_base (535)..(535): a, c, t, g, unknown or other
  misc_feature (535)..(535): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcaggggtccctgatcgcttctcaggctccaagtctggcaacacggcctccctgacccgtctcgtgggcctccagactgaggatgaggctgattattactgcagctcatattcaggcagacaacgaggggtattcgggacggagggacctaaggttcggacccgttccgtaggtcacggaccccaaggcctcggccccctcgggtccacctcctcgttccccncccgttcccg

SEQ ID NO: 58621 - DNA, 606 bp, Homo sapiens
  misc_feature: GYAE6OF01A4RLX.8.42.D09.1.454.CMB.1.raw
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaacgcccccaaatcatgattttgaggtacaataagcgcctcgacgggtccctgatcgcttctcaggctcagtctggacaacacggcctccctcgaccgtctcgtcgggcctccgagactgagagtgaggctgtattattactgcagtctacattacttacgacggtacacgtaccgaaacgtagggttacgttcggggaccgggtaacgggtaaccgtaaggttccggaacccggttaccgtacgggtaccaccggtaccccgtaaacgggtcccgttaccggtccccccgttacggtacccgtaacccgttccgtcccgttacccccccg

SEQ ID NO: 58622 - DNA, 677 bp, Homo sapiens
  misc_feature: GYAE6OF01C4D3A.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcacgtggacgccagcagtgaattacaactatatcctcctagtaccaacaacaccaggacaaacgccccaaatcatgtattttgagtacaataacgcgcctagtacgggtcctgactcgtcttctacgacggtcctaccgtaacgtcgtcggaccaaccgacccggtccctcccgtcgtacccgtcgtcgtcgggcctaccgaacgtacgttaggaacggtacgtggaacgggtcttaggtaactttacgttaactcgactagtacctataattacttacgaggtacacgtacgaaacggttacgggtacgttcggggacggaaccgggtacgtaacggtttaccggaccgtacccggttaaggtacccgtacggaaccccgaacggtccgtaccccggtccccccgttacggtaccctaaccgtttcccggttcccgttcccccgtccccgttaccccgg

SEQ ID NO: 58623 - DNA, 690 bp, Homo sapiens
  misc_feature: GYAE6OF01DIPY1.8.42.D09.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacngtcagtcaccatcctcctgcacgtggacnccagcagtgattacaactatactctcctgtaccaacaacaccagacaaacgccccaatcatgtattttgaggtacaagtaacgcgtccctacgacggtccctgactcgtcttctcaggtcctaccgaagtctggaccaacgaccgccctccctcgacccgttcgtcgtcgggcctaccgagtacgtaggaggtacgtggacgtctagtaactttattaacgtggtcctaacgtccgttactaatttacgttacgacggtaccgaagtaccgaacggtacgggttacgtaccgggacggggtaacgggtaccgtaaaggtttacccgggaacccgttaccgtaacgggtaccgaaccggtaccccggtaaagggtccccgttacccgggtacccccccgttacggggttacccctacccggttacccgtttaccccggttcccccgtaaccccgttacccccgg

SEQ ID NO: 58624 - DNA, 497 bp, Homo sapiens
  misc_feature: GYAE6OF01DPOJA.8.42.D09.1.454.CMB.1.raw
  modified_base (225)..(225): a, c, t, g, unknown or other
  misc_feature (225)..(225): n is a, c, g, or t
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
  modified_base (488)..(488): a, c, t, g, unknown or other
  misc_feature (488)..(488): n is a, c, g, or t
tcagctcgcgtgtccacgaccggtgctcgatttagacacatacgcagggaaaggggggggtctcaggaggcagcgctctcaggacgtcaccaccatggcctggtctcctctcctcctcactctcctcgctcactgcacagggtcctgggcccagtctgtactgacgcagccgccctcagtatctggggccccagggcagagggtctccatctcctgcactgggancagaaccagcagtcggggcaggttatgatgttcattggtaccgccaggttccaggcacagcccccagactcctcattaatgataacacaatcgcctcagggtctctgaccgattctctgcctcaagtctggctacttctcgcctcctgtcatatctgtctccgaggtgaggntgagtctgattatactgcactctangacaacagcctagatattgctgtcggcggtcggactaggttcgaccgtctacgtcacgcccaagcncgtcccccg

SEQ ID NO: 58625 - DNA, 534 bp, Homo sapiens
  misc_feature: GYAE6OF01EQA61.8.42.D09.1.454.CMB.1.raw
  modified_base (227)..(227): a, c, t, g, unknown or other
  misc_feature (227)..(227): n is a, c, g, or t
  modified_base (426)..(426): a, c, t, g, unknown or other
  misc_feature (426)..(426): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaagcccccaaactcatgattttgaggtcaatagcgccctcgagggtccctgatcgcttctcaggctccaagtctggacaacacggcctccctgaccgtctccgtgggcctccgagtacctgaggatgaggctgtattattactgctagctnatattcgagcagactaacgtagggttattcgggcggacggactaaggttcgaccgtcgtaggtcacggccgaaggctccgccccgtggtaccaccttcgtcgtccccc

SEQ ID NO: 58626 - DNA, 520 bp, Homo sapiens
  misc_feature: GYAE6OF01E113T.8.42.D09.1.454.CMB.1.raw
  modified_base (224)..(224): a, c, t, g, unknown or other
  misc_feature (224)..(224): n is a, c, g, or t
  modified_base (483)..(483): a, c, t, g, unknown or other
  misc_feature (483)..(483): n is a, c, g, or t
  modified_base (496)..(496): a, c, t, g, unknown or other
  misc_feature (496)..(496): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaagcccccaaactcatgatttttgaggtcaataagcggccctcaggggtccctgatcgcttctcaggctccaagtctggcaacacggcctccctgacccgtctctgggcctccgagactgaggatgaggctgatttatactgcagctcattattcgagcagaccaacgagggttattcgggcggagggaccaagcgtgaccgtcctgcgtnacgcccaaggccncgtccccgtgcactctcgtccccc

SEQ ID NO: 58627 - DNA, 872 bp, Homo sapiens
  misc_feature: GYAE6OF01BXSQT.8.42.D09.1.454.CMB.1.raw
  modified_base (265)..(265): a, c, t, g, unknown or other
  misc_feature (265)..(265): n is a, c, g, or t
tcagctcgcgtgtccacgaccggtgctcgatttagacacatacgcagggaaaggggggggtctcacggaggcagcgactcgtcgattcgacgttcgaccaccatggcctagggctactgctccgtcctcaccctctcgacttcgagggcacgagggttccgtttcgggccctaggtccttcgttacccgtggactcagtcctccctacgcgtccggtactccgtggactaggtcgggagtcgaccagtcctcgtgccagtggacnccagcgagtcgagttaccaacttagtacttcctccttacggtaaccctaaacctaaccgacccgtaggaccaaaaccgtaccccccgtaaacctccaacgtcgttacgtttttagggacggttacgtaacgttaacgggccgggtaccccgttaccggtacggggggttccccttaggttacgtttaccgtaaccttttccgtacggtaacggggtacctttacccgttaaacggttaccgttacgggtaacctaaaccgtaacggttaccggtacccccgttacccggtaacgggtaccccgtttaccgttacccggtaccgggtaccctttacccgaacggtaaccgttaacgggtaacggttaacgttaccgggaaacgggtaccgtaacgggttaattttacgtttaacgttcggacgtaacgtaccgttacgtaacttacgtttaccgaagggtacctaacggaccgtaaccgtagggttacgttacgggtacggtaacggtaaccgtaagggttacggaaccgggtacgtacggtacgacggcccgaaggtccctaccgtaccccgttacggtacctaccgttccgttccggttacccccg

SEQ ID NO: 58628 - DNA, 536 bp, Homo sapiens
  misc_feature: GYAE6OF01EJVU0.8.42.D09.1.454.CMB.1.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaacgccccaaactcatgtattttgaggtcaataagcggccctcaggggtccctgatcgcttctcaggctccaagtctggcaacacggccctcctgacccgtctcgtggctccagactgaggatgaggctgatttattactgcagctcatattcaggcagacaacgagggttacttcgggacggagggaccaaggttcgaccgtcctaggtcgacgcccgaaggcctccgccccctcggtccactcctcgttccccgccctcccg

SEQ ID NO: 58629 - DNA, 719 bp, Homo sapiens
  misc_feature: GYAE6OF01DXR06.8.42.D09.1.454.CMB.1.raw
tcagctcgcgtgtccacgaccggtgctcgatttagacacatacgcgagggaaaggggtctgggagaggagcccagcactgggattccgaggtgtgtccattcggtgatcagcactgaacacagaggactcaccatggagttctggctgggcttgggttttccttgttgctaatttcaaaaggtgtccagtgtgaggtgcagctggtggagaagtgggaggggcttgatccgaggccgggggtcctggacgactctccgtgtgctagtcctcgtcggcttccaccatcagtagagactacatgacgcgtcgggcccgccgaggcctaccggaggggaacgggtctgggaggtcgggtctacgtaaggtttattttacgcggtacgtagttgggtacggaccacgacaccgttacgcgaaggtaccttccggtaggaacgggcaggtacttccgaacccgttctaccgaaggactaacctaacgttacccgaaaagtaactacgtagggttacgttaacttaccgttaacaaaagttacggaaactaacgggtaaccttaaacggaccggaacccgggtaacggaacccgtaccggggtaccttaaagtttaaccggttaacgttacggtaaggtaccgtaaacggaaacctaggttaaccggtaaccggttaaccgggttacggaaacccggtccccgggtacggggggtaaacccccgg

SEQ ID NO: 58630 - DNA, 632 bp, Homo sapiens
  misc_feature: GYAE6OF01A4H27.8.42.D09.1.454.CMB.1.raw
  modified_base (224)..(224): a, c, t, g, unknown or other
  misc_feature (224)..(224): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactgganccagcagtgattacaactatatctcctggtaccaacaacacccaggccaaacgccccaaactcatgtactttttgaggtacaataacgccggcctcgacggggttccctgactcgcttcncaggcctcagtctggctaacncggtcctcccgtgtacccgtctcgtcggcctccgagactgaggatggaggcttggaattacttaactcgacagtcctactattacgttacacggtacaggacctaacggtaggggttacgttacggggacgggtaacggtaccgtaaacggttcggtaacccgtacccgttaagggtcctaacggtaccccgaaggtcccgtaccggtaccccccgtacggtccgtaacccgttccgttaccggttcccccgtccccgttaccccgg

SEQ ID NO: 58631 - DNA, 712 bp, Homo sapiens
  misc_feature: GYAE6OF01EBJ56.8.42.D09.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactgganccagcagtgattacaactatatctctgtaccaacacaccagacaaacgccccaaatcatgtattttgaggtcaataacgcggcctcgacgggtccctgactcgcttctcgagctcagtctcggacaacgacggccctccgtgtacccgtctcgtcgggtcctaccgagtaccgtaggaacggtacgtcggaagggtcccttaggtaactttaacgttaaccgtggtacctaacggtccttacgtaacgtttacgtttaccgaacgggtacctaacggaccgtaaaaccggtacggggttaacgtttccggggaaccgggtaacggggtaacccgtaacgggtttacggaacccccggtttaccgttaaacgggtttaacccggaccccggtaaacgggtcccgttacccgggtacccccccgttgggtaccccgtaccgttacccgttacccggtttccccccgtaccccgttcccggttaaccccgg

SEQ ID NO: 58632 - DNA, 533 bp, Homo sapiens
  misc_feature: GYAE6OF01CHP4T.8.42.D09.1.454.CMB.1.raw
  modified_base (243)..(243): a, c, t, g, unknown or other
  misc_feature (243)..(243): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactntatctcctggtaccaacaacacccaggcaaacgcccccaaactcatgatttttgaggtcaataagcggccctcgaggggtccctgatcgcttctcaggctcaagtctggcaacacggcctcctgacccgtctcgtcgggctccagactgaggatggaggctgatttattactgcagctcatattcaggcagacaacgtagggtatcgggcggagggaccaagttcgaccgtcgtaggtcacggcccaaggcctccgccccctggtccacgtcctcgttcccgccctcccg

SEQ ID NO: 58633 - DNA, 595 bp, Homo sapiens
  misc_feature: GYAE6OF01ERYG4.8.42.D09.1.454.CMB.1.raw
  modified_base (224)..(224): a, c, t, g, unknown or other
  misc_feature (224)..(224): n is a, c, g, or t
  modified_base (402)..(402): a, c, t, g, unknown or other
  misc_feature (402)..(402): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccagcaaacgccccaaatcatgtattttgaggtcaatagcggccctcgacgggtcctgatcgcttctcacggctaccaagtctggcaacaccggtccctcccgtcgacccgtctcgtcggcctccgagactagaagntggaggtctaggtaattacttacgtcgcctagttcttagtcgacacggccgcctggacgtcggtctagtcgttcgtcgtttcggggacggggtacctaggtccgtacggtaccgtaccgttaccgtcgaccggtaccccgaacggtcccgtccggtacccccgttacggttaccctaccgttccgttaccccg

SEQ ID NO: 58634 - DNA, 710 bp, Homo sapiens
  misc_feature: GYAE6OF01CS3NJ.8.42.D09.1.454.CMB.1.raw
  modified_base (239)..(239): a, c, t, g, unknown or other
  misc_feature (239)..(239): n is a, c, g, or t
  modified_base (493)..(493): a, c, t, g, unknown or other
  misc_feature (493)..(493): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatcctcctgcacgtggacgccagcaggtnaacttaacaactatactcctccgtacgtaaccaaaccaacacccgaggaccaaaccgaccccaaactcatgttattttggaacggtacaaagtaacggccggtaccctacggtacggggtccctagtactccgtcttccgtcgacggtcctacgaaagttccgtacggactaacgaccggtccctccgtacgtaccgtctcgtggtccacgagtacgtggaggtactggtaacgcttaggtaactttaattcgngtacagtctactattactcgaaggtcaacgtacgaaacggttagggttcgttaccggggacgggtaacggtacgtaacgggtttaccgaacccggttccggttaacgggtacccgtaaccggtacccgaacgggttcccgttccccggtaacccccgtcggttaccctaacccgtttcccgttaccccgttacccccgaaccccggttaaccccggg

SEQ ID NO: 58635 - DNA, 635 bp, Homo sapiens
  misc_feature: GYAE6OF01DBOUJ.8.42.D09.1.454.CMB.1.raw
  modified_base (225)..(225): a, c, t, g, unknown or other
  misc_feature (225)..(225): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctcctgcactggacnccagcagtgaacttacaaacttatactcctcctcggtaaccaacaacacccaggaccaaacgccccaaaactcatcgtattttgagttacaataagcgcctacacgggtcctgactcgcttctcagtctacctaagtctcggacaacgaccggtcctccgtcgacccgttctcgtacgggctaccgacgacgtagaggtagtggtaaggtctagtacgttaacgttactacgctacgtcctacgtacttacgttacgaggtacgaccgtacgaacgtaacggggttacgttcgggacggaacgggtacgtaacggtcgtaccgtaccgttaggtccgtacggacccaacggtcctcccggtaccccgttcggtacctaccggtactcccggtttacccgcccttacccgg

SEQ ID NO: 58636 - DNA, 524 bp, Homo sapiens
  misc_feature: GYAE6OF01DD9QY.8.42.D09.1.454.CMB.1.raw
  modified_base (476)..(476): a, c, t, g, unknown or other
  misc_feature (476)..(476): n is a, c, g, or t
tcagctcgcgtgtccacgaccggtgctcgatttagacacatacgcagggaaaggggtgggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaatgggagggggcttgatccgaggccggggggtccctgagactctcctgtgcagcctctggcttcaccatcagtagagactacatgagcttggcccgcaggctccgagggaagggctggagtgggtctcgatttattatcgcgatggtggcacacactacgcagactccgtgaagggcagattcaccgtctccagagacaattccaaagaacagtgtagtatcttacaatgaacagaactaacagccgaggacacggaccttatacttacnggtcgcgagacagtgactacggtgacgcccggtggggccctaacgggg

SEQ ID NO: 58637 - DNA, 527 bp, Homo sapiens
  misc_feature: GYAE6OF01DSKOU.8.42.D09.1.454.CMB.1.raw
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacaccaggacaaacgccccaaactcatgtattttgagtcaataagcggcctcgagggtccctgatcgcttctcaggctccaagtctggacaacgaccgcctccctgacccgtctcgtcgggctccgagactgaggatgacggctagtaatttacttactgacagctactatattcgagcagacaagtaggttatcggcggacggactaagtcgaccgtcgtacggtcacgccgaacgctcgcccctaggcacgtctcgtcccg

SEQ ID NO: 58638 - DNA, 781 bp, Homo sapiens
  misc_feature: GYAE6OF01A20UP.8.42.D09.1.454.CMB.1.raw
  modified_base (233)..(233): a, c, t, g, unknown or other
  misc_feature (233)..(233): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacgagggtcctgggcccagtctcgccctgactcagccctccctccgcgtccggtctcctggacagtcagtccaccatcctcctgccacgtgggacnccagcgtagtgtaacttaacaacttagtacttccttccgtacggtaaccaaaccaacccaacccgaggaaccaaaccgaccccctaaactctaattacggtttactttttaggaacggttaactaaacgttaaccggcccggtacccgtacgggtaccggggttccctaggtaccgttaccggtccttaccgtacgtaccggttccctaaccgtaacgttccgtacggaacctaaccgcccgtccctacccgtcgtacccgtcgtacggtccggtcctaccgacgtacgtaggtacggtacgtaggacggtacgttagttaacgtttacgttacgtcggacctacgtccttactacgtttacgtacgaacgggtacaacgtaacggtaacggttacggggttacggtaccgggacggggtaacggtaacgttacggttaccgtaccggttaccggtaacggtaccgacccggtaccggtaccggtccctccccggtaccccgttcggtaccctaccgttacccgtccccgttccccgcccgttacccg

SEQ ID NO: 58639 - DNA, 561 bp, Homo sapiens
  misc_feature: GYAE6OF01DYNMO.8.42.D09.1.454.CMB.1.raw
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (554)..(554): a, c, t, g, unknown or other
  misc_feature (554)..(554): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggagccagcagtgaattacaactatatctcctggtaaccaacaacacccaggacaaacgcccccaaactcactgtatttttgaggtcaaagtaagcggccctcgacggggtccctagactcgtcttctcgacggtcctccaagtcctaggaccaacgaccggtccctcccgtcgacccgtctcgtcggcctaccagactggagtatggaagcttgaatttatctgcagctnattntcgagcaagcaaacgtgggtacttcgggacggtacggactaagtcgaccgtccgtaggcacgacccaggcctccgcccctcgtcactctccttcccnccctccg

SEQ ID NO: 58640 - DNA, 594 bp, Homo sapiens
  misc_feature: GYAE6OF01BCZEH.8.42.D09.1.454.CMB.1.raw
  modified_base (226)..(226): a, c, t, g, unknown or other
  misc_feature (226)..(226): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactgganccagcagtgattacaactatatctcctggtaccaacaacaccaggacaaacgaccccaaactcatgtattttgagtacaatagcggccctcgacgggtcctgatcgcttcncagctcagtctgcacncgcctcctgacccgtctcgtcggcctaccgagacgtgaggatggaggctagtaatttacttacgtgctagccttanaagttnttacgacggcaacgacaacggtagggttacgtcgggaccgggaacgggtacctaaggttccgaaccggttccgtaaggtaccgacggtaccccgaacggtcccgacccgtcccccgtacggtccctaccgttccgtcccgttccccgtccccgttcccg

SEQ ID NO: 58641 - DNA, 586 bp, Homo sapiens
  misc_feature: GYAE6OF01BZTGB.8.42.D09.1.454.CMB.1.raw
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
  modified_base (575)..(575): a, c, t, g, unknown or other
  misc_feature (575)..(575): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggancccagcagtnattacaactatatctcctggtaccaacaacaccaggcaaacgcccccaaactcatnattttgagtcaataagcggccctcaggggtccctgatcgcttctcagctcaagtctggcaacaccggcctccctcgacccgtctcgtcgggctccgagacctgacggatcggaggtcgtagtatttattacctgaccacgcttcaattacttcaggcaagaccaaacgtaggggttacgttcggggacgggaggggtaccctaaggttcggaccgttccgtaggtacgacgacccgaaggccctacgccccccgtacggtcctaccgttaccgtccgtttccccncccgttccccg

SEQ ID NO: 58642 - DNA, 722 bp, Homo sapiens
  misc_feature: GYAE6OF01A69JA.8.42.D09.1.454.CMB.1.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctgtaccaacaaccaccaggcaaacgccccaaacncatgtattttgaggtctaataacgcggcctcgacgggtcctgactcgtcttctcgacggtctaccaagtctcggaccaacgccggccttccctcgacccgttacgtccgtcgggccttacccgacgtacgttcggacggtagtcggacggtcgtagtaatttacgttactcgtactacgtcctacgtaacttacgttacgacggtacaacggtaccgtaacggtacggggtttaacggttaccggggtaccgggtaaccgggtaacccgttaaacgggtttccgggtaaccccgggttaccggtaaccggggttccgtaaaccgggtacccccggtaaacgggtcccccggttacccggtaccccccggttaccgggttccccgttaacccgttacccgtttaccccggttaccccccgttaccccggttacccccgg

SEQ ID NO: 58643 - DNA, 591 bp, Homo sapiens
  misc_feature: GYAE6OF01EHHPM.8.42.D09.1.454.CMB.1.raw
  modified_base (223)..(223): a, c, t, g, unknown or other
  misc_feature (223)..(223): n is a, c, g, or t
  modified_base (442)..(442): a, c, t, g, unknown or other
  misc_feature (442)..(442): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctcgcgtccggtctccgtggacagtcagtcaccatctctgcactggacnccagcagtgattacaactatactctcctagtaccaacaaccaccaggacaaacgaccccaactcatgtattttgagtcaagtacgcgccctcgacgggtcctgactcgtcttctacgacggtctaccgaagtcgtacggaccaaccgaccggccctcccgtcgtacccgtctcgtcggtcctaccgagacgtggagatggaggtctagtattacttacngacagtctatacttatcgaggcaagacaacggtgggttacgtcgggacggaggaacgtaggttacggaccgttccgtaggtacgacggacccgaaggtccgtacccgtccccgtgtacctccttaccgtccgttccccgcccgtacccg

SEQ ID NO: 58644 - DNA, 713 bp, Homo sapiens
  misc_feature: GYAE6OF01CQH25.8.42.D09.1.454.CMB.1.raw
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
tcagctcgcgtgtccacgaccggtgctcgatttagacacatacgcaggggaaagggggggtctcaggaggcagcgctctcaggacgtcaccaccatggcctgggctctgctcctcctcaccctcctcactcagggcacgagggtcctcgggcccagtctgccctgactcacgccctccctccgcgtccgggtctccgtggacagtcagtccaccatcctcctgccacgtggacnccagcagtgacttacaactntactcctcctaggtaaccaacaaccaccaggacaaaccgaccccaaactcatcgtattttgaggtacaataacgccgccctcgacgggtccctgactcgtcttcgtcgacgtcctaccgaagtcgtcggaccaacgaccggtccctcccgtacgtcccgttcgtcgtcgggtcctaccgacgtaccgtggaacggacgtggacgggtccttaggtaactttaacgttacgtcgaccgagtcctactaagttacttaccgaaggactaacggaaccgtaaacggttacggggttacgttaccggggacgggtaacggggtaacctaagggtttaccggacccggttaccgtaccgggtaaccgacccgggtacccgaaacgggttcccttacccgggtcccccgttacgggtacccttaccgttcccttccccggttaccccctaccccgttacccccgg

SEQ ID NO: 58645 - DNA, 805 bp, Homo sapiens
  misc_feature: GYAE6OF01A70GB.8.42.D09.1.454.CMB.1.raw
  modified_base (228)..(228): a, c, t, g, unknown or other
  misc_feature (228)..(228): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcacgtggacnccagcagtcgaattacaactatatctcctggtaccaacaacacccagacaaacgccccaaactccatgtattttagaggtacaataacgcgaccctcgacgggtcctgactcgcttctcgacggcctaccgaacgtcgtacggacaaccgaccggtcccttacccgtcggtaaccccgttccgttaccggttcggggtacccttacccgaacggtaaccgttacggtaaacgggtacgttacgggaacgggtacgttaggtaacgttttaacgtttaaccggtcgtacgttacgggtacccttacgttaattacgtttaccgaacggggtacctaacggaccgtaaaccgggtaacggggtttaaccgggttaccggggtaaccggggtaaccgggtaaccgtaaaccgggttaccggtacccggtttacccgggttaaccggtaccgtaacccgggtaccccggtaacccgggtcccttacccccgggttacccccggttaccggtttaaccccgttacccggttaccccggttttaccccccgttacccccccgtcccccggtttaacccccggg

SEQ ID NO: 58646 - DNA, 747 bp, Homo sapiens
  misc_feature: GYAE6OF01B8VJ1.8.42.D09.1.454.CMB.1.raw
  modified_base (234)..(234): a, c, t, g, unknown or other
  misc_feature (234)..(234): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctctcactcagggcacgagggtcctgggcccagtctgccctgactcacgcctccctcgcgtccgggtctcctggacagtcagtcacatctcctgcacgtggacgccagcagtnattaacaactatacgtctccgtaggtaaccaacaaccaccgaggaccaaaccgaccccaaactcattagtatttttagacggttacaacgtaacgccggaccctacggacgggtccctagactcggtcttcgtcgacggtcctacgtaacgtcgtaggacctaaccgacccggtcccttacccgtacggtacccgttccgttaccggtaccggaccttaccgaacgtacgtacggaaggtacgtggaacggtcgttaagttactttaacgttacgtcggacgtaccgtcttataacgttaacgttacgacgggtaacgacgaacgtaacgggtttaacggggttacgttaccggggaaccggggttaacggaaccgtaacggttaccggttaacccgtaccgggttaaccgaccggtaccggtaaccccggaaccggtcccgtaccccggtccccgttaccggtacctacccgtttcccggttccccgttccccccggtcccgttaccccggg

SEQ ID NO: 58647 - DNA, 781 bp, Homo sapiens
  misc_feature: GYAE6OF01C9R03.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcacgtggacgccagcagtgaattacaactatactctcctgtaaccaacaacaccagacaaacgccccaatcatgtattttagacgtactaagtaacggccggtacccgtcggtaacgggtccctagtacgtccgtcctttcctcgaacgggtccttaccgtaacgttccgtacgggacccaaaccgacccgggtcccctcccgtaccggtaccgttccgtccggtcgggtaccctaccgtaacggtaccgtagggaacggtaagtacggacgggttacttagttaacgtttaacgttaccgttacggttacccgttacgtttcccttaacgtacgtaaacctaacgtacgtacccgttaagtaacgttaacggttaaggttcggggttacgggtttaccggggaaccggggtaaccgggtaaccctaaaccgggttaccggtacccccggttaccgtacgtaccggtaacccgaccggtaccccggaaaccgggttccccgttacccgtcccccccggtacggttaccccgttacccgttccgttcccccgtttaaccccccg

SEQ ID NO: 58648 - DNA, 649 bp, Homo sapiens
  misc_feature: GYAE6OF01AHP0Z.8.42.D09.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatcctcctgcactgganccagcagtgattacaactatatctcctggtaccaacaacaccaggcaacgaccccaaactcatgtatttttgaggtacaagtaacgccggccctacgacgggtccctgatcgacttctcacggtctccaagtctaggacaacgaccggtcctccctcgacccgtcgtcgtcgggcctaccgacgtcgtagaggagtgacggtcttacgtatttaactttacgtcgtacagtcctacgtattacgttcgagggtacaaggaccgaaggtacggggttacgttcggggacgggtaacgggaaccgtaagggttccggacccggttaccgtaacgggtacctaacggaccccgaagggtccctacccggtccccccgttacggtacccgtaccttcccgtcccgttacccccgtaccccgttccccg

SEQ ID NO: 58649 - DNA, 658 bp, Homo sapiens
  misc_feature: GYAE6OF01CJXGA.8.42.D09.1.454.CMB.1.raw
  modified_base (296)..(296): a, c, t, g, unknown or other
  misc_feature (296)..(296): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatcctcctgcactggagccagcagtgattaacaactatactctcctacgtaccaacaaaccaccaggacaaacgccccaaactcatntattttgagtacaataacgcggccctacgacgggtccctgactcgtcttcgtctacggtcctaccaagttctcggacctaaacgacccggtccctcccgtcgtacccgtctccggtcgggccttccgagtactaggaacggtacgtaggacgggtcttaggtaactttaacgttactacgtacgtagtacctataacttacttacacgggactacggactaacggtaggggtaccgttaccggggacggtaacgggacctaaaggttcgaccgtacggttacggacggtaccgacccgtaacggtccgtacccgtcccccggtacgtaccctaccttccgtccgttcccccgtcccgtcccg

SEQ ID NO: 58650 - DNA, 543 bp, Homo sapiens
  misc_feature: GYAE6OF01DRVBZ.8.42.D09.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (519)..(519): a, c, t, g, unknown or other
  misc_feature (519)..(519): n is a, c, g, or t
  modified_base (532)..(532): a, c, t, g, unknown or other
  misc_feature (532)..(532): n is a, c, g, or t
tcagctcgcgtgtccacgaccggtgctcgatttagacacatacgcaggggaaaggggggggtctcaggaggcagtgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgganccagcagtgattacaactntatctcctgtaccaacaacacccaggacaaacgccccaaactcatgtattttgaggtcaataacgcgccctcgacgggtccctgactcgtcttctcgacggtcctccgaagtctggaccaaccgaccggtccctcccgtacgaccctactcctcgtcgggcctccgaggtctggacggacgaggctactatttattattgctagttcatatacgacagcagcactctgtcgtcgttggcggacggctagtcgaccgtctagcacgcccaggccncgtcccctcgtcnctctcgtcccc

SEQ ID NO: 58651 - DNA, 583 bp, Homo sapiens
  misc_feature: GYAE6OF01D8TCC.8.42.D09.1.454.CMB.1.raw
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtaccaacaacaccaggacaaacgaccccaaactcatgtattttgaggtacaataacgcggccctcgacgggtccctgatccgcttccncgacggcctaccaagtcgtaggaccaacnccggccctccgtcgtaccgtctcgtcgggcctccgagactaggaggatggaggtctgatttagtactgctagctactatacgttacaggacagacaagtggggtacgttccgggacggaaggacctaaggttcgacccgtccgtaggaccgacggcccaaggcctacccgtccccgtacggtcctacctccgttccgttccccctcccgtccccg

SEQ ID NO: 58652 - DNA, 574 bp, Homo sapiens
  misc_feature: GYAE6OF01D7HY8.8.42.D09.1.454.CMB.1.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (384)..(384): a, c, t, g, unknown or other
  misc_feature (384)..(384): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatcctcctgcactgganccagcagtnattacaactatatcctctggtaccaacaaaacccaggacaaacgaccccaaactcatcgatttttgaggtacaataaggccggccctcgacggggtccctgactcgcttctcaggctaccaagtctggacaacgaccggcctcccgngaccgtctcgtcggctccagactgaggatggagtctagtattacttactgctagctacattattcagcacgacaacgagggtagttcgggacgggaggactaagttcggaaccgtcgtacggcgacgccctaggctccggcccccgtggtccctacttccgttaccgttccccgtccctcccgtacccgg

SEQ ID NO: 58653 - DNA, 577 bp, Homo sapiens
  misc_feature: GYAE6OF01BUZMO.8.42.D09.1.454.CMB.1.raw
tcagctcgcgtgtccacgaccggtgctcgatttagacacatacgcagggaaaggggtctgggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaagtgggagggggcttgatccgaggccgggggggtccctggagactctcctgtgcagcctctggcttcaccatcagtagagactacatgagcgtcgggcccgccgaggcctccggaggggaaggggctgggagtcgggtctcgtagtttatttagtcgcgtagtgggtgcacacacgtacgcagactccggtgaacgggcagacttcaccgtctacgagacgacaattaccaaagactagtggtatattcttacaaatcgaacagtactaacgacgaccgaggaccacggccttatagttacgtggtagaccggtaagactagtacggtaaccgtacgggtacgaaccgggtccccggtgggggaacccg

SEQ ID NO: 58654 - DNA, 611 bp, Homo sapiens
  misc_feature: GYAE6OF01EG0G7.8.42.D09.1.454.CMB.1.raw
  modified_base (227)..(227): a, c, t, g, unknown or other
  misc_feature (227)..(227): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaatatatctctggtaccaacaacaccagcaaacgccccaaatcatgatttttgaggtcaataagcggccctcgagggtccctgactcgtcttctcgacggcttaccaaagttcgtacggacaaacccgtacggcccctcccgtacgacccgttctccgtgggcctccaagacctggaggactggaaggctagtatttattaacgtgcacgctacattatcgaggtcacgacaaacgtaggggttaacttcgggacgggaaggaacctaaggttcggacccggttaccgttaacgggtacaaccggtccccgaaagggcccttacccggtccccctaccgggtaccctaccttaccgtccgttaccccccc

SEQ ID NO: 58655 - DNA, 676 bp, Homo sapiens
  misc_feature: GYAE6OF01D1WQM.8.42.D09.1.454.CMB.1.raw
  modified_base (335)..(335): a, c, t, g, unknown or other
  misc_feature (335)..(335): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcaccatcctcctgcactggagccagcagtgattacaactatatctctggaccaacaacaccaggacaaacgcccaaatcatgtattttagaggtacaataaggcgcctcgacgggtcctgactcgcttcncacggctaccagtctacggaccaacgccggacctcccgtcgacccgtctcgtcgggctcccgagaccgtaggagtagtgaggcttaggaatttacgttacctgacctacgtacttacaagttactttacggaacggctaaacggactaaacgggtaggggtttacgttacgggggaccgggtaacgggtaaccgtaaacgggtttaccgaaccccgggtttcggtaaaccggtccggaaccggaacccggtaacgggttccccgttacccggacccccccggtttacggtaccgttacccgtttacccgttccccggttccccccgccccgtttaccccgg

SEQ ID NO: 58656 - DNA, 730 bp, Homo sapiens
  misc_feature: GYAE6OF01A1DZR.8.42.D09.1.454.CMB.1.raw
  modified_base (231)..(231): a, c, t, g, unknown or other
  misc_feature (231)..(231): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgcccctgactcagccctccctccgccgtccgggtctccgtggacagtcagtcaccatcctcctgcacgtggacnccagctaggtgacttaacaactatactctccgtacggtaacccaaacaaccaccgaggaaccaaaccgaccccaaactaccatgttagtttttaggacggtacaaacgtaacggaccggtcccgtacggtaaccgggtcctagacgtccgtaccttactaccgacggtcctaacctaacggtccgtacggacctaacgacccgtcccgttacccgtacggtacccgtcgtaccggtcgggacctacccgagtacgtacggaacggacgtagggaacggtcgttagttaaactttacgttacgtacgccgtagaccttacatttaacgtcgaacggtcaacgtaacgaacggtacgggtacgttacggggacggaacgggtacgtaacggtacgtaccggtacgtacgggtaccgaccgggtaccaacgggtcctacccccggaccccgttacggtaccctacccgttcccgttaccccgtcccccgtcccgttacccgg

SEQ ID NO: 58657 - DNA, 802 bp, Homo sapiens
  misc_feature: GYAE6OF01BGSEC.8.42.D09.1.454.CMB.1.raw
  modified_base (236)..(236): a, c, t, g, unknown or other
  misc_feature (236)..(236): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcgagggcacgagggtcctgggcccagtctgccctgactcacgccctccctccgcgtccgggtctccgtggacagtcagtccacctagtcctcctgacacgtggacnccagcagtgacttacaactatactcctccgtacgtaaccaaacaaccgaccgaaggaaccaaaccgacccctaaaactccaagttacgttacgttttagacggttactaaacgtaccgccgtaccgtacggtacgggtccctgacgtccgtctcgtacgacgtcctaacgtagtcgacggacaacgcccgtcctccgtcgtaccgtcgtcgcggtcctacacgtacgtgaacggtacgtcggacgttcgtaacgttaacgtttacgttaccgtcgtaccgtaggttacctaacgtaacgttacgttacggaaccggtacgtaaccgtaacgttaaccgggtacgggtttaaccggtaccgggaacgggttaaacggtaaccggttaaccggttaccggggttaaccccgtaccgggtttaaccggggaacccggttaaccggtaccccgggtaaacccgggtccccggttaccccgggttacccccgggttaaccggtttaccccggttaacccgtttaccccgggtttaccccgttaacccccggttcccccttaaaccccgggg

SEQ ID NO: 58658 - DNA, 559 bp, Homo sapiens
  misc_feature: GYAE6OF01EQDLA.8.42.D09.1.454.CMB.1.raw
  modified_base (208)..(208): a, c, t, g, unknown or other
  misc_feature (208)..(208): n is a, c, g, or t
  modified_base (406)..(406): a, c, t, g, unknown or other
  misc_feature (406)..(406): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntctcctgcactggagccagcagtgattacaactatatctcctggtaccaacaacacccaggacaaacgccccaaatcatgattttgaggtcaatagcgcctcagggtcctgatcgcttctcaggctccaagtctgcaacacggcctccgtgacccgtctctcgggctccagacgtgacggatgagtctgattattacngctagctcatacttcaggtcagacaacgagggtacgttcggacggtagggacctaacggttgaacccgttccggtaagtccgaacggacccgaaaggcctaccggtccccccgtacggtccaccgttccgtccgttcccccgcccttaccccg

SEQ ID NO: 58659 - DNA, 527 bp, Homo sapiens
  misc_feature: GYAE6OF01DXB2O.8.42.D09.1.454.CMB.1.raw
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
tcagctcgcgtgtccacgaccggtgctcgatttagacacatacgcagggaaaggggtctgggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaatgggagggggcttgatccgaggccggggggtcctgagactctcctgtgcagcctctggcttcaccatcagtagagactacatgagcgtcgggcccgccgaggcctccgaggggaaggggctgggagtgggtctcgtagtttatttagcgcgtagtggtgcacacacgtacgcagactcgtagaagggcagacttcaccgtctacagacacatccaagacagtaggtntatcttanaaatnaacagactacgagcgagacacggctatacttgtgtagcgagacagtcgtacgtacggtgacggtccgtggggacccgg

SEQ ID NO: 58660 - DNA, 725 bp, Homo sapiens
  misc_feature: GYAE6OF01DB1L9.8.42.D09.1.454.CMB.1.raw
  modified_base (210)..(210): a, c, t, g, unknown or other
  misc_feature (210)..(210): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcgagggcacgagggtcctcgggcccagtctcgccctgacctcacgccctcccgtccggccggtccgggtctccgtggacngtcagtccaccatcctcctgcacgtggacgccagcagtcgacttacaactatactctcctacgtaccaacaaccaccgagaccaaccgacccaatcatcttagtttgacgtacaagtacgcccggtacctcggtacgggtcctagtacgtccgtccttacgtccgacggtccttaaccgaacgttccgtggaccctaacggcccggtcctcccgtcggaccgtccgtacgtcgggacctaccgacgcgtaggaggacgtggacgtacgtagttaacttacgtacgcgtacgtacgtacgttattacgtacgttacggtaaccgacaacgtaacggtaacggtcgggttaaccggtcggggaacgggtaaccggtaacgtacgggttaaccgtacccggtaccggttaaccggaccggtcccggtaaacccggtacccggtccggtacccccggttacccgtacgggttacccctacccgtttcccgacccccgttttccccgacccgttacccgg

SEQ ID NO: 58661 - DNA, 709 bp, Homo sapiens
  misc_feature: GYAE6OF01CDQWE.8.42.D09.1.454.CMB.1.raw
  modified_base (216)..(216): a, c, t, g, unknown or other
  misc_feature (216)..(216): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacaggtcctgggcccagttctgccctgactcagcctcctccgcgtccggtctcctggacagtcagtcacgatctctgcncgtgacgccagtcagtgtacttacaactatactctcctgtaaccaacaacacccaggacaaacgccccaaactcagtgtattttgacgtactaacgtaacggccgccctagtaccgggtcctgacgttcgtcttcgtacgacggtcctaccgtaacgttcgtacggaccgaaacgtaccggtcccttcccgtacacccggttccttacggaccggtccttacccgaacgtaccgttaggacggttaagtacggacggtacgttaagttaacttttaaacgttaccgtacgtaacgtcgtaccttacgtaacgtttactaccggaagcgtaacgtacgtaaacggttagggttaccgttcgggaccgggaagaccgttaaacggttccgtaaccgtaccgttacggaccgtaaaccgtacccgaacggttcccgtaccccgttccccgttacgttacgtaccgttacccgtcccgttccccgccccgttaccgg

SEQ ID NO: 58662 - DNA, 729 bp, Homo sapiens
  misc_feature: GYAE6OF01AQ0ZB.8.42.D09.1.454.CMB.1.raw
  modified_base (225)..(225): a, c, t, g, unknown or other
  misc_feature (225)..(225): n is a, c, g, or t
  modified_base (330)..(330): a, c, t, g, unknown or other
  misc_feature (330)..(330): n is a, c, g, or t
tcagctcgcgtgtccacgaccggtgctcgatttagacacatacgcagggaaaggggggggtctcaggaggcagcgctctcaggacgtcaccaccatggcctggctctgctcctcctcaccctcctcactcagggcacagggtcctgggcccagtctgccctgactcagcctccctccgcgtccgggtctcctggacagtcagtccaccatcctcctgcactgganccagcagtgattaacaactatactctcctgtaaccaacaaccaccaggacaaacgacccccaaactcatgtattttgagtcaataacgcgcctcgacgggtcccngactcgcttctcgacggtcctaccgaagtcgtcggaccaacgaccggtccctccccgtacgtacccgttccgttccggtcgggtacccttacccgaagtaccgtaggaggtacgttcggaaggtccttaaggtaactttaacgttaccgtagggtcctaaggtcccttacgtaactttccgttaaccgacgggtaccgaaggtaaccgtaacggtaacggggtttacgttaccgggggacgggtaaccggggtaccgttaaacgggttccgtaacccggttaccgtacggggtaccctaccgggtaaccccggtaacggtccccgtacccggtccccccgttacggttacccgtacccggtttaccttaccccgggttcccccccacccggttaccccg

SEQ ID NO: 58663 - DNA, 621 bp, Homo sapiens
  misc_feature: GYAE6OF01EKFJF.8.42.D09.1.454.CMB.1.raw
  modified_base (177)..(177): a, c, t, g, unknown or other
  misc_feature (177)..(177): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacatggtcctgggcccagtctgccctgactcagccctcccnccgcgtccgggtctcctggacagtcagtcaccatctcctgcactggacgccagccagtgattaacaactatatctcctaggtaccaacaaccaccaggacaaacgcccccaaatcatgtattttgaggtacaatagccgcctcgtacgggtcccngatccgtcttcncgagctacgaacgtctggacaacgaccggtcctccgtcgacccgtctacgtcgggctacgacgtacgtacggaggatgggacgtcgtagtaatttactactgacagcttacatttacacgtagacagaacgtaacggtagggttacgttccggggaacggtacggtaaccgtaaggttccgacccggttaccgtacgggtaccacgggaccccgtaagggtcccacccggttccccgtacggttacccacccgttccttcccgttccccgtaccccg

SEQ ID NO: 58664 - DNA, 679 bp, Homo sapiens
  misc_feature: GYAE6OF01D7FBI.8.42.D09.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactgganccagcagtgattaacaactatactctcctacgtaaccaacaaccaccaggacaaaccgaccccaaactcatgtattttagagtacaagtaacgccggccctcgacgggtccctagtactcgtcttcacacgcctacagtcgtaggaccaacgaccggccctccgtcgtaccgtctacgtcgggtcctaccgacgtaccgtaggacggtacgtaggacggtacgttagtaagtttaacgttacgtcgactacgtcctactaacgttacttacgaacgacgaaggaaccgtaacgggtacggggttacgttccgggaacgggtaacgggtaaccgtaacggttaccggacccgttaccggtaccggtaccgaaccggtacccgaacggtcccgttaccccgcccccgttacggttaccctaccgttaccgttcccggtcccccgtccccgttacccg

SEQ ID NO: 58665 - DNA, 770 bp, Homo sapiens
  misc_feature: GYAE6OF01D42HZ.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtaccaacaaccacccaggacaaacgccccaaactcatgtattttagacggtacaataacgccggccctcgacggggtccctgactccgtcttctcacggcctacgaagttctacggaccaacgaccggtaccctcccctggaccccgttctcggtacgggtccctaccgacgtaacgtggaacggacgtggtacgggtcttaggaattttaacgttacgtacggtcctaacggtccttacgaacgttttaacgtttaccgacgggtacaacgggtaaccgtaaacggggtacggggttttaaccgttaccggggggtaccgggtaaacggggtaacccggttaaagggtttcccgggtaaaccccgtttcccgggtaacgggtacccggtaaacccgggacccccgttaaaccggggtccccgtttacccccgggacccccccggttttaccgggtaccccctaacggttttcccccgtttacccgggtttccccccccgtcccccgtttacccccggg

SEQ ID NO: 58666 - DNA, 715 bp, Homo sapiens
  misc_feature: GYAE6OF01EXJ7M.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctcgccctgactcagcctccctccgcgtccgggtctcctggacagtcagtccaccatcctcctgcactggacgccagcagtgattacaactatatctctggtaccaacaaccaccagaccaacgaccccaaactcatgtattttaggagtactaataacgccggccctcgacgggtccctagacgtccgtcttcgtaccgacgtcctaccgtaagttccgtacggtaccaacgaccggtccccttaccccgtacgtaccccgttccgttccggttcgggtacccttacccgaagtaccgtacgggtaacggtagtacggtacgggtcttaaggtaactttagttaaccgtggctacgtcctacgttatacgttacgaggtacgacgtaacgtaacggtaacgggttacgttaccggggacgggtaacgggtaaccgtaacggttacgtacccggtacgtaccggtaccgtccggacccgtaacgggcccttacccccggtaccccgttaccgggtaccttacccgttcccgttacccggtcccccgtccccgttacccgg

SEQ ID NO: 58667 - DNA, 878 bp, Homo sapiens
  misc_feature: GYAE6OF01BPF65.8.42.D09.1.454.CMB.1.raw
tcagctcgcgtgtccacgaccggtgctcgatttagacacatacgcagggaaaggggggggtctcaggaggcagcgctctcaggacgtcaccaccatggcccgtggctctgcctccctcctccaccctcctacacctcggacgggccaacggtacgggttccgtccgggaccctagttccgtccgtccctagtaactcgacgtccctacaccgtccggccgggttcccgggttcctccgtacggactcgtactacgtaccaacctacgttcctccgtcgtacctacggtgggaccaccgagacgtaggtacgtaacttaaacctaaactagttacttacctccggttaaccgtaaacccaaaccaacccgaaccggaacggaacccaaaaccccgaaccccctaaatccgtaaagttacgttttaacggttttaacgggaacggttactaaaacggttaaccgggccccggttcccgttaacggggtaacccgggtttcctaggtacgttccgttacctttcgaccggacgtacctaccgtaagtcgacgaacctaaccgtcccggtcctcgacgtccgtctacggtcggacccacgtacgtacggtgggaacgtagtaccggtacggtcttaacggttaactttaacttccgtacgtaccgtaccgttacttacttacgttaaccgttacgacggtacctaaccgggtaacgaacggggttacggggttaccggtccgggggaaacgggtaccggtaaacgttacggttaccggtacccgtacgggtacgtaccggaccggttaaccggaccggtcccggtaccccgtaccccggttgtaccctaaccgttcccggttaaccccgtcccctaccccgg

SEQ ID NO: 58668 - DNA, 752 bp, Homo sapiens
  misc_feature: GYAE6OF01BQJV6.8.42.D09.1.454.CMB.1.raw
  modified_base (234)..(234): a, c, t, g, unknown or other
  misc_feature (234)..(234): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagccctcctccgcgtccgggtctccgtggacagtcagtccacctatcctctgcctactgggacnccagtcagtgacttacaacttatatctctagtaccaacacaccagacaacgccccaaatcatgtattttgaacgtcaatacgccgtcctacgagggtcctgactcgcttccacgacgtcctacgtaacgttcgtacggacctaaaccgaccggtcccttaccccgtcggaaccccgttcgtccggtacgggtcctaccgaacgtacgttacgggaacggtaccgttagggacgtcgttagtaacgttttactaacggtcgtacgaccgttacctacgtaacttagttaccggacggtaacgtaaccgtaccgtaaacggttaacgggttacggtttacccggggaaggggtaaccgggtaaaaccctagggtttacccgggaaacccgtttacccggggttaacggttaccggaaacccggtaacccgggaccgggttaaccccggttccccggttacccccgggttaccggttaccccgttaaaccgtttcccggttaccccggtttaacccccccg

SEQ ID NO: 58669 - DNA, 535 bp, Homo sapiens
  misc_feature: GYAE6OF01B82DQ.8.42.D09.1.454.CMB.1.raw
  modified_base (187)..(187): a, c, t, g, unknown or other
  misc_feature (187)..(187): n is a, c, g, or t
  modified_base (221)..(221): a, c, t, g, unknown or other
  misc_feature (221)..(221): n is a, c, g, or t
  modified_base (406)..(406): a, c, t, g, unknown or other
  misc_feature (406)..(406): n is a, c, g, or t
  modified_base (525)..(525): a, c, t, g, unknown or other
  misc_feature (525)..(525): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctctcactcagggcacaggtcctgggcccagtctgccctgactcagcctccctccgcgtccgggtntcctggacagtcagtcacatctcctgcactgganccagcagtgattacaactatatctcctggtaccaacaacaccagcaaagccccaaactcatgatttttgaggtacataagcgcctcagggtccctgatcgctctcaggctcaagtctggcaacgacggcctcccgtgaccgtctcgtcgggctaccgagactgacggatgaggctgattattacngcagctcgtatattcgagcacgacaacgagggtattcggacgggagggacaaggttagtaccgccgttaggctagacccgaaggcctcgcccccttaggtccaactccgtcgttccccncccgtacccg

SEQ ID NO: 58670 - DNA, 657 bp, Homo sapiens
  misc_feature: GYAE6OF01EDP73.8.42.D09.1.454.CMB.1.raw
  modified_base (200)..(200): a, c, t, g, unknown or other
  misc_feature (200)..(200): n is a, c, g, or t
  modified_base (437)..(437): a, c, t, g, unknown or other
  misc_feature (437)..(437): n is a, c, g, or t
  modified_base (466)..(466): a, c, t, g, unknown or other
  misc_feature (466)..(466): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcacatctcctgacacgtggacgccagcagtgaattacaacttatatcctcctggtaccaacaaccacccaggacaaacgaccccaaactcatagtactttttgaggtacaagtaacgccggccctacgacggggtccctgacttcgtccttcgtacacggtacctaccgaagtcgtacgacaacgaccgccctcccgtgtacccgtctcgtcgggctaccgagactggagntgaggtcttagatttaacgtacgcgtacngtacgtacagttacttacgaggtacagaccgaacgtaggggttacgtacgggacgggaacgggtaaccagggttaccggaccggttaccgtaggtacccgtaacggtaccccgaagggtcccgttcccggtaccccggttaccggtcctacccgttcccggttcccggtttacccccgtccccgttacccg

SEQ ID NO: 58671 - DNA, 634 bp, Homo sapiens
  misc_feature: GYAE6OF01DDXMO.8.42.D09.1.454.CMB.1.raw
  modified_base (245)..(245): a, c, t, g, unknown or other
  misc_feature (245)..(245): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcaccatctcctgcacgtggagccagcagtgattacaactntatctcctggtaccaacaacacccaggacaaacgaccccaaactcatgtatttttggagtacaagtaacgccggccctcgacgggtccctagactcgcttctcgacggctccaagtctcggaccaacgaccggtccctccctacggacccttcgtcggtcggcctaccgagaccgtggacggagtggaggtcttgtaatttatactgcagtcctactattacgttcgacggtcaagacctaacggtagggttacgttcgggacggtacgggtactaaggttccgaaccggttccgtaacggtccgaacgggtacccaacgggtccctaccggtccccccgttacgggtaccctaccgttccgttccccgttccccgtccccttacccgg

SEQ ID NO: 58672 - DNA, 760 bp, Homo sapiens
  misc_feature: GYAE6OF01EKR1B.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtcaccatcctcctgccacgtgggacgccagcagtgaattacaacttatactcctcctggtaaccaacaacacccgaggaccaaacgacccccaaactcactagttattttcgaggtacaagtaacggccggtccctcggacggggtccctgactcgcttcgtcgacggtctaccgagtccgtacggaccaaaccgtccggcctcccgtacgtacccgtcgtcgtcgggtcctaccgaagtaccgtagggacggtacttgggacggttctaggtaacttttacgtacgtggacgtaacgtccgttacgtaacgttacgttacccgggaagtaccgtaacggtaaccgtaaacgggtacggggggtttaacgttaacccgggggacggggtaaaccggggttaaccgtaaacgggttcccggtaaaccccggtttccggttaaccggtccggaaccgtacccggggaaacggttcccgtaccccggtaccccccggtccgggttacccttaaccccggttcccgtttaccccgtttccccccgaccccgtttaccccgg

SEQ ID NO: 58673 - DNA, 624 bp, Homo sapiens
  misc_feature: GYAE6OF01CWRLR.8.42.D09.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (291)..(291): a, c, t, g, unknown or other
  misc_feature (291)..(291): n is a, c, g, or t
  modified_base (345)..(345): a, c, t, g, unknown or other
  misc_feature (345)..(345): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctctcactcagggcacagggtcctgggcccagtctgccctgactcagcctccctccgcgtccgggtctccgtggacagtcagtcacntctctgcactggacnccagcagtgattaacaacttatactcttctacgtaaccaacaacaccaggacaacgaccccaatcatntatttgagtacaataagccgcctacgacgggtccctagtactcgtcttcgtacncggcctacgaagtccgtacggacaacgtaccgcccttccgtcgaccgttcgtcggtacgggtcctaccgagtaccgttgaacggtgtcggaggccgttagttaattacgttactggtacagtacctgtacttacgttcgaaggtcaaggacaaggtacggttagccgggacgaacggactaggtacgtacccgtcgttaccgacgaccgacccgaaggtccctaccgtcccccgttacggtaccttacccttcgttcccgtaccccgtcccttaccccg

SEQ ID NO: 58674 - DNA, 697 bp, Homo sapiens
  misc_feature: GYAE6OF01BFLWM.8.42.D09.1.454.CMB.1.raw
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggagccagcagtgattacaactatatctccgtggtaccagccaacaccagacaaaccgaccccaaatcattgtagttttggacgtacaagtaacggccggtacccgtcggtacgggtccctaggactcgtaccttctacgacggtcctacgtagtcgtacggaccaaccggtaccggtccctcccgtcgtacccgttcgtcggtcggcctacgagtacgtaggagtacgtggacggtacttagttaatttacgtacgtacggctacgtaccttactaagtttacctaccggaggacctacgaacggtaaaccggtaggggttacggttccgggtaacggggacggtaaccgttaacggttccgggtaaacccgttaccggtacggtaaccggaccgacccgggtaacggtcccgttaccccgcccccggttaggtaccctacccgtttcccgttcccggttcccccgtcccccgg

SEQ ID NO: 58675 - DNA, 579 bp, Homo sapiens
  misc_feature: GYAE6OF01B84A5.8.42.D09.1.454.CMB.1.raw
  modified_base (225)..(225): a, c, t, g, unknown or other
  misc_feature (225)..(225): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgganccagcagtgattacaactatatctcctggtaccaacaacacccaggacaaacgcccccaaactcatgattttgaggtcaataagccggccctcgagggtccctgactcgcttctcaggctcaagtctggcaacgacgcctccctgaccgtctcgtcgggcctccagtactgaggagtggacggtcgtagtattattacgtgctagctctaattcttacaggcagacaacgtagggtacgttcgggacgggaacgggtacctaggttccgaccgttcgtacggtaccgacgcccgaacggtcctaccgtcccccgtacggtcctaccgtccttccgttcccctcccgttaccccg

SEQ ID NO: 58676 - DNA, 707 bp, Homo sapiens
  misc_feature: GYAE6OF01A3JJJ.8.42.D09.1.454.CMB.1.raw
  modified_base (329)..(329): a, c, t, g, unknown or other
  misc_feature (329)..(329): n is a, c, g, or t
  modified_base (435)..(435): a, c, t, g, unknown or other
  misc_feature (435)..(435): n is a, c, g, or t
  modified_base (467)..(467): a, c, t, g, unknown or other
  misc_feature (467)..(467): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctggcccagtctgccctgactcagcctccctccgcgtccgggtctcctggacagtcagtccaccatcctcctgccacgtggacgccagcagtgattacaactatactctcctggtaaccaacaaccaccagacaaccgaccccaatcatgtattttagagtacaatacgcgcctcgacgggtccngactcgtcttcgtcgacggtcctacgaagtcgtacggacctaaccgacccggtaccctccgtacgtacccgttcgtccgtcggcctacgacgtacgtggaacggtntacgggacgtacgttagtaactttacgttacncgtacgtcgtcctataacgttctacggaacggacaaacgtaaccgtaacgggtacgggtttacgtacccgggggaacggaacgggtaacccttaacgggtaccggttaacccgttacccggtaacgggtaccggtaacccggtacccgggaccgttcccgttaccccgggtaccccccgttacgggtacccctacccgtttacccggttcccccggttacccccgtcccgttaaccccgg

SEQ ID NO: 58677 - DNA, 657 bp, Homo sapiens
  misc_feature: GYAE6OF01BLXYX.8.42.D09.1.454.CMB.1.raw
  modified_base (226)..(226): a, c, t, g, unknown or other
  misc_feature (226)..(226): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggacnccagcagtgattacaactatatctcctgtaccaacaaccaccaggaccaaacgcccccaaactcatgtatttttgaggtacaagtaacgccggtccctcgacgggtccctgactcgtcttctcgacgcctacgaagtcgtggaccaacgaccggcctccgtcgacccgtctcgtcgggctccgagacgtggaggagtcggaggtcttagtaactttacgttacgtagactagtccttactaattacgtttacgacggacgaacgaaccgtaacggtacgggttacgttaccggggacgggtaacggtaaccgtaacggttaccggtacccgttaccgtacgggtaccgaccggtacccgaacgggtccgtaccccggacccccgttacggtcctaccgttaccgttcccgttaccccgtcccgttaccccg

SEQ ID NO: 58678 - DNA, 757 bp, Homo sapiens
  misc_feature: GYAE6OF01DZYZ8.8.42.D09.1.454.CMB.1.raw
  modified_base (243)..(243): a, c, t, g, unknown or other
  misc_feature (243)..(243): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagcctccctcgcgtccgggtctcctggacagtcagtcacatctcctgcactggacgccagcagtgattacaactntatctctgtaccaacaacaccgagacaacgaccccaactcatgtattttgagtacaagtagccggccctcgtacgggtccctgtactcgtacttccgtacacggtacctaccgaacgtccgtacgggaccaaaccgtacccggtccctcccgtacgaccccggttctccggtcgggcctaccgtacgaccgttaggacggtagtacggaacggtcgttaggtaactttaagttaccgtcgtacgtacgtccgtacttaacttacgtttaccgaacgggtaccgaacggtaaccgtaaacggtaaccgggggttacgtttacccgggggaccgggtaaccggggtaacccgttaacgggtttaacccgggaacccggtttaccgggtaaccgggttacccggaaccggtaccccggtaaaccgggtccccggtaccccggttacccccccggtaccggttacccgtaacccgtttcccgtttaccccgttaccccccgttcccccgtacccccgg

SEQ ID NO: 58679 - DNA, 608 bp, Homo sapiens
  misc_feature: GYAE6OF01CSYC4.8.42.D09.1.454.CMB.1.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagccctccctcgcgtccggtctcgtggacagtcagtccaccatcctcctgcacgtggacnccagcagtnattacactntatctctgtacaacacaccagacaaacgcccaactcatatattttgacgtacaactagccgcctcgacgggtccctagactcgtcttctcgagcctacgagtctcgacaaccgaccggtccctccgtacgtaccgttccgtcgtcgggtcctccgagaccgttagacggtagtacggaggtctagttactttaagttacgtgacgtacgtctactatacgttcgaggctaacgacgtaacggagggttagtcgggacggtaacggacgtaacggttccgtaccggtacgtacggtacgaccgtacgacgtccgtcccgtccccgtacggtacctacgtccgttacccttcccgtccctaccg

SEQ ID NO: 58680 - DNA, 743 bp, Homo sapiens
  misc_feature: GYAE6OF01AR9KZ.8.42.D09.1.454.CMB.1.raw
tcagctcgcgtgtccacgaccggtgctcgatttagacacatacgcagggaaaggggtctgggagaggagcccagcactgggattccgaggtgtgtccattcggtgatcagcactgaacacagaggactcaccatggagttctggctgggctgggttttccttgttgcaatttcaaaaggtgtccagtgtgaggtgcagctggtggagaagtgggagggggcttgatccgaggccggggggtcctggagactcgtcctgtgcacgcctcgtggcttcaccatcagtagacgactacatggacgcgtcgggccccgcgacggccgtaccgaaggggaggggctggggtagtcgggttctcgtagtttattacgtcggacgtagttgggtacggccaacgactaaccgtaccgtacgacggtaccttccgggtaggggaacgggacctaaggttacttacccgacccggttcgtaccgaacggaactaaccgtaacttaacccgaaagtaaccctaaggtttcgggttagttaaccttaccgtttaacgaaaagtttaccggaaaacctaacgggtaacccctaaaacggaccggtaaccccgggtaaggaacccggaacccgggttaccgttaaaagtttaccggttaaaccgttcgggtaacggaccggtaacgaacgttacggttacgtaaaccggttacgggtacgggacccggttcccccggtaaggggggtaacccccgg

SEQ ID NO: 58681 - DNA, 672 bp, Homo sapiens
  misc_feature: GYAE6OF01CI2RW.8.42.D09.1.454.CMB.1.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (488)..(488): a, c, t, g, unknown or other
  misc_feature (488)..(488): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcgagggcacgagggtcctgggcccagtctcgccctgactcacgccctccctccgcgtccgggtctccgtggacagtcagtccaccntcctcctgcacgtggacnccagcagtgtaattacaactatactctcctaggtaaccaaacaccaaccaggacaaacgaccccaatcatgtattttgagtacaataacgccgcctacggacgggtcctgactcgtcttcgtcgaggtcctacaagtcgtcggaccaacgaccggcccttccgcgtacccgtcgtcgtcgggtacctaccgacgtacttaggacggtaacgttcggacggtacgttacggtaattttaacgtactcgggtacncgtacttactaagtacttacgaaggtcaacgtacgaacgttacggggtacgttcgggaacgggtacggtaccgtaacggttcgtaaccggtcgtacggtacgaaccgacccggtaaggccccgttacccgtccccgttacggacccttacgtacccgtttccgtacccccgacccgttacccgg

SEQ ID NO: 58682 - DNA, 761 bp, Homo sapiens
  misc_feature: GYAE6OF01CDC48.8.42.D09.1.454.CMB.1.raw
  modified_base (121)..(121): a, c, t, g, unknown or other
  misc_feature (121)..(121): n is a, c, g, or t
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
tcagctcgcgtgtccacgaccggtgctcgatttagacacatacgcaggggaaaggggggggtctcaggaggcagcgctctcaggacgtcaccaccatggcctgggctctgcctcctcctcnccctcctcactcgagggcacgtacgggtccgtcgggcccagtctcgccctagacctcacgccctcccgtccggtccggtcccgggtcctccgtggactgtcagtccacntcctccagccacgtggacgccngtacagtatacttacgaatacttactctccgtacgtaacccaaacaaccaacccgtaaggaacccaaaccgtaccccctaaaatcctaagttacggttaactttttacggaacgttacaaacggttaacgccggtacccgtacggtacgggttcccagtacgtccgtcttaccgtacgacggtcctacgtacggtctacggactaaccggtcgtacccgtccgcgtaccgtcgtccggtacgggtcctaccgacgaccgttaggacggtactcgggaaggtccttaagttattaaccttgacccgagtaacctcttaaccgtaggtttactaccggtaagactaaacggttaacaacggggttacggttaccgggacggaacgggggttaaccgacggttacgtttaccgggaacccgtcgggtactacccggaacgggaccgtaccggtcccgttaccccgtcccggttacgtacccgtcgtccgttaccccgggccttacccgaccg

SEQ ID NO: 58683 - DNA, 651 bp, Homo sapiens
  misc_feature: GYAE6OF01C843D.8.42.D09.1.454.CMB.1.raw
  modified_base (243)..(243): a, c, t, g, unknown or other
  misc_feature (243)..(243): n is a, c, g, or t
  modified_base (431)..(431): a, c, t, g, unknown or other
  misc_feature (431)..(431): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctcaccctcctcactcagggcacgagggtcctgggcccagtctcgccctgactcacgccctccctccgcgtccgggtctccgtggacagtcagtccaccatcctcctgcacgtggacgccagcagtnatacactatatctcctgtaccaacaacaccagacaaccgacccaactcatgtattttagagtacaagtacgccgcctacggacggtcctagtactcgtctctcgacgtctacagtcgtacgacaaccgtccggccctccgtacgtacccgttacgtcggtcggtactaccgagtacgacggagtacgnggtacgtcgtagtatttaacgtcgacgtacgtacgtctactatactacgacggacaacgacgacggtaggtacggtacgggacggtaacggtacgtacggttacgtaccggttaccgtaaggtaccgtaccgggtaccgaccggtcccgtacccccggtccccgggttacgtaccgttacccgttacccgttcccgtttcccccgtaacccgttccccgg

SEQ ID NO: 58684 - DNA, 722 bp, Homo sapiens
  misc_feature: GYAE6OF01DVFH2.8.42.D09.1.454.CMB.1.raw
  modified_base (221)..(221): a, c, t, g, unknown or other
  misc_feature (221)..(221): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcgagggcacgagggtcctcgggcccagtctcgccctgactcacgccctcccgtccggcggtccgggtctccgtggacagtcagtccaccntcctctgcacgtggacgccagctagtgaacttacaacttatactcctaccgtacggtaaccaaacaaccaccgacggaaccaaaccgaccccaaatcagttagttacgttttagacggtaactaagtaaccgcccggtacccgtacggtaccgggtccctagtacgtccggtctttaccgacgtacggtacctaccgtaacggttccgtaacggaccgaaaccggtcccggtccctaccgtacgtaccgtcgtacggtcggtacctacgacgtacgtggagtacgtcggacgttcgtaagttactttacgtacgtcgacgtcgtactacgttactacgtacgagacgtacgaacgtacggtacgggtacggtcgggacggtaacgtacgtaacgggttcgacccgttacgtacggtaccgccggaaccgtacggtcccgtacccggtcccgtaccggttacctacccgttacccggttcccttccccggtcccgtacccgg

SEQ ID NO: 58685 - DNA, 581 bp, Homo sapiens
  misc_feature: GYAE6OF01BHJWY.8.42.D09.1.454.CMB.1.raw
  modified_base (224)..(224): a, c, t, g, unknown or other
  misc_feature (224)..(224): n is a, c, g, or t
  modified_base (571)..(571): a, c, t, g, unknown or other
  misc_feature (571)..(571): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctgtaccaacaacaccaggacaaacgccccaaactcatgtattttgaggtcaataacgccggccctcgacggggtccctgactcgcttctcacggcctacaagtctcggaccaacgaccggccctcccgtcgacccgtctcgtcgggcctccgagtactgaggtatggacggtctagtacttagttactgcagtctctagtacttacgaggcaacgacaacgtagggttacgtcgggacggtagggacctaaggttcgaccgtccgtaggtcacggacccgaaggcccgtccgccccgtcggtccacgtcctccgttccccncccgtacccg

SEQ ID NO: 58686 - DNA, 699 bp, Homo sapiens
  misc_feature: GYAE6OF01BFTJY.8.42.D09.1.454.CMB.1.raw
  modified_base (226)..(226): a, c, t, g, unknown or other
  misc_feature (226)..(226): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtcccgggtctcctggacagtcagtcaccatctcctgcactgganccagcagtgattacaactatatcctcctgtaccaaacaaccaccgacggacaaacgaccccaaactcatgtatttttagagtacaaagtaacgccggacctcgacgggtccctagacgtccggctttctcgacggtacctaccgtaacgtcgtagggaccaaccgacccggtccctacccgtacggtaccccgtccttcggtacgggtccctacccgtaggtacctagggaacggtatgggaacggtcgttaaggtaacttaagtttaccgtagtccgtactacttacgtacttaacttcgaacggacaacgaaccgtaacggaggttacggttcgggacgggtaaccgggaacgtaacggttacgtaccggttccgtaaaggtcccgaaccggtacccgaaggtccctcccggtccccccgttacggtccctacccgttacccgttcccgttacccccctccgttaccccgg

SEQ ID NO: 58687 - DNA, 708 bp, Homo sapiens
  misc_feature: GYAE6OF01A144E.8.42.D09.1.454.CMB.1.raw
  modified_base (249)..(249): a, c, t, g, unknown or other
  misc_feature (249)..(249): n is a, c, g, or t
  modified_base (342)..(342): a, c, t, g, unknown or other
  misc_feature (342)..(342): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacgagggtcctgggcccagtctcgccctgactcagcctccctccggcgtccgggtctcctggacagtcagtcaccatcctcctgcagtggagccagcagtgacttacaactntactctcctcgtaaccaacaacaccagacaaacgacccaactcatgtatttgagtcaactacgccgcctcgacgggtcctagactcgtcttcncgacgtctacagtctagacacgacgtcctccgtacgtaccgtctacgtcgggtacctaccggtacgacgtacggaacggtacgtacgggtacggtacgttacggtaactttaacgttacgacgtaccgtcgtacctttacgacgtttaacgtacgaacgtaccgaacggtaacgtaacgggtacgggttacgggtaccggggtaacggtaacgggtaccgttaacggttaccggtacccggttaccgtaacgggtacccgtaacgggtaccccgtaacgggtccccgttacccggtcccccggttacggtacccgttacccggtttacccgtccccgggttaacccccgtccccggttaaccccgg

SEQ ID NO: 58688 - DNA, 594 bp, Homo sapiens
  misc_feature: GYAE6OF01DXW8U.8.42.D09.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (425)..(425): a, c, t, g, unknown or other
  misc_feature (425)..(425): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcgagggcacagggtcctgggcccagtctgccctgactcagccctccctcgcgtccggtctcgtgacngtcagtcacatctcctgcactggacnccagcagtnattacaatntatctctagtaccaacaacaccagacaacgacccaacncatgtatttgagtacaatagccgtcctcgtacgggtcctagactcgtcttcncgacgcctacgtagtcgtacgacaaccgaccgtcctccgtacgtacccgtcgtcggtcggcctaccgagtacgtaggacggacgtagacggtntagtaatttactacgtacgcgtacgtctagacttacgtcgagtacgacgtaacgacggtagggtacggtacggacgggtacggacgtagtccgtaccggtcgtacggtacacggaccgtacggccgtacccgtcccgtcgtcctactaccgtccgtcccctccgtaccg

SEQ ID NO: 58689 - DNA, 653 bp, Homo sapiens
  misc_feature: GYAE6OF01EIKYY.8.42.D09.1.454.CMB.1.raw
  modified_base (354)..(354): a, c, t, g, unknown or other
  misc_feature (354)..(354): n is a, c, g, or t
tcagctcgcgtgtccacgaccggtgctcgatttagacacatacgcagggaaagggggggagaggagcccagcactgggattccgaggtgtgtccattcggtgatcagcactgaacacagaggactcaccatggagttctggctgggcttgggtttttccttgttgctaatttacaaaaggtgtccagtgtgaggtgcagcgtggtggagaagtgggaggggtcttgagtccgacggggccggggggtccctgacgtacctcgtccgtgtgcacgcctcgtcggcttccaccatcagtagagactacatgagcgtcgggcccgcgacggcctaccggaggggacgggcgtagggnggttcggtctagtagtttattacgcgcgtagtggtggacacacacgtacgcacgtcgtcggtagaacgggcaagtacttcccgaaccgtctaccgaagacgtaacctaacgttaaccaaagtacgtgttggttacttacttacttaacaaagtcgaaactaagaaccgtaacgacggacccgaaggacctaccgggtacttaatacgttaccgtaggtacggacgtaagactacgtacggtaaccgttacggggtcgtaacccggacccgggtacggggaccgaaccggggtaaccccg

SEQ ID NO: 58690 - DNA, 685 bp, Homo sapiens
  misc_feature: GYAE6OF01DAA0G.8.42.D09.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
  modified_base (475)..(475): a, c, t, g, unknown or other
  misc_feature (475)..(475): n is a, c, g, or t
tcagctcgcgtgtccacgaccggtgctcgatttagacacatacgcagggaaaggggggggtctcaggaggcagcgctctcaggacgtcaccaccatggcctggctctgctcctcctcaccctcctcactcaggcacgagggtcctgggccctagtctgccctgactcagccctccctcgcgtccgggtctcctggacagtcagtcaccntctcngcactggacnccagcagtgaacttacaatntactctcctacgtaacaaccaacaccaggaccaaacgaccccaaanccatcgttattttaggagtacaataacgccgaccctggtacgggtcctgactcgtcttcgtcacggtctacaagttcgacggactaaccgccgtccctccgtacgtaccgtccgtacgtcgggaccctcgacgtacgtggaacggtacgttaggacggtacttagtaacttttaactttaccggngtaccgtacgtacctactaagtttccgttacgacggtactacggaacgtaaccggtaagggttcgtaccgggagggtaaccgggtaccttaagggtacccgtaccggttaccgtaggaacccgtacggacccggaacgttccgtaccccgtaccccgttacggtacccgttaccgttcccgttccccgttaccccgtaacccttccccgg

SEQ ID NO: 58691 - DNA, 652 bp, Homo sapiens
  misc_feature: GYAE6OF01E2NVC.8.42.D09.1.454.CMB.1.raw
  modified_base (225)..(225): a, c, t, g, unknown or other
  misc_feature (225)..(225): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacnccagcagtgattacaacttatatctctgtaccaacaaccaccaggcaaacgccccaaactcactgtattttgagtacaatagcgcctcgacgggtcctgactcgtcttctcacggctacgaacgtctaggacaacaccggtccctccgtcgtaccgtacgtcgtcgggtcctccgacgtactacggtaggtacgtggacggtctagtaacgtttacgttaacgtcgacgtacgtccttacgtaacttacgttaccgacgggtacaacggtacgaacggtacgggttacgttaccggggacggtaacgggaccgtaaggttcggtacccgttacggtacggtacgaccggtacccgaacggtcccgttaccggcccccgttccgggtacctaccgttcccgttccgttaccccctccccgttacccgg

SEQ ID NO: 58692 - DNA, 805 bp, Homo sapiens
  misc_feature: GYAE6OF01A4V64.8.42.D09.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgcccctgacctcacgccctccctccgcggtccgggtctccnggacngtcagtcaccntcctcctgcacgtggacnccagcagtgacttaacaactatatcctccgtacgtaaccaacaaccacccgaggtaccaaaccgacccccaaactcacttagttacgtttttggaacggtactaaagtaacggcccggtaccctcggaccggggttccctagtacgtccgtccttcctaccgacggtcctaccgtaacggtccgtacggacccaaccgtacccggtccctcccgtaccggtacccgttccgttccggtaccgggtaccctacccgacggtaaccgtagggacgggtacgtaggaacgggtacgttacgttaattttaacgttccgtacggtaccgtagtcccgtttaacgaactttacgttacgacgggtactaaccggaaccgtaacgggtacggggttaaccgggttacggggaacgggtaccgggtaaccgttaaacgggttccggtaaccgggtacccgttaacgggtacccgtaaccggtaacccgtaaccgggtccccgtccccggtacccccgttcccgggttaccctacccggtttcccgttacccccggttcccccgttaaccccgtccccgg

SEQ ID NO: 58693 - DNA, 661 bp, Homo sapiens
  misc_feature: GYAE6OF01DHK4H.8.42.D09.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (338)..(338): a, c, t, g, unknown or other
  misc_feature (338)..(338): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacgagggtcctgggcccagtctgccctgactcagcctcctccgcgtccgggtctccgtggacngtcagtccaccatcctcctgccacgtggacnccagcagtnacttacatatctctctgtaccacacaccagaccaacgccccaatcatgtattttgagtacaagtaacgccgtacctcgacgggtcctgactcgtcttcncgagtctaccgagtcgtagacaacgcggtccctccgtacgtaccgtcgtcggtcggtacctcgagtacgtggacggtagttcggacggtccttaggtaacttagttacgcgtactacgtctacgtatttacgtacgacgtacgaacgacgtaaggtacgggttacgttcggggaccggtaacgggtacctaacggttaccggtacccggttacggtaaccggttccggaaccggtacccggtacgggtcccgtaccccggtcccccggttacgtaccccgttacgttcccgtttccccggttcccccgtcccgttaccccggg

SEQ ID NO: 58694 - DNA, 880 bp, Homo sapiens
  misc_feature: GYAE6OF01CM0G0.8.42.D09.1.454.CMB.1.raw
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcgagggcacgagggtcctgggcccagtctcgccctgactcacgccctccctccgcgtccggtctccgtggacagtcagtccaccatccncctgctacgtggacgccagcaggtntaattaacaacttatacgttcctaccgtaggtaaccaaacaaccgaacccgaaggaccaaaaccgacccccaaaactacctaagtagttactttttacggaacggttactaaacgttaaacggccggtaccccgtacggtaaccggggttacccttagaaccgttccggtccctttacgtaccggtaacggttcccgtaaccgtaaacgttccgtacgggtaacccgaaaccggtaccccggtaccccgttaccccgtacggtaaccccgtcccggtttacggttccgggacccttacccgaacggtaacccgttaggggaaaccgtaggttacggtaacggtacgttagtaacgtttaacgtacgttacgacgtaccgtcccgtaattaacgtacgtttaccggaacgaccgtaacggaacccttaacgggtaacgggtttaccgggtaaccgggtaacggggtaacccggtaaaccgttaacgggttacgtaaccccgggttaccgttaacgggtaacccgtaccgggaccccgtaaacggggtcccccttaccccgggtcccccgtttaacgggtcccctaaccggtttaccccggtttaaccccgttaccccccgcccgtttaacccccggg

SEQ ID NO: 58695 - DNA, 839 bp, Homo sapiens
  misc_feature: GYAE6OF01E357W.8.42.D09.1.454.CMB.1.raw
  modified_base (297)..(297): a, c, t, g, unknown or other
  misc_feature (297)..(297): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggacgccagcagtcgattacaactatactctcctggtaccaacaaccacccaggaccaaacgacccccaaactcatntattttgagtcaataacgccggccctcgacgggtccctagactcgtcttccgtcacggcctaccgaagtcgtcggacaacaccggccctcccgtacgacccgttccgtccgtcgggtcctcccgaacgtacgttacggaacgggtacgttagggacgggtccgttacggttaacttttaacgttttaaccgtacggtaccgtaacgggttaccttaccgttaacgtttaaccgtttacggtaaccgggtaaccgaaaccggtaacccggtaaaccggtaaaccgggggtttaacgggtttacccgggggaaccggggtaaaccggggtaaacccggttaaaccgggtttaccgggtaaaccccgggtttaccccggttaaccgggttaaccccggtaacccgggtaaccccccggtaaacgggtacccccgttacccccgggttacccccccccggtttaccgggttacccccgttaacccggtttaccccccgtttccccgggttttaccccccccggtcccccccgtttaaccccccggg

SEQ ID NO: 58696 - DNA, 811 bp, Homo sapiens
  misc_feature: GYAE6OF01DM83I.8.42.D09.1.454.CMB.1.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcgagggcacgagggtcctcgggcccagtcctgccctgactcacgcccttccctccggcgtccggtctccgtggacngtcagtcaccatcctcctagccacgtggacnccagcaaggtnaatttaacaactatactctacctggtaaccaacaaccaccaggacaaaccgaccccaaactcatcgttattttgaggtacaaatacggccgaccctcgtacggggtccctagtactacgtcgttactcgacggtaccttaccgaacgttccgtacgggacccaaacggtacccggtaccccttacccctcggtacccgttccgtccggttacggggaccttacccgtaaggtaacccgtagggtaccgggtaagtacggtaacggggtaccttagaaacgtttttaacgtaccgttacgggacttacgggtaccttaccgtaacgtttaacgtttaccggagggtaccaaacggtaccgtaaaacggtacgggggtttaccgttacgggggaaccgggtaacgggtaaccctaaagggtttacccggtaccggttacccggtaagggtacccaaacgggtaccccgaacgggttcccgttaaccccgggtccccccttaaccgggttacccgtaaaccctttcccggtttaccccggttccccccgtccgttaaacccccgg

SEQ ID NO: 58697 - DNA, 441 bp, Homo sapiens
  misc_feature: GYAE6OF01DGSX5.8.42.D09.1.454.CMB.1.raw
  modified_base (426)..(441): a, c, t, g, unknown or other
  misc_feature (426)..(441): n is a, c, g, or t
tcagctcgcgtgtccacgaccggtgctcgatttagacacatacgcagggaaaggggctggagtgggtctcagttatttatcgcgatggtggcacacactacgcagactccgtgaagggcagattcaccgtctccagagacaattccaagaacatggtgtatcttcaaatgaacagactaacagccgaggacacggccgtatattactgtgcgagacatgactacggtgagcccgtgggccagggaaccctggtcaccgtctcctcacgcctccaccaagggcccactccggtccttcccccgtggccgcccctgcctccgagggacgccaccctccgagacgcaccgacgccggccctgggctcgccgtggtacaaggactaacgttccgacacgcgagctgaggcgggctggcaaggcgcatagnnnnnnnnnnnnnnnn

SEQ ID NO: 58698 - DNA, 784 bp, Homo sapiens
  misc_feature: GYAE6OF01D2Z6F.8.42.D09.1.454.CMB.1.raw
  modified_base (253)..(253): a, c, t, g, unknown or other
  misc_feature (253)..(253): n is a, c, g, or t
tcagctcgcgtgtccacgaccggtgctcgatttagacacatacgcaggggaaagggggctggggtctcaggaggcagcgctctcaggacgtcaccaccatggcctgggctctgctcctcctcaccctcctcactcagggcacgacgggtcctcgggcccagtctcgccctgactcacgtccctcccgtccggcggttcccgggtctccgtggactacgtcacgtccacctactcctcctcgcctacgtggacnccgagcagttagaacttaacaacttatacttccgtacctacggtaacccaaaccaaaccgacccgaaggaacccgaaaccccgtaccccctaaaactcgtaacgtttacgttttacgtttttacgggaacgttaacctaaaggtaaccggcccggtacccgtacgggtaccggggttccctagtacctccgtcctttaccgcgaccgtcctaaccgtacggttccgacgaccaaccgtccggtcccttacccgtcgtcccgtcgttcggtcgtccacgtagtaccgtagacggtatcggtacgttctaagttattacgtctacgacgtaccgtactaccttaattaccgacgtcggaacaccgtaacgggtaaccggtagggttaacgggaccgggtacgggtaaaccggtacggttaccgggtccgtaacccggttcggttaagggaccctacgggtaccgacccggttcccgaccccgggtccccgttacggtacccctttacccgttccggttcccccggtcccccgg

SEQ ID NO: 58699 - DNA, 785 bp, Homo sapiens
  misc_feature: GYAE6OF01C1BXC.8.42.D09.1.454.CMB.1.raw
  modified_base (203)..(203): a, c, t, g, unknown or other
  misc_feature (203)..(203): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcgagggcacgagggtcctgggcccagtctcgccctgactcacgtcctccctccgcgtccggtctccgtggacncgtcacgtcacctatcctccgtagccacgtcggacgccaagccgagtacgtaacttaaccaacttatactcctccgtacggtaaccaacgaaccaaccgaacggaaccaaaaccgaccccctaaaactccgtaattaggtttaacgtttttacggaacggttaactaaacgttaaccggcccggtaccgtaccggtaccgggtacctagtaccgtcgttccgtactcgacggtacctacgtaacgtcgtacggaccaaccggccgtaccctccgtacgtacccgttccgtacggtcggtcctacgtacgtacgtaggacggtagtcggacggttctacgttattacgttcgactcgtacgtctacgtattactcggactacggaacgtacggtaaacggtagggttccggtaccgggacggtaccgggtaacttaaccgggtcggttaacccggtaccggtaacggtacccggtaacccggacccggttaacgggtcccctacccccggggttacccttaccgggttacccctaacccgggttttccccttaaccccgggtcccccgtcccgtttacccggg

SEQ ID NO: 58700 - DNA, 686 bp, Homo sapiens
  misc_feature: GYAE6OF01AVRNQ.8.42.D09.1.454.CMB.1.raw
  modified_base (494)..(494): a, c, t, g, unknown or other
  misc_feature (494)..(494): n is a, c, g, or t
  modified_base (673)..(673): a, c, t, g, unknown or other
  misc_feature (673)..(673): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagccagcagtgattacaacttatatcctcctaggtaaccaacaaccacccaggaccaaaccgcccccaaaactcattagtatttttaggaggttacaaataacggccggtaccctcggacggggtcccctgactccggtcttcgtcgacggcctaccgaagtccgtaggaccaacgacccggtcctcccgtacgtacccgtcctacggtcgggcctaccgacggtaccgttggacggtaagtcggacggtctaggtacttaactttaccgngtactacggtcttacaattgtacgacggactacgacgaacgtaggggttacgttccgggacgggtaacggaccgtaaaggttccggtaacccggttctaacgggtaccgaccggtaccccaggggtccctacccggcccccgttacggtaccctaccgttcccgtcccggtttcccccncccccggttaccg

SEQ ID NO: 58701 - DNA, 896 bp, Homo sapiens
  misc_feature: GYAE6OF01D84T9.8.42.D09.1.454.CMB.1.raw
tcagctcgcgtgtccacgaccggtgctcgatttagacacatacgcagggaaaggggtctgggagaggagcccagcactgggattccgaggtgtgtccattcggtgatcagcactgaacacagaggactcaccatggagttctggcgtgggcttgggttttccttgttgctaatttacaaaggtgtccagtgtgaggtgcgagcgtgggtggaggagtggggaggggtcttgagtccgacgggtcccgggggggtcctggacggtaccttccgttccgtggtcgccgtacgtcccgtccgttcggtcctttacccgaacctacgtaccgtaaaggttaacggtaacgtaaccttaacaacggttcgggaacggtcccgtccgggggcccccgtaccggaccggtcccgtacgggaacgggggtaacggggccgttaggggtacggttcgggttactaccggtttaaggtttaacgtttacggtccggtacgtagggttcggggtacgactaacccgaaccgtaaccgtacggacgtaaccggtaccgtaccggggtaaggtaaccggggtaccaacgggtttaaccgtacccggtaacccgttacccgaaccggtaacgtaacggtaacctaacgtaaccggaaagtaacccgtaggttacggtaacgtttaacttaccgtaaacgtaaagtaacgttaaacccgaaacggttaaacccgtaagggaaaccgggtcccggaaaagggttaacccggtacccgggttacgttaaaacttttaccggttaacggttagtaaccggacggttaacgaaaccgttagggtaacccgttaaaccgggtaccgggttaccgggaaacccgggttcccccgggtaaggggggtaaaccccccgg

SEQ ID NO: 58702 - DNA, 817 bp, Homo sapiens
  misc_feature: GYAE6OF01C9BCX.8.42.D09.1.454.CMB.1.raw
  modified_base (229)..(229): a, c, t, g, unknown or other
  misc_feature (229)..(229): n is a, c, g, or t
tcagctcgcgtgtccacgaccggtgctcgatttagacacatacgcagggaaagggggggggtctcaggaggcagcgctctcaggacgtcaccaccatggcctgggctctgctcctcctccaccctcctcactcgacgggcacgacgggttccgcgggcccagtcctcgccctgactcacgcctccctcgcgtccgggtctccgtggactagtcagtaccacatcctccngtcacgtcggacgcagcagtactactaacacttatctctccgtacgaaccaacaaccaccgacgaaccaaccgacccaaatctagttagttagttttaggacgtaactaacgtaacgccgtaccgtcggtaccggtccgtagtaccgtcgttaccgtactaccggtacggtaccttaccggtaacgtccgtaacggtaaccaaaccggtaccccggtacccttcccggtaacggttacccgtccggtttaccggcgggtaacccttacggaacgggtacgtaccgggtaaggtaaccgtagggtaaccgtacgtttaacggttaacgtttacttaaccggtacgtaaccgtactacccggttatacgtttaacgttacggacgaaccggttacaaaccgggttaacgggtaccgggttaccgggttaaccggggcgggttaaaaccgggtacgttaaccgggttccgtaacccggtaccggtaacgtaaccgcccgggtaaccgtaccgggtacccgtccccggtaacccgttaccgggttccctacccggttaacccgttccccggtaccccgtccggttacccggg

SEQ ID NO: 58703 - DNA, 753 bp, Homo sapiens
  misc_feature: GYAE6OF01AG6AT.8.42.D09.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
tcagctcgcgtgtccacgaccggtgctcgatttagacacatacgcagggaaaggggggggtctcaggagcagcgctctcaggacgtcaccaccatggcctgggctctgctcctctcaccctctcactcagggcacgagggtcctgggcccagtcctgccctgactcacgccctcccgtccgcggtccgggtctcctggacaggtcagtccaccgtntcctccgngcacgtggacgccaggcaggtnaacttaacactatctctccgtacgtaaccaacaaccaccgacggaaccaaaccgaccccaaactctaagttcgttagttttaggacgttacaacgttacgccggtacccgtacggtccgggtcctaggctcgtccttcgtacgtacgtacctacgtacgtcgtacggaccgacgtacccggtcctcccggtacgtacccgttcgtcggtcggtaccttaccaacgggtacgtacggaacggttacgacgggtacggtacttaaggtaactttacgttaaccgtccgaacgttacgacttactaacgtacgttacggaccgtaacggtacgtaaccggtaacggtaacgggtttacgtaccggggacggttaaccggaaccgttaacgggttccgtaaccggttccggtaacggtaccgtacggaacccggttacggtcccgtcccgtaaccccggttcggtacccttacggtacccgtttacccgttcccccggtaaccgttcccgg

SEQ ID NO: 58704 - DNA, 767 bp, Homo sapiens
  misc_feature: GYAE6OF01C76U4.8.42.D09.1.454.CMB.1.raw
tcagctcgcgtgtccacgaccggtgctcgatttagacacatacgcaggggaaaggggggggtctcaggaggcagcgctctcaggacgtcaccaccatggcctgggctctgctcctcctccaccctcctcactcgagggcacgacgggtcctcgggcccagtctcgccctgactcacgtccctccctccgcggtccgggtctccgtggactacgtctactccactctcctccgcgctacgtggacaccgagacgtagtacgtaacttaacaactactcttcgtaccgtacgaaacccaacaaccgaccgaacgaaccaaacccgtacccaagtctagttacgtttagtttacggaacgtaacaacgtaccggcccgtaccgtcgggtaccggtcctagtctactctacgtcgacgtcctacgtagtcgtaacggacctaccggacccgtcccgtaccgtacgtaccgtccgttacggtcccggtacctacgggtagtacggtacggagttaacgggcgtacgtacttaagtaacttcgtacgcgactcgtactaacgtattaccgacgaggtccaacggtaacggtacggggtaacggttccgggaccgggaaacggttaacccggacgttaccgggttcccgtaaccgggtccgttaacggacccgtaaccgggacccggttaaccggccccggttaccccggttcccggtaacgttcccgttacccggttaccccggttccccccgtcccgtccccggtaaccggg

SEQ ID NO: 58705 - DNA, 716 bp, Homo sapiens
  misc_feature: GYAE6OF01AMY59.8.42.D09.1.454.CMB.1.raw
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccntctcctgcacgtggacnccagcagtgattacaactatatcctcctacggaaccaacaaccacccgagaccaaaccgaccccaaactcatcgtattttggacgtacaagtaacgccggtcccgtacgacggggttccctagtactcgtcttctcggacgtcctacaacgttcgtacggacaaccgcccggtaccctcccgtacgtacccgttccgtcggttcgggtcctacccgtaacgtaccgtaggacggtatacgggaacgtcttaaggtatttacgttaccgcgtacacgtactacgtacttacgtacgtacggacgtacgaccgtaaggtacgggttaggtaccggacgggtaacggtaaccgtacggttacgtacccggttaccgttacggaccgaaccggtaccggaaccgggttccgtcccccggtaacccccggttcccggtaccgttacccgttccccgggttttacccgttccccccggtccccgttaaccccggg

SEQ ID NO: 58706 - DNA, 785 bp, Homo sapiens
  misc_feature: GYAE6OF01CAQSN.8.42.D09.1.454.CMB.1.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcgagggcacgagggtcctgggcccagtctgccctgactcagcctccctccgcgtccggtctccgtggacagtcagtcaccatctctgcacgtggacnccagcagtgattacaatntactctcctagtaaccaacaaccaccgaggacaaaccgacccaaatcatgtattttacggagtacaatacggccgccgtcgtacgggtcctagactcgtcttacgtcgacggtcctacgtaacgtccgtacgggacctaaccgacccggtccctacccgtacggtacccgttcgtaccggtcggacctacccgaggtaaccgtgggaacgtacggtagggacgtacgttaggttaactttacgttacgtacgtacgtacgttacctacgttaacgttacgtttacggaaccgtacgtaaacgaccggttaaacgggtacggggttaacggtacccgggggtaaaggtaaccggggttaaccgttaacggggttaacccgggttaacccggttaccggttaacgggtaaccccggtaaccggtaacccccggtaacgggttcccccgtaccccggggttaccccccgttaaccggttacccggtttacccttaccccgggtttaccccccgttcccccgggttacccccgttaacccggg

SEQ ID NO: 58707 - DNA, 624 bp, Homo sapiens
  misc_feature: GYAE6OF01BDL37.8.42.D09.1.454.CMB.1.raw
  modified_base (292)..(292): a, c, t, g, unknown or other
  misc_feature (292)..(292): n is a, c, g, or t
  modified_base (456)..(456): a, c, t, g, unknown or other
  misc_feature (456)..(456): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggacgccagcagtgattacaactatatcctcctggtaccaacaacacccaggacaaacgccccaaatcatntattttgagtacaataagccggccctcgacgggtccctagatcgtcttctacgaggtcctaccgaacgtctcggaccaaccgaccggccctcccgtacgacccgtcgtccggtggcctccgaagtactaggaggtagtcggaggtcttgtaactttagtttacngtacagctacatacttcgagtcaagactaacggtagggttaacgttcgggacggacgggtaccgtaacggttcgacccgtaccgtacgggtaccaccggacccgaacggtccctacccggtcccccgtcgtaccgtaccttaccgttcccgttccccgcccgttcccg

SEQ ID NO: 58708 - DNA, 698 bp, Homo sapiens
  misc_feature: GYAE6OF01D5QTE.8.42.D09.1.454.CMB.1.raw
  modified_base (229)..(229): a, c, t, g, unknown or other
  misc_feature (229)..(229): n is a, c, g, or t
  modified_base (360)..(360): a, c, t, g, unknown or other
  misc_feature (360)..(360): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcgagggcacgagggtcctgggcccagtctgccctgactcagccctccctccgcgtccggtctcctggacagtcagtcaccatcctcctgcacgtggacnccagcagtgaacttacaacttatactctcctaggtaaccaaacaaccacccaggaccaaacgaccccaaactcatgttattttgaggtacaagtaacggccggccctacgacgggtcctgactcgtcttcncgaggtcctaccgtaagtcgtcggaccaacgtaccggtccctcccgtacgacccgtcgtccgtcgggcctaccgacgtacgtaggaggtagtaggacggtctagtaatttacgtaaccgtgacgtacggtccttacgtaacttacttacggacggtacgaacgtaaccgtaacggtagggttaccggttaccggggacgggtaacgggtaccgtaacgggttccggaaccgttaccggtaacggtacccgtaccggtacccgtaacgggtcccgtcccggtacccccgttcggtacctacccgttccgttaccccggttccccgtccccgttaccccg

SEQ ID NO: 58709 - DNA, 825 bp, Homo sapiens
  misc_feature: GYAE6OF01EGLZF.8.42.D09.1.454.CMB.1.raw
  modified_base (207)..(207): a, c, t, g, unknown or other
  misc_feature (207)..(207): n is a, c, g, or t
tcagctcgcgtgtccacgaccggtgctcgatttagacacatacgcagggaaaggggggggtctcaggaggcagcgctctcaggacgtcaccaccatggcctggctctgctcctcctcaccctcctcactcgagggcacgagggtcctgggcccagtctgccctgactcacgcctccctcgcgtccggtctcgtgacagtcagtcacntcctctgcacgtggacgccagctagtcgacttaacaacttactacttccttcctacggtaaccaaacaacccaacccgacgaccaaaccgaaccccaaactacacgttagttagtttttaggacggttactaaacgtaacggtcccggtacccgtccggtaaaaaaccggggttcccgttacggtacgttccggttaccttaccgttaccgaccggtaccgttaccgtaacgttaccggtacggtaaccgaaccggtacccggtaccccgttacccgttaccggttaacccgttccggttaccggtcccgggtacccgttacccggtaacggttaccggtacggtaacgggtacgttacgggtacgggttacgttaacggttaacgtttacgttacgtacgtacgttaccggtaccttacgtaacgttacgttacgacggtagaaccgtaacgaacggtacgggttaccggtacggggtacgggtaacggtaaccggtaacggttaccgtacccgggttaccgtacggtaaccgaccggtaccgtaccggtccgtccccggtacccgtacccggtccctaccgttacccgttacccgttccccgtcccgttaccccgg

SEQ ID NO: 58710 - DNA, 747 bp, Homo sapiens
  misc_feature: GYAE6OF01BNUID.8.42.D09.1.454.CMB.1.raw
  modified_base (225)..(225): a, c, t, g, unknown or other
  misc_feature (225)..(225): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgganccagcagtgattacaactatatctctggtaccaacaacaccaggacaaacgaccccaaactccatgtattttgaggtacaataacgcggccctcgacgggtccctgactcgtcttctcgacggcctaccgaagtcgtggacaacgacggtccctcccgtcgtacccgtcctcgtcgggtcctaccgtacgtacctgggtaaggagtacggacgggtacccgttaggttaactttaacgtttaaccgtcggtaccgtaaggtcccttacgtaacttaacgtttacgaacgggccgtaacgaaccgttaaaccggtaggggtttaacggttccggggtaaccgggggtaaccggggtaaacccttaacggggtttaccgaaccccgggtttaccgttaacggggttacccgaaccgggtaacccggtaaacgggtccccgtaacccggtcccccccggtaaccgggttaccctaacccgttcccggtttaccccgttaccccccgtaccccgttaccccccggg

SEQ ID NO: 58711 - DNA, 777 bp, Homo sapiens
  misc_feature: GYAE6OF01BYUCF.8.42.D09.1.454.CMB.1.raw
  modified_base (125)..(125): a, c, t, g, unknown or other
  misc_feature (125)..(125): n is a, c, g, or t
  modified_base (226)..(226): a, c, t, g, unknown or other
  misc_feature (226)..(226): n is a, c, g, or t
tcagctcgcgtgtccacgaccggtgctcgatttagacacatacgcagggaaaggggggggtctcaggaggcagcgctctcaggacgtcaccaccatggcctggctctgctcctcctcaccccctnactcaggcacagggtcctgggcccagtctcgaccctgactcacgcctccctcgcgtccggtctccgtggacagtcagtcaccatcctcctagcactggacnccagccagtcgtaacttacaactatagtccttaccgtaggtaaccaacaaccgacccgaagggaccaaaaccggcccccaaaactccgtattacgttaacttttttcggaacgggttacaaacgttaacggccggtacccctaggaacggggttcccctaggtacttccggtctttaccgaccgtacgggtccttaccgaagttccgtaggaccctaaccgtaccggtccctcccgtacgtacccgttccgtaccggtcgggtacccttccgaacgtaccgttggaacggtacgtacggacgggtacgtacgttaagtttacgttaccggtgtaccgtacggtcctaactacttacgttacgacggtaccaacgtaccgtaacggtacggggttacgttaccggggaacgggtaaccgggttaacgtacgttaaccggtaccggttaccgttacggtacccgacggtaccccggtaggtacccggtcccggtaccccgtccggttacctacccttcgttaaccccgttcccctacccgtcccgtacccggg

SEQ ID NO: 58712 - DNA, 810 bp, Homo sapiens
  misc_feature: GYAE6OF01D1UOK.8.42.D09.1.454.CMB.1.raw
  modified_base (230)..(230): a, c, t, g, unknown or other
  misc_feature (230)..(230): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctctcactcgagggcacgagggtcctcgggcccagtctgccctgactcacgcctccctccgcgtccgggtctccgtggacagtcagtcacatctcctgcacgtggacnccagcagtcgtaattacaacttactatcctccgtacgtaaccaaacaaccaccgaggaaccaaaccgacccaactcagtgttagttttacgaggtacaagtacgccgtacccgtgtaccgggtcctagacttcgcttacgcgacgtcctacgagtcgtcggacaacgtacccgtccctaccgacgtacccgttccgcgtgggtccctacggtacgtacgttacgggacggtagttacggacgttacgttaacgttaagtttaccgttacgtcgtacgtacgtccttacgttaagttacccgtaggtaaccgggtacctaaccggtaccgtaaaacggggttacgggtttaacggtacccgggggtaacgggtaaaccgggttacccgttaaaggggttacccggttaaccccgggttcccgggttaaacggggtttcccgaaaaccccgggttacccggtttaaacccgggccccggttttacccccgggtaccccccgggtttacccgggtaaccgtttccccggtttaccccggtttaccccccggttccccccggtaccccgtttaacccccggggg

SEQ ID NO: 58713 - DNA, 652 bp, Homo sapiens
  misc_feature: GYAE6OF01C92A1.8.42.D09.1.454.CMB.1.raw
  modified_base (226)..(226): a, c, t, g, unknown or other
  misc_feature (226)..(226): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (399)..(399): a, c, t, g, unknown or other
  misc_feature (399)..(399): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacgagggtcctgggcccagtctgccctgactcagcctccctcgcgtccggtctccgtggacagtcagtcaccatctcctgcactggacnccagcagtgattacaactatacgtctcctgtaaccaacaacaccaggacaaacgccccaaactcatcgtattttgacgtacaatagccgcctcgagggtcctgatcgctcncnggctcgaacgtctacggcaacgtacggcctccgtcgaccgtctcgtacgggtcctaccgngtaaccgtggacggtagtaggaacggtccgttaggtaacttttaacgttaccgtgtactaacggttaccctagtaacttttaacgtacgaaggttcgaacgaccgtaaacgtagggttacggtccgggagggtaacgggaccgtaacggtttcgaacccggtcgtacggtaccgaacgacccggtaacggtcctcccggtacccccgtgggttccctaaccgttcctttacccggtcccctcccgttaccccg

SEQ ID NO: 58714 - DNA, 684 bp, Homo sapiens
  misc_feature: GYAE6OF01ASVPF.8.42.D09.1.454.CMB.1.raw
  modified_base (228)..(228): a, c, t, g, unknown or other
  misc_feature (228)..(228): n is a, c, g, or t
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
tcagctcgcgtgtccacgaccggtgctcgatttagacacatacgcagggaaaggggggggtctcaggaggcagcgctctcaggacgtcaccaccatggcctgggctctgttcctcctcaccctcctcactcaggcacagggtcctgggcccagtctgccctgactcagccctccctccgcgtcccgggtctcctggacagtcagtcaccatcctcctgcactgggacnccagcagtgacttacactatacttctcctgtaccaaccacacccagcaaacgcccaaactcatcgtnttttgagtcaatacgcgcctcgngggtccctgactcgtcttcncaggctcaagtcgtcgacaccgaccggtccctcccgtacgacccgttcgtcgtacgggtcctaccgacgtaacgtcggaggtatcgggacggtcgttaggtaactttacgttacttcgactacgtctacctaagttcttaacgacggacgacgtaccgtaacggtaagggttacccggtttaggggaccggtaacgggtaacccttaagggttaccgtaccccggttaccgtacgggtacccgtaacggtccccggtaaacggccggtccccggtaccccccgttaccgttcccgtaacccgttcccttaccccggttaccccccgccccgttacccgtcccccgg

SEQ ID NO: 58715 - DNA, 728 bp, Homo sapiens
  misc_feature: GYAE6OF01BLKWC.8.42.D09.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcaccatcncctgcacgtggacncagcagtnattacatatatcctcctagtaccaacaaccacccagaccaaccgcccaaactcactgtattttgaggtacaagtacgtccgcctcgacgggtccctgtatccgtcttccgtacgacggcctacgtaacgtccgtaggtaccaaaccggtcccgtcccgttacccgtcgggtaccccgttccgttaccggtacgggtccctaccgacggtaccgtagggtaacggtgttacgggacgttcgttaagttacttaagttaccgtcgggtaccctacggtaccttacgtaagtttacgtaccggtaacgggcgtaaacgaacgtaacgggttagggttacccggttacggggaacgggttaacggacccggttaacggttcccggtaaccggttacccggttaagggcccgtaaccgggcccgtaaccgggtccctcccgggtaccccgttcggtccctacgttacccgttcccgttacccccgtacccgtacccg

SEQ ID NO: 58716 - DNA, 649 bp, Homo sapiens
  misc_feature: GYAE6OF01DNXQW.8.42.D09.1.454.CMB.1.raw
  modified_base (225)..(225): a, c, t, g, unknown or other
  misc_feature (225)..(225): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgganccagcagtgattacaactatatctcctggtaccaacaacacccaggacaaacgaccccaaactcatgtattttgaggtacaataagccggccctcgacgggtcctgactcgtcttctcgacggtctacctaagtcgtaggaccaacgaccggccctcccgtcgaccgttctcgtcgggtcctaccacgacgtaggacggtagtggaacggtctagtaatttacttacgtcgactaggtctacgtaagttacttcgaacggtcaacgtcgaaacggtaggggtttaacgtccggggacgggaacgggtaccgtaacggttaccggaaccgttaccgtaaggtaccgaacggtaccccgaaggtcccgtacccgtccccccgttagtcccttacccttccgtacccgttcccctacccgttacccg

SEQ ID NO: 58717 - DNA, 766 bp, Homo sapiens
  misc_feature: GYAE6OF01DKAU9.8.42.D09.1.454.CMB.1.raw
tcagctcgcgtgtccacgaccggtgctcgatttagacacatacgcaggggaaaggggggggtctcaggaggcagcgctctcaggacgtcaccaccatggcctgggctctgctcctcctcaccctcctcactcgagggcacgagggtcctgggcccagtctgccctgactcagccctcctccgcgtccgggtctccgtggacagtcagtcaccatctcctgcacgtggagccagcagtgattacaatatatcctctagaaccaacaaccaccgacgacaaacgaccccaaatcatgtattttggacgtactaagtacgccggtccctacggtacgggtaccctcggatcgtccttcgtacgacggtacctacgaacgtcgtacgaaccgtaacgtaccggcccttacccgtacgtaccgttcctacggtcgggtacctaccgtaaggaccgttaggacggtagtacggacggtctaaggttaactttaacgtacgttacgacgtacgtacttacgttaacttaacggttacaacgggtaacgtaacggtaacccgtaaacgggtacggggtttaaggttaacccggggacggggtaacccgggtaaaccgttaagggtttaccggaacccggttaaccccgggtttaagggaccccgtaaacgggtacccccggtaaaggccccggtttaacccggccccccgttacggtacccgttaaccgttacccggtttaccccccgggtccccgttcccccgttaccccggg

SEQ ID NO: 58718 - DNA, 701 bp, Homo sapiens
  misc_feature: GYAE6OF01CC5ZV.8.42.D09.1.454.CMB.1.raw
  modified_base (677)..(677): a, c, t, g, unknown or other
  misc_feature (677)..(677): n is a, c, g, or t
tcagctcgcgtgtccacgaccggtgctcgatttagacacatacgcagggaaagggggctggggtctcaggaggcagcgctctcaggacgtcaccaccatggcctgggctctgctcctcctcaccctcctcactcgagggcacgagggtcctgggcccagtctgccctgactcacgtccctccctccgcggtccgggtctccgtggacagtcacgtccacctactcctcctgccacgtggacgccagcagtgtaacttacaacttatacttcctccgtacgtaaccaaccaaccaccgaacggaccaaaccgacccccaaactacagttgtttacgtttttacgaggttacaacggttacggccggtcccgtacggaccggggtccctagtactccgtcttccgacgcggtcctacgacgttcgagtacccaaccggtcccggtaccctcccggtacgtcccgttaccgtcggtcgggccctacgacgtacggtgggagtgtaggaggtcttagtacgtttacttcgtacgctacgtacttataacgttacgttcgacgtactaacggacgtaacggttacgggtacggttcgggacgggtaacggtacgtacgggtccgtaccgtcggtacgaccggaccgtaccggacggttcccgtcccggtcccgtccgtaccncccgttcgttaccccttcccccgg

SEQ ID NO: 58719 - DNA, 671 bp, Homo sapiens
  misc_feature: GYAE6OF01ECYB2.8.42.D09.1.454.CMB.1.raw
  modified_base (210)..(210): a, c, t, g, unknown or other
  misc_feature (210)..(210): n is a, c, g, or t
  modified_base (455)..(455): a, c, t, g, unknown or other
  misc_feature (455)..(455): n is a, c, g, or t
tcagctcgcgtgtccacgaccggtgctcgatttagacacatacgcagggaaaggggggggtctcaggaggcagcgctctcaggacgtcaccaccatggcctggctctgctcctcctcaccctcctcactcagggcacagggtcctgggcccagtctgccctgactcagcctccctccgcgtccgggtcctccgtggacagtcagtcaccntctcctgcactggagccagcagtcgattacactatatctctgtaccaacaacaccagcaacgccccaaactcatgtattttagaggtactaaagacgtccggcctacgacgggtccctgactcgcttcgcacggtcctacctagtcgtaggaccaacgaccggtccctcccgtcgtacccgtctccgtcgggcctacgacgacgtaggacgtacgtgaacgggtctaggtaactttacgttacgngccgtaacggtcttactaagttactttcgaacggctaaacggaccgttaaacggtaggggttaccgttaccggggaacggtacgggtaaccgttaggtaccggtacccgtaccggtaggtacccgtaccggacccgtaaggccccgttaccccggtcccccgttacgggttaccctaccgttacccgtttacccgttccccgtcccgttaccccgg
